United States Patent 12,747,451 (RNA ENCODING AN ANTIBODY) - sequence listing, part 2

SEQ ID NO: 4168 - protein, 122 aa, synthetic construct
  REGION 1..122: note = anti-HIV_Chain
SQHLVQSGTQVKKPGASVRISCQASGYSFTDYVLHWWRQAPGQGLEWMGWIKPVYGARNYARRFQGRINFDRDIYREIAFMDLSGLRSDDTALYFCARDGSGDDTSWHLDPWGQGTLVIVSA

SEQ ID NO: 4169 - protein, 122 aa, synthetic construct
  REGION 1..122: note = anti-HIV_Chain
DIQMTQSPSSLSASVGDRVTITCRASQSISRYLNWYQQKPGKAPKLLIYAASSLQGGVPSRFSGSGSGTDFTLTISSLQPEDFATYYCQQSSSKPFTFGGGTKVEIKRTVAAPSVFIFPPSD

SEQ ID NO: 4170 - protein, 122 aa, synthetic construct
  REGION 1..122: note = anti-HIV_Chain
EIVLTQSPGTLSLSPGERATLSCRASQSISSNYLAWYQQKPGQAPRLLIYGASTRATGIPDRFSGSGSGTDFTLSISRLEPEDIAVYYCHQYGSSQRFGQGTKVEIKRTVAAPSVFIFPPSD

SEQ ID NO: 4171 - protein, 122 aa, synthetic construct
  REGION 1..122: note = anti-HIV_Chain
EIVMTQSPATLSVSPGDRATLSCRASQSVSTNLAWYQQKPGQAPRLLIYGASTRATGIPATFSGSGFATEFTLTISSLQSEDFAVYYCQQYNNWPPAFGQGTKVEIKRTVAAPSVFIFPPSD

SEQ ID NO: 4172 - protein, 122 aa, synthetic construct
  REGION 1..122: note = anti-HIV_Chain
DIQMTQSPASLSASVGDRVTITCRASQGISHYLAWYQQKPGKVPRLLIYAASRLQSGVTSRFSGSGSGTEFTLTISSLLPEDAAVYFCQKYDTDPMTFGQGTRLEIKRTVAAPSVFIFPPSD

SEQ ID NO: 4173 - protein, 122 aa, synthetic construct
  REGION 1..122: note = anti-HIV_Chain
QSALTQPPSASGAPGQRVTISCSGGPSNVGGNYVYWYRQFPGTAPNLLILRDDQRPSGVPDRFSASKSGNSASLAISGLRPDDEAFYFCATYDSDGSIRLFGGGTTLTVLSQPKAAPSVTLF

SEQ ID NO: 4174 - protein, 122 aa, synthetic construct
  REGION 1..122: note = anti-HIV_Chain
DIQMTQSPSSLSASVGDRVTINCQAGQGIGSSLNWYQKKPGRAPKLLVHGASNLQRGVPSRFSGSGFHTTFTLTISSLQPDDVATYFCAVFQWFGPGTKVDIKRTVAAPSVFIFPPSDEQLK

SEQ ID NO: 4175 - protein, 122 aa, synthetic construct
  REGION 1..122: note = anti-HIV_Chain
DIQMTQSPSSLSASVGDRVTITCQASQGIGSSLQWYQQKPGRAPNLLVHGASKLHRGVPSRFSGSGFHTTFSLTISGLQRDDFATYFCAVLEFFGPGTKVEIKRTVAAPSVFIFPPSDEQLK

SEQ ID NO: 4176 - protein, 122 aa, synthetic construct
  REGION 1..122: note = anti-HIV_Chain
QVHLVQSGAEVKKPGASVKVSCKVSGYTLSELSIHWVRQGPGRGLEWMANFDPEDGETIYAPQFQGRVTLTEDTSTDTAYMQLTSLRSEDTAVYYCATDRYTDTGRWGPGTLVTVSSASTKG

SEQ ID NO: 4177 - protein, 122 aa, synthetic construct
  REGION 1..122: note = anti-HIV_Chain
QVQLVESGGGLIQPGGSLRLSCEASGFAVGDINYMSWVRQAPGKGLEWVSVLYSGGSSQYADSVKGRFTISRDNSRNTLYLQMDNLRAEDTAVYYCARGLRVYFDLWGQGILVTVSSASTKG

SEQ ID NO: 4178 - protein, 122 aa, synthetic construct
  REGION 1..122: note = anti-HIV_Chain
QVQMVASGGGLVKPGGSLRLSCEASGFTFSDYYMSWVRQAPGKGLEWISYITSGGNALYYADSVKGRFTISRDNAKNSLYLQMNSLRAEDTAVYYCARDLLHAHDFGRQGTLVTVSSASTKG

SEQ ID NO: 4179 - protein, 122 aa, synthetic construct
  REGION 1..122: note = anti-HIV_Chain
QLQLVESGGGVVQPGRSLRLSCAASGFTFSTYTMHWVRQAPGKGLEWVAVISYDGTNKYYADSVKGRFTISRDNSKNTLYLQMNSLRGEDTAVYYCARSPSYYFDYWGQGTLVTVSAASTKG

SEQ ID NO: 4180 - protein, 123 aa, synthetic construct
  REGION 1..123: note = anti-HIV_Chain
QVHLSQSGAAVTKPGASVRVSCEASGYKISDHFIHWWRQAPGQGLQWVGWINPKTGQPNNPRQFQGRVSLTRQASWDFDTYSFYMDLKAVRSDDTAIYFCARQRSDFWDFDVWGSGTQVTVSS

SEQ ID NO: 4181 - protein, 123 aa, synthetic construct
  REGION 1..123: note = anti-HIV_Chain
QVQLLQSGAVVTKPGASVRVSCEASGYKIRDYFIHWWRQAPGQGLQWVGWINPQTGQPNIPRPFQGRVTLTRHASWDFDTFSFYMDLKALRSDDTAIYFCARRRSDYCDFDVWGSGTHVTVSS

SEQ ID NO: 4182 - protein, 123 aa, synthetic construct
  REGION 1..123: note = anti-HIV_Chain
QVQLLQSGAAVTKPGASVRVSCEASGYNIRDYFIHWWRQAPGQGLQWVGWINPKTGQPNNPRQFQGRVSLTRHASWDFDTFSFYMDLKGLRSDDTAIYFCARQRSDYWDFDVWGSGTQVTVSS

SEQ ID NO: 4183 - protein, 123 aa, synthetic construct
  REGION 1..123: note = anti-HIV_Chain
QVQLLQSGAAVTKPGASVRVSCEASGYNIRDYFIHWWRQAPGQGLQWVGWINPKTGQPNNPRLFQGRVSLTRHASWDFDTFSFYMDLKAVRSDDTAVYFCARQRSDYWDFDVWGSGTQVTVSS

SEQ ID NO: 4184 - protein, 123 aa, synthetic construct
  REGION 1..123: note = anti-HIV_Chain
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTGVYFCARQRSDYWDFDVWGSGTQVTVSS

SEQ ID NO: 4185 - protein, 123 aa, synthetic construct
  REGION 1..123: note = anti-HIV_Chain
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 4186 - protein, 123 aa, synthetic construct
  REGION 1..123: note = anti-HIV_Chain
EVQLVESGGGLIQRGGSLRLSCVASGFPVSDNHMSWVRQAPGKGLEWVSIIYSDGGTYYADSVKGRFTISRDNSKNTVYLQMNSLRATDTAVYYCARDPGFHYGLDVWGQGTTVTVSSASTKG

SEQ ID NO: 4187 - protein, 123 aa, synthetic construct
  REGION 1..123: note = anti-HIV_Chain
QVQLQESGPGLLRPLETLSLTCSVSGGSIRGYFWSWVRQPAGRGLEWIGRIYSSGTTRFNPSLKSRVRLSIDTAKSEVSLNITSVTAADSASYFCAGTSPVHGGLDLWGLGLRVTVSSASTKG

SEQ ID NO: 4188 - protein, 123 aa, synthetic construct
  REGION 1..123: note = anti-HIV_Chain
EIVLTQSPGTLSLSPGERATLSCRASQSVSSNLAWYAQKPGQAPRLIIYGASSRASAIPDRFRGSGSGTDFTLTISRLEPEDFAVYYCQQYDDAPITFGHGTRLEIKRTVAAPSVFIFPPSDE

SEQ ID NO: 4189 - protein, 123 aa, synthetic construct
  REGION 1..123: note = anti-HIV_Chain
EIVLTQSPGTLSLSPGDRAALSCRASETLSGNSLAWYQQKRGQPPRLLIFAASSRATGIPERFSGGGSGTDFTLTITRLEPEDFAVYFCQQYVDAPITFGQGTRLEIKRTVAAPSVFIFPPSD

SEQ ID NO: 4190 - protein, 123 aa, synthetic construct
  REGION 1..123: note = anti-HIV_Chain
DIQMTQSPSSLSASVGDRVTITCRASQDITTYLAWLQQKPGKAPKSLIYSASTVQSGVPSRFSGSGSGTEFTLTISGLQPEDFATYYCQQYNYYPITFGLGTRLEIKRTVAAPSVFIFPPSDE

SEQ ID NO: 4191 - protein, 123 aa, synthetic construct
  REGION 1..123: note = anti-HIV_Chain
DIQMTQSPSSLSASIGDRVTITCRANQHIRSFLNWYQQTPGKAPKLLIYAASTLQRGVPSRFSGSGSGTDFTLTITSLEREDLATYYCQQTYTSPITFGQGTRLEIKRTVAAPSVFIFPPSDE

SEQ ID NO: 4192 - protein, 123 aa, synthetic construct
  REGION 1..123: note = anti-HIV_Chain
SEIVLTQSPATLSLSPGESATLSCRASQSLSSSLAWYQQKPGQAPRLLIYDTSDRATGIPARFSGRGSGTDFTLTISSLEPEDFAVYYCQQRSNWAITFGQGTRLEIKRTVAAPSVFIFPPSD

SEQ ID NO: 4193 - protein, 123 aa, synthetic construct
  REGION 1..123: note = anti-HIV_Chain
QVLSVSGTPGQRVIISCSGTSSNVGGNLVSWYQHLPGAAPRLLIHRDDQRPSGVPDRFSGSKSGNSASLVISGLRSDDEADYFCAAYDSTFSLPVFGGGTRLTVLSQPKAAPSVTLYAPSSEE

SEQ ID NO: 4194 - protein, 123 aa, synthetic construct
  REGION 1..123: note = anti-HIV_Chain
DIQMTQSPSSLSASVGDRVTITCQAGQGIGSSLQWYQQKPGKAPKLLVHGASNLHRGVPSRFSGSGFHTTFSLTISGLQRDDFATYFCAVLEFFGPGTKVEIKRTVAAPSVFIFPPSDEQLKS

SEQ ID NO: 4195 - protein, 123 aa, synthetic construct
  REGION 1..123: note = anti-HIV_Chain
EIVLTQSPATLSLSPGERATLSCRASQGLNFVVWYQQKRGQAPRLLIHAPSDRAPGVPDRFSARGSGTDFSLVISSVEPDDFAIYYCQEYSSTPYNFGPGTRVDRKRTVAAPSVFIFPPSDEQ

SEQ ID NO: 4196 - protein, 123 aa, synthetic construct
  REGION 1..123: note = anti-HIV_Chain
EIVLTQSPTTLSLSPGERATLSCRASQGVNLVVWYQQKRGQAPRLLIYGPSDRAPGVPDRFSARGSGTEFSLVISSVEPDDFALYYCQEYSSTPYNFGTGTRVDRKRTVAAPSVFIFPPSDEQ

SEQ ID NO: 4197 - protein, 123 aa, synthetic construct
  REGION 1..123: note = anti-HIV_Chain
EIVLTQSPATLSLSPGERATLSCRASQGVNFVVWYQQKRGQAPRLLIYGPSNRAPGVPDRFSARGSGTEFSLVISSVEPDDFALYYCQEYSSTPYNFGPGTRVDRKRTVAAPSVFIFPPSDEQ

SEQ ID NO: 4198 - protein, 123 aa, synthetic construct
  REGION 1..123: note = anti-HIV_Chain
EIVLTQSPATLSLSPGERATLSCRASQGLNFVVWYQQKRGQAPRLLIHGPSHRAPGVPDRFSARGSGTEFSLVISSVEPDDFAIYYCQEYSSTPYNFGPGTRVDRKRTVAAPSVFIFPPSDEQ

SEQ ID NO: 4199 - protein, 123 aa, synthetic construct
  REGION 1..123: note = anti-HIV_Chain
EIVLTQSPATLSLSPGERATLSCRASQGLNFVVWYQQKGGQAPRLLIHGPTDRAPGVPDRFSARGSGTEFSLVISSVEPDDFALYYCQEYSSTPYNFGPGTRVDRKRTVAAPSVFIFPPSDEQ

SEQ ID NO: 4200 - protein, 123 aa, synthetic construct
  REGION 1..123: note = anti-HIV_Chain
EIVLTQSPATLSLSPGERATLSCRASQGLNFVVWYQQKRGQAPRLLIHAPSGRAPGVPDRFSARGSGTEFSLVISSVEPDDFAIYYCQEYSSTPYNFGPGTRVDRKRTVAAPSVFIFPPSDEQ

SEQ ID NO: 4201 - protein, 123 aa, synthetic construct
  REGION 1..123: note = anti-HIV_Chain
QVQLVQSGAEVKKPGSSVKVSCKTSGGSFSNYAFSWVRQAPGEGLEWMGRIIPIFGTAKYTQKLQGRVTITADKFTSTVYMELSSLRSEDTAIYYCASLHQGPIGYTPWHPPPRAPLGQSVCG

SEQ ID NO: 4202 - protein, 123 aa, synthetic construct
  REGION 1..123: note = anti-HIV_Chain
QVQLVESGGGLVQPGGSLRISCSATGFTFSTHAMHWVRQAPGKGLEYVSAINSNGRSAFYADSVKGRVTISRDNSKNTLFLQMTSLRAEDTAVYYCVKGPLLRYLDSWGQGTLVTVSSASTKG

SEQ ID NO: 4203 - protein, 123 aa, synthetic construct
  REGION 1..123: note = anti-HIV_Chain
EVQLVESGGGLVQPGGSLRISCSATGFTFSTHAMHWVRQAPGKGLEYVSAINSNGRSAFYADSVKGRVTISRDNSKNTLFLQMTSLRAEDTAVYYCVKGPLLRYLDSWGQGTLVTVSSASTKG

SEQ ID NO: 4204 - protein, 123 aa, synthetic construct
  REGION 1..123: note = anti-HIV_Chain
EESGPGLVKPSQTLSLTCSVSGDSVSSGGYFWSWIRQHPTKGLECLGYVYYTGNTYYNPSLKSPPTIEVAMANNQVSLKLGSVTAADTAVYYCARIKRFRGGNYFDTWGHGLLVTVSSASTKG

SEQ ID NO: 4205 - protein, 123 aa, synthetic construct
  REGION 1..123: note = anti-HIV_Chain
QVQLQESGSGLVKPSGTLSLTCAVSNGPISSGNWWSWVRQTPEKGLEWIGEVYHSGSTNHNPSLKSRATILVDKSKNQFSLNLRSVTAADTAVYYCARVRGSWNFDYWGQGILVTVSSASTKG

SEQ ID NO: 4206 - protein, 123 aa, synthetic construct
  REGION 1..123: note = anti-HIV_HeavyChain
EVQLQQSGTVLARPGASVKMSCKASGYTFTSYWMHWVKQRPGQGLEWIGAIYPGNSDTSYNQKFKGKAKLTAVTSASTAYMELSSLTNEDSAVYYCTRWPHYYGGSRYYFDYWGQGTTLTVSS

SEQ ID NO: 4207 - protein, 124 aa, synthetic construct
  REGION 1..124: note = anti-HIV_Chain
VVQLVESGGGLVQPGGSLRLSCAASGFAFRSYWMSWVRQAPGRGLEWVANIKQDGSEKYYADSVKGRFTISRDNTKNSLYLQMNSLRAEDTAVFYCASRGDRYGPIDYWGQGTLVTVSSASTKG

SEQ ID NO: 4208 - protein, 124 aa, synthetic construct
  REGION 1..124: note = anti-HIV_Chain
QVQLVQSGAEIKKPGESLKISCKASGYTFNDYWIGWVRQMPGKGLEWMGIFYPDDSDSNYSPSFQGRVTISADKSITTAYLQWSTLKASDSAMYFCARLLGDSGAFDIWGQGTMVIVSSASTKG

SEQ ID NO: 4209 - protein, 124 aa, synthetic construct
  REGION 1..124: note = anti-HIV_Chain
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCAREGSYYYGMDVWGQGTTVTVSSASTKG

SEQ ID NO: 4210 - protein, 124 aa, synthetic construct
  REGION 1..124: note = anti-HIV_Chain
EIVLTQSPATLSVSPGERATLSCRAGQSVSSDLAWYQHKPGQAPRLLIYDASKRATGIPARFSGSGSGTDFTLTISSLEPEDFAVYYCQHRTNWPPSITFGQGTRLEIKRTVAAPSVFIFPPSD

SEQ ID NO: 4211 - protein, 124 aa, synthetic construct
  REGION 1..124: note = anti-HIV_Chain
EIVLTQSPGTLSLSPGERATLSCRASQSVSSRYLAWYQQKPGQAPRLIIYDASSRASGIPDRFSGSGSETDFTLTITRLEPEDFAVYYCQLYGTSPKFTFGQGTKLEIKRTVAAPSVFIFPPSD

SEQ ID NO: 4212 - protein, 124 aa, synthetic construct
  REGION 1..124: note = anti-HIV_Chain
EIVLTQSPGTLSLSPGERATLSCRASQSVSNNYLAWYQQKPGQAPRLLIYGASSRATGIPDRFSGSGSGTDFTLTISRLEPEDFAVYYCQQYATSSLYTFGQGTKLEIKRTVAAPSVFIFPPSD

SEQ ID NO: 4213 - protein, 124 aa, synthetic construct
  REGION 1..124: note = anti-HIV_Chain
PATLAVSPGERATISCKSSQNLLYSANNQHSLAWYQQRPGQPPKLLLYWASTRLSGVPDRFSGSGSGTDFTLTISNLQAEDVAVYYCQQYYSPPPTFGQGTKVEIRRTVAAPSVFIFPPSDEQL

SEQ ID NO: 4214 - protein, 124 aa, synthetic construct
  REGION 1..124: note = anti-HIV_Chain
QPVLTQPPSASGAPGQRVTISCSGGPSNVGGNYVYWYRQFPGTAPNLLILRDDQRPSGVPDRFSASKSGNSASLAITGLRPDDEAFYFCATYDSDGSIRLFGGGTALTVLSQPKAAPSVTLFPP

SEQ ID NO: 4215 - protein, 124 aa, synthetic construct
  REGION 1..124: note = anti-HIV_Chain
NFMLTQPPSASGAPGQRVTISCSGGPSNVGGNYVYWYRQFPGTAPNLLILRDDQRPSGVPDRFSASKSGNSASLAISGLRPDDEAFYFCATYDSDGSIRLFGGGTTLTVLSQPKAAPSVTLFPP

SEQ ID NO: 4216 - protein, 124 aa, synthetic construct
  REGION 1..124: note = anti-HIV_Chain
DIQMTQSPPSLSASVGDRVTITCQASQDINNFLNWYQQKPGKAPRLLIYDASNLESGVSSRFSGSRSGTDFTLTISSLLPEDIATYSCQQYSNLPYTFSQGTKLEIKRTVAAPSVFIFPPSDEQ

SEQ ID NO: 4217 - protein, 124 aa, synthetic construct
  REGION 1..124: note = anti-HIV_Chain
QVQLVQSGTAVKRPGASVRVSCQASGYTFIDHFIYWWRQAPGQGLEWLGWINPLTSQPSYPSRFQGRLTLTRDTFDEMLYMDLRGLRSDDTGIYFCARRHSDYCDFDIWGSGTQIIVSSASTKG

SEQ ID NO: 4218 - protein, 124 aa, synthetic construct
  REGION 1..124: note = anti-HIV_Chain
QVQLVQSGAALKKPGASLRISCQAYGYKFTDHLIYWWRQAPGQGLEWIGWIKPETGQPSYSYKFQGRVSLTRDTFQEILFMDLRGLRSDDTAIYFCARRHSDYCDFDVWGSGSQVIVSSASTKG

SEQ ID NO: 4219 - protein, 124 aa, synthetic construct
  REGION 1..124: note = anti-HIV_Chain
QVQLVQSGAALKKPGASLRISCQTYGYKFTDHLIYWWRQAPGQGLEWMGWIKPETGQPSYSYRFQGRVSLTRDTFEEIVFMDLRGLRSDDTAIYFCARRHSDYCDFDVWGSGSQVIVSSASTKG

SEQ ID NO: 4220 - protein, 124 aa, synthetic construct
  REGION 1..124: note = anti-HIV_Chain
QVQLVQSGAALKKPGASLRISCQTYGYKFTDHLIYWWRQAPGQGLEWIGWIKPETGQPSYSYRFQGRVSLTRDTFEEIAFMDLRGLRSDDTAIYFCARRHTDYCVFDVWGSGSQIIVSSASTKG

SEQ ID NO: 4221 - protein, 124 aa, synthetic construct
  REGION 1..124: note = anti-HIV_Chain
QVQLVQSGTAVKRPGASVRVSCQASGYTFTDYFIYWWRQAPGQGLEWLGWINPLTSQPSYPSRFQGRLTLTRDTFDEMLYMDLRGLRSDDTGIYFCARRHSDYCDFDIWGSGTQIIVSSASTKG

SEQ ID NO: 4222 - protein, 124 aa, synthetic construct
  REGION 1..124: note = anti-HIV_Chain
QVQLVQSGAALKKPGASVRISCQAYGYKFTDHLIYWWRQAPGQGLEWIGWIKPETGQPSYAYKFQGRVTLTRDTFEEIHFMDLRGVRNDDTATYFCARRHSDYCDFDVWGSGSQVIVSSASTKG

SEQ ID NO: 4223 - protein, 124 aa, synthetic construct
  REGION 1..124: note = anti-HIV_Chain
QVQLVQSGAALKKPGASVRISCQTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVLVSSASTKG

SEQ ID NO: 4224 - protein, 124 aa, synthetic construct
  REGION 1..124: note = anti-HIV_Chain
QVQLVQSGAALKKPGASLRISCQTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVLVSSASTKG

SEQ ID NO: 4225 - protein, 124 aa, synthetic construct
  REGION 1..124: note = anti-HIV_Chain
QVQLVQSGAALKKPGASVRISCQTYGYKFTDHLIHWWRQAPGQGLEWIGWIKPDTGQPSYSSRFQGRVSLTRDTFEEIVFMDLRGLRSDDTAIYFCARRHSDYCDFDVWGSGSQVLVSSASTKG

SEQ ID NO: 4226 - protein, 124 aa, synthetic construct
  REGION 1..124: note = anti-HIV_Chain
QVQLVQSGAALKKPGASLRISCQTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVIVSSASTKG

SEQ ID NO: 4227 - protein, 124 aa, synthetic construct
  REGION 1..124: note = anti-HIV_Chain
QVQLVQSGAALKKPGASLRISCQTYGYKFTDHLIYWWRQAPGQGLEWIGWIKPETGQPSYSYRFQGRVSLTRDTFEEIVFMDLRGLRSDDTAIYFCARRHSDYCDFDVWGGGSQVIVSSASTKG

SEQ ID NO: 4228 - protein, 124 aa, synthetic construct
  REGION 1..124: note = anti-HIV_Chain
QVQLVQSGAALKKPGASLRISCLTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVIVSSASTKG

SEQ ID NO: 4229 - protein, 124 aa, synthetic construct
  REGION 1..124: note = anti-HIV_Chain
QVQLVQSGATLKKPGASVRISCQAYGYKFTDHLIHWWRQAPGQGLEWIGWIKPETGQPSYAYKFQGRVSLTRDTFEEILFMDLRGLRSDDTAIYFCARRHSDYCDLDVWGGGTQLLVSSASTKG

SEQ ID NO: 4230 - protein, 124 aa, synthetic construct
  REGION 1..124: note = anti-HIV_Chain
QVQLVQSGAALKKPGASVRISCQAYGYKFTDHLIYWWRQAPGQGLEWIGWIKPETGQPSYSYKFQGRVTLTRDTFEEIHFMDLRGLRYDDTATYFCARRHSDYCDFDVWGSGSQVSVSSASTKG

SEQ ID NO: 4231 - protein, 124 aa, synthetic construct
  REGION 1..124: note = anti-HIV_Chain
QVQLVQSGAALKKPGASLRISCQAYGYKFTDHLIYWWRQAPGQGLEWIGWIKPETGQPSYSYKFQGRVSLTRDTFQEILFMNLRGLRSDDTAIYFCARRHSDYCDFDVWGSGSQILVSSASTKG

SEQ ID NO: 4232 - protein, 124 aa, synthetic construct
  REGION 1..124: note = anti-HIV_Chain
QVQLVQSGTAVKKPGASVRVSCQASGYTFTDYFIYWWRQAPGQGLEWLGWINPRTSQPSYPYRFQGRVTLTRDIFEEMLYMDLRGLRSDDTGIYFCARRHSDYCDFDIWGSGTQIIVSSASTKG

SEQ ID NO: 4233 - protein, 124 aa, synthetic construct
  REGION 1..124: note = anti-HIV_Chain
QVQLVQSGAALKKPGASLRISCQAYGYKFTDYLIHWWRQAPGQGLEWIGWIKPETGQPSYSYKFQGRVSLTRDTFEEILFMDLRGLRSDDTAIYFCARRHSDYCDFDVWGGGSQVLVSSASTKG

SEQ ID NO: 4234 - protein, 124 aa, synthetic construct
  REGION 1..124: note = anti-HIV_Chain
EVQLLESGGALVQPGGSLRLSCAASGFTFSTSSMSWVRQAPGKGLEWVSAIGSGRGSTFYADSVKGRFTISRDNSKNTLSLQMNSLTAEDTATYYCTKTGGLLRFPEVWGKGTTVTVSSASTKG

SEQ ID NO: 4235 - protein, 124 aa, synthetic construct
  REGION 1..124: note = anti-HIV_Chain
EVQLVESGGGLVKPGGSLRLSCADSGFTFRSYSMHWVRQAPGKGLAWVSSISSTSNYIYYADSVKGRFTISRDNAKNSLYLQMNSLRAEDTAVYYCARTFITASWFDSWGQGTLVTVSSASTKG

SEQ ID NO: 4236 - protein, 124 aa, synthetic construct
  REGION 1..124: note = anti-HIV_Chain
QVQLVQSGAEVKKPGASVKVSCKASGYTFTNYGVSWVRQAPGQGLEWMGWISPYSGNTNYAQRLQDRVTMTTDTSTNTAYMELRSLRSDDTAVYYCAARSYYYYSMDVWGQGTTVTVSSASTKG

SEQ ID NO: 4237 - protein, 124 aa, synthetic construct
  REGION 1..124: note = anti-HIV_Chain
QVQLVQSGAELKKPGSSVKVSCKASGGTFSNYAINWVRQAPGQGFEWMGGIIPLFATPTYAQKFQGRVRITADDSTSTAYMELSSLRSDDTAVYFCARPNVVRSALDYWGQGTLVTVSSASTKG

SEQ ID NO: 4238 - protein, 124 aa, synthetic construct
  REGION 1..124: note = anti-HIV_Chain
QVQLVESGGGVVQPGKSLRLSCAASGFTFSTHAMHWVRQAPGKGLDWVAVISHDGDNQYYADAVKGRFTISRDDSRDTVFLQMNSLRTEDTGVYYCAADSSGSNWFDYWGQGILVTVSSASTKG

SEQ ID NO: 4239 - protein, 125 aa, synthetic construct
  REGION 1..125: note = anti-HIV_Chain
QVRLSQSGGQMKKPGESMRLSCRASGYEFLNCPINWIRLAPGRRPEWMGWLKPRGGAVNYARKFQGRVTMTRDVYSDTAFLELRSLTSDDTAVYFCTRGKYCTARDYYNWDFEHWGRGAPVTVSS

SEQ ID NO: 4240 - protein, 125 aa, synthetic construct
  REGION 1..125: note = anti-HIV_Chain
EVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSS

SEQ ID NO: 4241 - protein, 125 aa, synthetic construct
  REGION 1..125: note = anti-HIV_Chain
QVQLVQSGGGLVQPGESLRLSCTASGFTFSSYNMNWVRQAPGKGLEWISYISDKSKNKYYADSVRGRFTISRDNAQNSLFLQMSSLRDEDTAVYYCTREGPQRSFYFDYWGQGIQVTVSSASTKG

SEQ ID NO: 4242 - protein, 125 aa, synthetic construct
  REGION 1..125: note = anti-HIV_Chain
EVQLVESGAEVKKPGSSVKVSCKASGGTFSSYSISWVRQAPGQGLEWMGGIIPIFATTHYGQKFQGRIKITADKSTSTAYMELSRLRSEDTAVYYCARDREFYFYGMDVWGQGTTVTVSSASTKG

SEQ ID NO: 4243 - protein, 125 aa, synthetic construct
  REGION 1..125: note = anti-HIV_Chain
QLQLQESGPGLVKPWETLVLTCSVSGGSISSGDYYWGWIRQSPGKGPEWIGNIFYSSGNTYYNTSLKSRVTISVDVSKNRFSLKLTSMTAADTAVYYCGRLSNKGWFDPWGQGTLVSVSSASTKG

SEQ ID NO: 4244 - protein, 125 aa, synthetic construct
  REGION 1..125: note = anti-HIV_Chain
EIVLTQSPATLSLSPGERATLSCRASQSVSSYLAWYQQKPGQAPRLLIYDASNRATGIPARFSGSGSDTDFTLTISSLEPEDFAVYYCQQRGIWPLQITFGQGTRLEIKRTVAAPSVFIFPPSDE

SEQ ID NO: 4245 - protein, 125 aa, synthetic construct
  REGION 1..125: note = anti-HIV_Chain
SEIVLTQSPGTLSLSPGERATLSCRASQSVSSSYLAWYQQKPVQAPRLLIYGASSRATGIPDRFSGSGSGTDFTLTISRLEPEDFAVYYCQQYGTLHPRTFGQGTKVEIKRTVAAPSVFIFPPSD

SEQ ID NO: 4246 - protein, 125 aa, synthetic construct
  REGION 1..125: note = anti-HIV_Chain
SQAVVTQPPSVSGAPGQRVTISCSGGPSNVGGNLVYWYKQFPGTAPKLLIRRDDQRPSGVPDRFSGSKSGNSASLAISGLRPDDEAFYFCATYDSHGSIRLFGGGTLLTVLSQPKAAPSVTLFPP

SEQ ID NO: 4247 - protein, 125 aa, synthetic construct
  REGION 1..125: note = anti-HIV_Chain
DIQMTQSPSTLAASIGGTVRVSCRASQSITGNWVAWYQQRPGKAPRLLIYRGAALLGGVPSRFSGSAAGTDFTLTIGNLQAEDFGTFYCQQYDTYPGTFGQGTKVEVKRTVAAPSVFIFPPSDEQ

SEQ ID NO: 4248 - protein, 125 aa, synthetic construct
  REGION 1..125: note = anti-HIV_Chain
EIVMTQSPDTLSVSPGERATLSCRASQSVNSNLAWYQQKPGQAPRLLIYGASTRATAVPARFSGSGSGTEFTLTISSLQSEDSAVYYCQQYYQWLSYTFGQGTKLEIKRTVAAPSVFIFPPSDEQ

SEQ ID NO: 4249 - protein, 125 aa, synthetic construct
  REGION 1..125: note = anti-HIV_Chain
RQVQLVQSGAALKKPGASLRISCQAYGYKFTDHLIYWWRQAPGQGLEWIGWIKPETGQPSYSYKFQGRVSLTRDTFQEILFMDLRGLRSDDTAIYFCARRHSDYCDFDVWGSGSQILVSSASTKG

SEQ ID NO: 4250 - protein, 125 aa, synthetic construct
  REGION 1..125: note = anti-HIV_Chain
QVQLVQSGAALKKPGASVRISCQAYGYKFTDYLIHWWRQAPGQGLEWIGWIKPETGQPSYSYKFQGRVTLTRDTFEEILFMDLRGLRSDDTAIYFCARRHSDYCDFDVWGSGSQVIVSSASTKGA

SEQ ID NO: 4251 - protein, 125 aa, synthetic construct
  REGION 1..125: note = anti-HIV_Chain
EVQLVESGGGLVKPGGSLRLSCAASGFSFSEHYMSWIRLAPGKGLEWLSYISSSTRTTYSADSVRGRFTISRDTAKQLLFLHMSSLRAEDTAVYYCVRLYGGINGWFDQWGQGTLVSVSSASTKG

SEQ ID NO: 4252 - protein, 125 aa, synthetic construct
  REGION 1..125: note = anti-HIV_Chain
QVQLVQSGPGLVKPSETLSLTCSVSNGSISSGGYYWSWLRQFPGKGLEWIGSIHYTGRTFYNPSLMGRTALSMDTSNNQFSLKVSSVTAADTALYYCARELQWMFVVDPWGQGTLVTVSSASTKG

SEQ ID NO: 4253 - protein, 125 aa, synthetic construct
  REGION 1..125: note = anti-HIV_Chain
QVQLQESGPGLVKPSETLSLTCSVSNGSISSGGYYWSWLRQFPGKGLEWIGSIHYTGRTMYNPSLMGRPALSMDTSNNQFSLKLRSVTAADTALYFCARDLQWIFVVDPWGQGTLVTVSSASTKG

SEQ ID NO: 4254 - protein, 125 aa, synthetic construct
  REGION 1..125: note = anti-HIV_Chain
EVQLLESGGGLVQPGGSLRLSCAVSGFTFGGHAVSWVRQAPGKGLEWLSQISGTGSRTDYADAVKGRFTVSRDNSKKTVYLQMNSLRVEDTALFYCATRSPGGGYAFDIWGQGAMVTVSSASTKG

SEQ ID NO: 4255 - protein, 125 aa, synthetic construct
  REGION 1..125: note = anti-HIV_Chain
QVQLVQSGAEVKKPGSSVKVSCKVSFFSNYGISWVRQRPGQGLEWMGRIIPAIDDMTYAQTFRGRVTFSADKFTTTAYMELTGLTFEDTATYFCARDPQVNRRGNCFDHWGQGTLVTVSSASTKG

SEQ ID NO: 4256 - protein, 125 aa, synthetic construct
  REGION 1..125: note = anti-HIV_Chain
QVQLQESGPGLVKPSETLSLTCTVSGGSISYYYWSWIRQPPGKGLEWIGDIYYSGTTDYNPSLKSRVTISVDTSKNQFSLKLSSVTAADTAVYYCARRRGQRLLAYFDYWGQGSLVTVSSASTKG

SEQ ID NO: 4257 - protein, 125 aa, synthetic construct
  REGION 1..125: note = anti-HIV_Chain
QVQLQESGPGPVKPSETLSLTCTVSGGSMISYYWSWIRQPPGKGLEWIGYIFTNGRTTYSPSLRSRVTISLDTSTNHFSLRLKSVTAADTAIYYCARLDGEAFRYYLDLWGQGNLVTVSSASTKG

SEQ ID NO: 4258 - protein, 125 aa, synthetic construct
  REGION 1..125: note = anti-HIV_Chain
QVQLVQSGAEVKKPGASVKVSCKPSSNTFTSHYIHWVRQAPGQGLEWMGMINPGGSTRYAPKFQGRVTLTRDTSTRTVYMELSSLRSEDTAVYYCARPQYNLGRDPLDVWGLGTMVTVSSASTKG

SEQ ID NO: 4259 - protein, 125 aa, synthetic construct
  REGION 1..125: note = anti-HIV_Chain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLPIGSGWYGRDYWGQGTLVTVSSASTKG

SEQ ID NO: 4260 - protein, 125 aa, synthetic construct
  REGION 1..125: note = anti-HIV_Chain
QVQLVQSGAEVKKPGASVKVSCKASGNTFTSYGITWVRQAPGQGLEWMGWISAYNGNTNYAQKLQDRLTMTTDTSTSTAYMELRSLRSDDTAVYYCAFSRHYGSGNYDYWGQGTLVTVSSASTKG

SEQ ID NO: 4261 - protein, 125 aa, synthetic construct
  REGION 1..125: note = anti-HIV_Chain
QFRLVQSGPEVKNPGSSVTVSCKASGGTFSGLGINWVRQAPGQGLEWLGDIKTMYGTTNYAPKFQGRVTITADESTSTSYMELSGLRSEDTAVFYCVRELFGHHPAFGVWGQGTSVIVSSASTKG

SEQ ID NO: 4262 - protein, 125 aa, synthetic construct
  REGION 1..125: note = anti-HIV_Chain
RVQLVQSGAEVKKPGSSVTVSCKASGGSFSSYAISWVRQAPGQGLEWVGGVKVMFGTVHYSQKVQGRVTITADDSTGTSYLELSGLRSADTAVYYCARNAGAYFYPFDIWGQGTLIIVSSASTKG

SEQ ID NO: 4263 - protein, 125 aa, synthetic construct
  REGION 1..125: note = anti-HIV_Chain
QVQLQESGPGLVKPSETLSLTCTVSGGSISSRSYYWGWIRQPPGKGLEWVGSIYYTGSTYYSPSLKSRVTISVDTSQNQFSLKLNSVTAADTAVYYCARQKGSGTSLLYWGQGTLVTVSSASTKG

SEQ ID NO: 4264 - protein, 125 aa, synthetic construct
  REGION 1..125: note = anti-HIV_Chain
QVQLVQSGTEVKKPGSSVKVSCKASGGTFSDSDIAWVRQAPGQGLEWMGGITPMFDMAKSAQKFRGRLIITADKSTGTAYMELSSLRYEDAAVYFCARSSGNFEFAFEIWGQGTKIIVSLASTKG

SEQ ID NO: 4265 - protein, 125 aa, synthetic construct
  REGION 1..125: note = anti-HIV_Chain
VVQLVQSGTEVKKPGSSVKVSCKASGGTFSGSDISWVRQAPGQGLEWMGGIIPMFDIEDHAQKFRGRLTITADKSTGAAYMELSSLRSEDAAVYYCARSSGNYDFAFDIWGQGTRLIVSSASTKG

SEQ ID NO: 4266 - protein, 125 aa, synthetic construct
  REGION 1..125: note = anti-HIV_Chain
VVQLVESGTEVKKPGSSVKVSCKASGGTFSGSDISWVRQAPGQGLEWMGGIIPMFDIENHAEKFRGRLTITAVKSTGAAYMELSSLRSEDAAVYYCARSSGNYDFAYDIWGQGTRVIVSSASTKG

SEQ ID NO: 4267 - protein, 126 aa, synthetic construct
  REGION 1..126: note = anti-HIV_Chain
QVQLVQSGSAMKKPGASVRVSCWTSEDIFDTTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSA

SEQ ID NO: 4268 - protein, 126 aa, synthetic construct
  REGION 1..126: note = anti-HIV_Chain
QVQLQESGPGLVKPSETLSLTCTVSGGSISNHYWSWIRQPPGKGLEWIGYIYHSGNINYKSSLKSRATISIDTSNNQFSLKLSSVIAADTAVYYCARNFGPGSPNYGMDVWGQGTTVTVSSASTKG

SEQ ID NO: 4269 - protein, 126 aa, synthetic construct
  REGION 1..126: note = anti-HIV_Chain
QVQLVQSGGGVVQPGRSLRLSCAASGFTFSHHGIHWVRQAPGEGLEWVAVISEDGTNIHYEDSVRGRFTISRDNSKNTVDLQMNSLRAEDTAVYYCASLISMRDGDAFDLWGQGTRVTVSSASTKG

SEQ ID NO: 4270 - protein, 126 aa, synthetic construct
  REGION 1..126: note = anti-HIV_Chain
QVQLVESGGGLGQPGGSLRLSCAASGFTFRNYAMSWVRQAAGKGLEWVSGVSGGGDTTYYGDSVKGRFTISRDNSKNTLYLQMNNLRAEDTAVYYCAKDKGVWGSSDFDYWGQGTLVTVSSASTKG

SEQ ID NO: 4271 - protein, 126 aa, synthetic construct
  REGION 1..126: note = anti-HIV_Chain
EVQLVESGGGVVQPGRSLRLSCAASGFTFSHHGIHWVRQAPGEGLEWVAVISEDGTNIHYEDSVRGRFTISRDNSKNTVDLQMNSLRAEDTAVYYCASLISMRDGDAFDLWGQGTRVTVSSASTKG

SEQ ID NO: 4272 - protein, 126 aa, synthetic construct
  REGION 1..126: note = anti-HIV_Chain
RGPVTLAVSLGERATITCKSSQSVLVHSNNKNYLSWYQQKPGQPPKLLIYWASTRESGVPERFSGSGSGTDFTLSISSLQAEDVAVYYCHQYFSTPRTFGQGTKVEIKGTVAAPSVFIFPPSDEQL

SEQ ID NO: 4273 - protein, 126 aa, synthetic construct
  REGION 1..126: note = anti-HIV_Chain
SEIVMTQSPATLSMSPGERATLSCRASLSVNTNLAWYQQKPGQAPRLLIYGASTRATGIPARFSGSGSGTEFTLTISSLQSEDFALYYCQQYNHWPQTFGQGTKVEIKRTVAAPSVFIFPPSDEQK

SEQ ID NO: 4274 - protein, 126 aa, synthetic construct
  REGION 1..126: note = anti-HIV_Chain
SEIVLTQSPATLSLSPGERATLSCRASQSINNYLAWYQQKPGQAPRLLIYDASNRATGIPARFSGGGSGTDFTLTISSLEPEDFAVYYCQQRANWRLLTFGGGTKVEIKRTVAAPSVFIFPPSDEQ

SEQ ID NO: 4275 - protein, 126 aa, synthetic construct
  REGION 1..126: note = anti-HIV_Chain
QVQLVQSGGAVKKPGASVKVSCETYGYTFTDHFMHWWRQAPGQGLEWMGWINPYSSAVSYSPRYQGRVTMTRDTFLETVYMELRGLKFDDTAIYYCATPKSGRDYWSFDLWGQGTLVTVSSASTKG

SEQ ID NO: 4276 - protein, 126 aa, synthetic construct
  REGION 1..126: note = anti-HIV_Chain
SQVQLVESGPGLVKPSETLSLTCSVSNGSISSGGYYWSWLRQFPGKGLEWIGSIHYTGRTMYNPSLMGRPALSMDTSNNQFSLKLSSVTAADTALYFCARDLQWIFVVDPWGQGTLVTVSSASTKG

SEQ ID NO: 4277 - protein, 126 aa, synthetic construct
  REGION 1..126: note = anti-HIV_Chain
SVVQLVESGPGLVKPSETLSLTCSVSNGSISSGGYYWSWLRQFPGKGLEWIGSIHYTGRTMYNPSLMGRPALSMDTSNNQFSLKLRSVTAADTALYFCARDLQWIFVVDPWGQGTLVTVSSASTKG

SEQ ID NO: 4278 - protein, 126 aa, synthetic construct
  REGION 1..126: note = anti-HIV_Chain
SGGRLVQPGGSLRLSCSASGFTLSNSAMSWVRQAPGKGLEWVSSILSSGVGTFYADSVKGRFTVSRDNSRNTLYLQMKSLRAEDTALYYCAKVQIQQLNFGVITDAGLDVWGKGTTLIVSSASTKG

SEQ ID NO: 4279 - protein, 126 aa, synthetic construct
  REGION 1..126: note = anti-HIV_Chain
QVQLVQSGAAVKKPGASVKVSCEAYGYKFTDHFMHWWRQAPGQGLEWMGWINPYTSAVNYSPKYQGRVTMTRDTFLETVYMELRGLRVDDTAIYYCATPKSGRDYWSFDLWGQGTLVTVSSASTKG

SEQ ID NO: 4280 - protein, 126 aa, synthetic construct
  REGION 1..126: note = anti-HIV_Chain
QVQLVQSGAAVKKPGASVKVSCETYGYKFTDHFMHWWRQAPGQGLEWMGWINPYSSAVSYSPRYQGRVTMTRDTFLETVYMELRGLRFDDTAIYYCATPKSGRDYWSFDLWGQGTLVTVSSASTKG

SEQ ID NO: 4281 - protein, 126 aa, synthetic construct
  REGION 1..126: note = anti-HIV_Chain
QVQLVQSGAAVKKPGASVKVSCETYGYTFTDHFMHWWRQAPGQGLEWMGWINPYSSAVSYSPRYQGRVTMTRDTFLETVYMELRGLKFDDTAIYYCATPKSGRDYWSFDLWGQGTLVTVSSASTKG

SEQ ID NO: 4282 - protein, 126 aa, synthetic construct
  REGION 1..126: note = anti-HIV_Chain
QVQLVQSGAEVKKPGSSVKVSCKTSGVRFSSNAISWVRQAPGQGLEWMGRTTPMLGGANHAPSFKGRVTISADESTRTVYMEMSSLRYEDTAVYYCASGRREGLNFLLDYWGQGTLVTVSSASTKG

SEQ ID NO: 4283 - protein, 126 aa, synthetic construct
  REGION 1..126: note = anti-HIV_Chain
QVQLQESGPGLVKPSETLSLTCTVSGGSISTYYWSWIRQPPGKGLEWIGYISYSGSTNYNPSLKSRVTISVDTSKNQFSLKLSSVTAADTAVYYCARHKSVLLWFRELDYWGQGTLVTVSSASTKG

SEQ ID NO: 4284 - protein, 126 aa, synthetic construct
  REGION 1..126: note = anti-HIV_Chain
QVQLVQSGAEVKKPGAAVKISCKASRFTFSSYYIHWVRQAPGQGLEWMGIINPSGGSTSNAQKFQDRVTLTRDMSTGTVYMELSRLTSEDTAVYYCATPEPSSIVAPLYYWGQGTLVTVSSASTKG

SEQ ID NO: 4285 - protein, 126 aa, synthetic construct
  REGION 1..126: note = anti-HIV_Chain
QVQLVQSGAEMKKPGASVKVSCKASGHTFTNYYMHWVRQAPGQGLEWMGMINPTGDSTRYAQRFQGRVTMTRDTSTRTVYMELSSLRSDDTAVYYCARAHHDFWRAPVDVWGKGTTVTVSSASTKG

SEQ ID NO: 4286 - protein, 126 aa, synthetic construct
  REGION 1..126: note = anti-HIV_Chain
QVVLIQSGAEVKRPGSSVKVSCKASGGSFPITWVRQAPGHGLEWMGGINPFFGTTNYAQKFQGRVSITADESTSTTYLHLSDLRSEDTAVYFCARENREKWLVLRSWFAPWGQGTLVTVSSASTKG

SEQ ID NO: 4287 - protein, 126 aa, synthetic construct
  REGION 1..126: note = anti-HIV_Chain
SQQLVQSGAQVKKPGASVRVSCQASGYTFTNHFLHWWRQAPRQGLEWMGWINPVHGGRNYARRFQGRINFGRDVYQETAYMELSGLRNDDTATYFCARGGGDGRNWHLHPWGQGTLVIVSAASTKG

SEQ ID NO: 4288 - protein, 126 aa, synthetic construct
  REGION 1..126: note = anti-HIV_Chain
EVQVVESGGGLVQPGGSLRLSCVASGFTFSEYWMSWVRQAPGKGLEWVATIKRDGSEESYVDSVKGRFTISRDNAKNSLYLQMNSLRAEDTAVYYCARVRDPNYNLHFDSWGQGTLVTVSSASTKG

SEQ ID NO: 4289 - protein, 126 aa, synthetic construct
  REGION 1..126: note = anti-HIV_Chain
LVQLVESGGGVVQPGKSLRLSCATSGFTFSTYGMHWVRQAPGKGLEWVAVIWYDGSYKYYADSVKGRFTISRDNSKNTLFLQMNSLRAEDTAMYYCGREMAVGGTKALDHWGQGTLVTVSSASTKG

SEQ ID NO: 4290 - protein, 126 aa, synthetic construct
  REGION 1..126: note = anti-HIV_Chain
EFQLVQSGGGLVKPGGSLRLSCTGSTFSFSSDDMNWVRQAPGKGLEWVSSMSDSGSHIYYADFVKGRFTISRDNAKKSLYLQMNSLRAEDTAVYYCAQSRPPQRLYGMDVWGQGTTVTVSSASTKG

SEQ ID NO: 4291 - protein, 127 aa, synthetic construct
  REGION 1..127: note = anti-HIV_Chain
EVQLVESGGGVVQPGGSLRLSCAASGFMFKNYAMHWVRQPPGKGLEWVAVIWYGGRDQNYADSVKGRFTISRDDSDNTLYLQMNSLRAGDTAVYFCARNSQVGRLMPAAGVWGQGTLVTVSSASTKG

SEQ ID NO: 4292 - protein, 127 aa, synthetic construct
  REGION 1..127: note = anti-HIV_Chain
QGHLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSAST

SEQ ID NO: 4293 - protein, 127 aa, synthetic construct
  REGION 1..127: note = anti-HIV_Chain
QVQLLESGGGLVQRGGSLRLSCTASGFVFNNYWMTWVRQAPGNGLEWVANIDQDGSEKHYLDSVKGRFTISRDNAKNSLYLQMNSLRAEDTAIYYCARVRFKVTAWHRFDSWGQGDLVTVSSTSTKG

SEQ ID NO: 4294 - protein, 127 aa, synthetic construct
  REGION 1..127: note = anti-HIV_Chain
QSALTQPPSASGTPGQRVTISCSGSYHNIGSNAVNWYQQLPGTAPKLLIYSNDQRPSGVPDRFSGSKSGTSASLAISGLQSEDEADYYCAAWDDSLHVFGTGTKVTVLGQPKANPTVTLFPPSSEEL

SEQ ID NO: 4295 - protein, 127 aa, synthetic construct
  REGION 1..127: note = anti-HIV_Chain
QSVLTQVLSVSGTPGQRVIISCSGTSSNVGGNLVSWYQHLPGAAPRLLIHRDDQRPSGVPDRFSGSKSGNSASLVISGLRSDDEADYFCAAYDSTFSLPVFGGGTRLTVLSQPKAAPSVTLFPPSSE

SEQ ID NO: 4296 - protein, 127 aa, synthetic construct
  REGION 1..127: note = anti-HIV_Chain
QVQLLQSGAAVTKPGASVRVSCEASGYNIRDYFIHWWRQAPGQGLQWVGWINPKTGQPNNPCQFQGRVSLTRHASWDFDTFSFYMDLKALRSDDTAVYFCARQRSDYWDFDVWGSGTQVTVSSASTK

SEQ ID NO: 4297 - protein, 127 aa, synthetic construct
  REGION 1..127: note = anti-HIV_Chain
QVQLVQSGGEVRKPGSSVKVPCKISGNAFSNYGVNWVRQAPGQGLEWVGRIIPVIGVAQHAPKFQGRVTITADKSTTTAYLELSSLRSDDTAVYFCAKDHGDPRTGYYFDYWGQGALVTVSSASTKG

SEQ ID NO: 4298 - protein, 127 aa, synthetic construct
  REGION 1..127: note = anti-HIV_Chain
QVQLGQSGTEVKKPGFSVKVSCKASGGSSTAYGYSWVRQAPGQGFEWMGRIIPFYGIITYAPKFQGRVTITADRSTSTVYMELTSLTFADTALFFCARDFGDPRNGYYFDSWDQGLWLTVSSASTKG

SEQ ID NO: 4299 - protein, 127 aa, synthetic construct
  REGION 1..127: note = anti-HIV_Chain
QVQLVQSGAEVKKPGSSVKVSCKASGGTFSNYAISWVRQAPGQGLEWMGGIIPIFEAASYAQKFQDRLTITTDESTTTAYMDLSSLRSEDTAIYYCARAQGDILTEGYFDYWGQGTLVTVSSASTKG

SEQ ID NO: 4300 - protein, 127 aa, synthetic construct
  REGION 1..127: note = anti-HIV_Chain
QVQLQESGPGLVKPSETLSLTCTVSGGSISSAGYYWSWIRQHPEKGLEFIGYIYYLGTTYYNPSLKSRVSISIDTSNNQFSLELSSVSAADTAIYYCARDYTASGRHFFDYWGQGTLVTVSSASTKG

SEQ ID NO: 4301 - protein, 127 aa, synthetic construct
  REGION 1..127: note = anti-HIV_Chain
QVQLVQSGAEVKKPGASVKVSCKAPGYTFIGHYMHWIRQAPGQGLEWMGWINPNSGDTNYAQTFQGRVTMTRDTSISTAYMELTRLRSDDTAVYYCARDLRPMRGNWAMHVWGEGTTVTVSSASTKG

SEQ ID NO: 4302 - protein, 127 aa, synthetic construct
  REGION 1..127: note = anti-HIV_Chain
QVQLQESGPGLVKPSETLSLTCTVFGASIRSFYWHWIRQSPGKGLEWLGSVFDNGLTTYNPSLKNRLSISEDPSRNQISLNLRSMTAADTAVYYCARADYDLLTSSYHFDSWGQGTLVTVSSASTKG

SEQ ID NO: 4303 - protein, 127 aa, synthetic construct
  REGION 1..127: note = anti-HIV_Chain
SQQLVQSGTQVKKPGASVRVSCQASGYTFTDYVLHWWRQAPGQGLEWMGWIKPVYGARNYAHRFQGRINFDRDVYREIAYMDLSGLRSDDTAVYFCARDGSGDATSWHLHPWGQGTLVIVSSASTKG

SEQ ID NO: 4304 - protein, 127 aa, synthetic construct
  REGION 1..127: note = anti-HIV_Chain
SQQLVQSGTQVKKPGASVRVSCQASGYTFTNYILHWWRQAPGRGLEWMGLIKPVYGAVNYARQFQGRIQLTRDIYREIAFLDLSGLRPDDTAVYYCARDESGYDLNWHLDSWGQGTQVIVSPASTKG

SEQ ID NO: 4305 - protein, 127 aa, synthetic construct
  REGION 1..127: note = anti-HIV_Chain
SQQLVQSGAQVKKPGASLRVSCQASGYTFMNYLLHWWRQAPGQGLEWMGWINPVYGAVNYAHRFQGRLTFSRDVYREIAYMDLNGLRSDDTAVYFCARDGSGDDRNWHLDPWGQGTLVIVSSASTKG

SEQ ID NO: 4306 - protein, 127 aa, synthetic construct
  REGION 1..127: note = anti-HIV_Chain
SQQLVQSGTQVKKPGASVRISCQASGYTFTDYVLHWWRQAPGQGLEWMGWIKPVYGARNYARRFQGRINFDRDIYREIAFLDLSGLRSDDTARYFCARDGSGDDTSWHLHPWGQGTLVIVSAASTKG

SEQ ID NO: 4307 - protein, 127 aa, synthetic construct
  REGION 1..127: note = anti-HIV_Chain
SQQLVQSGTQVKKTGASVRVSCQASGYDFTKYLIHWWRQAPGQGLEWMGWMKPVYGATNYAHRFQGRISFTRDIYREIAFMDLNGLRSDDTAVYFCARDGGGDDRTWLLDAWGQGTLVIVSSASTKG

SEQ ID NO: 4308 - protein, 127 aa, synthetic construct
  REGION 1..127: note = anti-HIV_Chain
SQQLVQSGTQVKKPGASVRVSCQASGYTFMNYIIHWWRQAPGQRLEWMGWINPVFGARNYAHRFQGRINFDRDINRETFQMDLTGLRSDDTAVYYCARDGSGDARDWHLHPWGQGTLVIVSSASTKG

SEQ ID NO: 4309 - protein, 127 aa, synthetic construct
  REGION 1..127: note = anti-HIV_Chain
SQHLVQSGTQVKKPGASVRVSCQASGYTFTNYILHWWRQAPGQGLEWMGLIKPVFGAVNYARQFQGRIQLTRDINREIAFLDLSGLRSDDTAVYYCARDESGDDLKWHLHPWGQGTQVIVSPASTKG

SEQ ID NO: 4310 - protein, 127 aa, synthetic construct
  REGION 1..127: note = anti-HIV_Chain
SQQLVQSGTQVKKPGASVRVSCQASGYTFMNYIIHWWRQAPGQRLEWMGWINPVFGARNYAHRFQGRINFDRDINRETFQMELTGLRSDDTAVYYCARDGSGDARDWHLDPWGQGTLVIVSSASTKG

SEQ ID NO: 4311 - protein, 127 aa, synthetic construct
  REGION 1..127: note = anti-HIV_Chain
SQQLVQSGTQVKKPGASVRISCQASGYTFTDYVLHWWRQAPGQGLEWMGWIKPVYGARNYARRFQGRINFDRDIYREIAYMDLSGLRSDDTARYFCARDGSGDDTSWHLHPWGQGTLVIVSAASTKG

SEQ ID NO: 4312 - protein, 127 aa, synthetic construct
  REGION 1..127: note = anti-HIV_Chain
SQQLVQSGTQVKKPGASVRISCQASGYSFTDYVLHWYRQAPGQGLEWMGWIKPVYGARNYARRFQGRINFDRDIYREIAFMDLSGLRSDDTALYFCARDGSGDDTSWYLDPWGQGTLVIVSAASTKG

SEQ ID NO: 4313 - protein, 127 aa, synthetic construct
  REGION 1..127: note = anti-HIV_Chain
SQQLVQSGTQVKKPGASVRISCQASGYSFTDYVLHWWRQAPGQGLEWMGWIKPVYGARNYARRFQGRINFDRDIYREIAFMDLSGLRSDDTALYFCARDGSGDDTSWHLDPWGQGTLVIVSAASTKG

SEQ ID NO: 4314 - protein, 127 aa, synthetic construct
  REGION 1..127: note = anti-HIV_Chain
SQHLVQSGTQVKKPGASVRVSCQASGYTFTNYILHWWRQAPGQGLEWMGLIKPVFGAVNYARQFQGRIQLTRDIYREIAFLDLSGLRSDDTAVYYCARDESGDDLKWHLHPWGQGTQVIVSPASTKG

SEQ ID NO: 4315 - protein, 127 aa, synthetic construct
  REGION 1..127: note = anti-HIV_Chain
QVQLVESGGGVVQPGKSLRLSCAISGFLFNNYGGQWVRQAPGKGLEWVAAISYDGNNRYYADSAKGRFLISRDTPKNILYLQIYSLRLDDTAVYYCARDSVSKSYSAPPEFWGQGTVVTVSSASTKG

SEQ ID NO: 4316 - protein, 127 aa, synthetic construct
  REGION 1..127: note = anti-HIV_Chain
QVHLEESGPGLVKTSQTLSLTCSVSSYSISRSGYFWTWIRQRPGKGLEWIGYIYFNGRTTYNPSLKSRITISRDTSHSQFSLTLNSLSAADTAVYYCGRCQDGLASRPIDFWGQGTLVTVSSASTKG

SEQ ID NO: 4317 - protein, 127 aa, synthetic construct
  REGION 1..127: note = anti-HIV_Chain
QVQLVESGGGVVQPGRSLRLSCATSGFTSKNYGVHWVRQAPGKGLEWVAVIWYDGSNKFYADSVKGRFTISRDRSKNMVYLQMNSLRVEDTAIYYCARDSVAFVLEGPIDYWGQGTLVTVSSASTKG

SEQ ID NO: 4318 - protein, 128 aa, synthetic construct
  REGION 1..128: note = anti-HIV_Chain
QVQLVQSGGGVKKPGTSASFSCRTSDDIYDNEFFDSAFMHWVRLIPGQRPEWMGWMNPRSGAVNYARQLQPRVSMYRDRDLSTAYMEFKSLTSADTGTYFCARKKRGDGFNLYFDLWGRGSQVIVSSA

SEQ ID NO: 4319 - protein, 128 aa, synthetic construct
  REGION 1..128: note = anti-HIV_Chain
QGHLVQSGGGVKKLGTSVTISCLASEDTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTS

SEQ ID NO: 4320 - protein, 128 aa, synthetic construct
  REGION 1..128: note = anti-HIV_Chain
QSALTQPPSVSGAPGQRVTISCSGGPSNVGGNYVYWYRQFPGTAPKLLILRDDQRPSGVPDRFSASKSGNSASLAISGLRPDDEAFYFCATYDSQGSFRVFGGGTALTVLSQPKAAPSVTLYPPSSEE

SEQ ID NO: 4321 - protein, 128 aa, synthetic construct
  REGION 1..128: note = anti-HIV_Chain
NFMLTQPPSASGTPGQRVTISCSGGGSNIGGNLVSWYQHFPGAAPKLLIYRNDQRPSGVPDRFSGSKSGTSASLAISGLRSDDKATYFCAAYDSTLSLRLFGGGTTLTVLSQPKAAPSVTLFPPSSEE

SEQ ID NO: 4322 - protein, 128 aa, synthetic construct
  REGION 1..128: note = anti-HIV_Chain
NFMLTQPPSVSATPGQTVTISCSGSGSNVGGNHVYWYRQLPGAAPTLVISKTDHRPSRVPDRFSGSKSGNSASLAISGLRPDDEAVYFCATYDTGLSLRLFGGGTRLTVLSQPKAAPSVTQFPPSSEE

SEQ ID NO: 4323 - protein, 128 aa, synthetic construct
  REGION 1..128: note = anti-HIV_Chain
QSALTQPPSASGAPGQRVTISCSGGPSNVGGNYVYWYRQFPGTAPKLLILRDDQRPSGVPDRFSASKSGNSASLAISGLRPDDEALYFCATYDSDGSIRLFGGGTALTVLSQPKAAPSVTLFPPGWEE

SEQ ID NO: 4324 - protein, 128 aa, synthetic construct
  REGION 1..128: note = anti-HIV_Chain
QVQLLQSGAAVTKPGASVRVSCEASGYNIRDYFIHWWRQAPGQGLQWVGWINPKTGQPNNPRLFQGRVSLTRHASWDFDTFSFYMDLKAVRSDDTAVYFCARQRSDYWDFDVWGSGTQVTVSSASTKG

SEQ ID NO: 4325 - protein, 128 aa, synthetic construct
  REGION 1..128: note = anti-HIV_Chain
QVQLLQSGAVVTKPGASVRVSCEASGYKIRDYFIHWWRQAPGQGLQWVGWINPQTGQPNIPRPFQGRVTLTRHASWDFDTFSFYMDLKALRSDDTAIYFCARRRSDYCDFDVWGSGTHVTVSSASTKG

SEQ ID NO: 4326 - protein, 128 aa, synthetic construct
  REGION 1..128: note = anti-HIV_Chain
QVQLLQSGAAVTKPGASVRVSCEASGYNIRDYFIHWWRQAPGQGLQWVGWINPKTGQPNNPRQFQGRVSLTRQASWDFDTISFYMDLKALRLDDTAVYFCARQRSDYWDFDVWGSGTQVTVSSASTKG

SEQ ID NO: 4327 - protein, 128 aa, synthetic construct
  REGION 1..128: note = anti-HIV_Chain
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVYSASTKG

SEQ ID NO: 4328 - protein, 128 aa, synthetic construct
  REGION 1..128: note = anti-HIV_Chain
QVQLLPFGGAVTKPGASVRVSCEASGYNIRDYFIHWWRQAPGQGLQWVGWINPKTGQPNNPCQFQGRVSLTRPASWDFDTISFYMDLKALRLDDTAVYFCARQRSDYWDFDVWGSGTQVTVSSASTKG

SEQ ID NO: 4329 - protein, 128 aa, synthetic construct
  REGION 1..128: note = anti-HIV_Chain
QVHLSQSGAAVTKPGASVRVSCEASGYKISDHFIHWWRQAPGQGLQWVGWINPKTGQPNNPRQFQGRVSLTRQASWDFDTYSFYMDLKALRSDDTAIYFCARQRSDFWDFDVWGSGTQVTVSSASTKG

SEQ ID NO: 4330 - protein, 128 aa, synthetic construct
  REGION 1..128: note = anti-HIV_Chain
QVHLSQSGAAVTKPGASVRVSCEASGYKISDHFIHWWRQAPGQGLQWVGWINPKTGQPNNPRQFQGRVSLTRQASWDFDTYSFYMDLKAVRSDDTAIYFCARQRSDFWDFDVWGSGTQVTVSSASTKG

SEQ ID NO: 4331 - protein, 128 aa, synthetic construct
  REGION 1..128: note = anti-HIV_Chain
QVQLLQSGAAVTKPGASVRVSCEASGYKISDHFIHWWRQAPGQGLQWVGWINPKTGQPNNPRQFQGRISLTRQASWDFDTFSFYMDLKALRSDDTAVYFCARQRSDYWDFDVWGSGTQVTVSSASTKG

SEQ ID NO: 4332 - protein, 128 aa, synthetic construct
  REGION 1..128: note = anti-HIV_Chain
QVQLLQSGAAVTKPGASVRVSCEASGYNIRDYFIHWWRQAPGQGLQWVGWINPKTGQPNNPRQFQGRVSLTRHASWDFDTFSFYMDLKGLRSDDTAIYFCARQRSDYWDFDVWGSGTQVTVSSASTKG

SEQ ID NO: 4333 - protein, 128 aa, synthetic construct
  REGION 1..128: note = anti-HIV_Chain
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKG

SEQ ID NO: 4334 - protein, 128 aa, synthetic construct
  REGION 1..128: note = anti-HIV_Chain
HVQLLQSGAAVTKPGASVRVSCEASGYNIRDYFIHWWRQAPGQGLQWVGWINPKTGQPNNPRQFQGRVSLTRQASWDFDTFSFYMDLKALRLDDTAIYFCARQRSDYWDFDVWGSGTQVTVSSASTKG

SEQ ID NO: 4335 - protein, 128 aa, synthetic construct
  REGION 1..128: note = anti-HIV_Chain
QVHLSHSGAAVTKPGASVRVSCEASGYKISDHFIHWWRQAPGQGLQWVGWINPKTGQPNNPRQFQGRISLTRQASWDFDTFSFYMDLKALRSDDTAVYFCARQRSDYWDFDVWGSGTQVTVSSASTKG

SEQ ID NO: 4336 - protein, 128 aa, synthetic construct
  REGION 1..128: note = anti-HIV_Chain
QVHLSQSGAVVTKPGASVRVSCEASGYKISDHFIHWWRQAPGQGLQWVGWINPKTGQPNNPRQFQGRISLTRQASWDFDTFSFYMDLKALRSDDTAVYFCARQRSDYWDFDVWGSGTQVTVSSASTKG

SEQ ID NO: 4337 - protein, 128 aa, synthetic construct
  REGION 1..128: note = anti-HIV_Chain
QVHLSQSGAVVTKPGASVRVSCEASGYKISDHFIHWWRQAPGQGLQWVGWINPKTGQPNNPRQFQGRISLTRQASWDIDTFSFYMDLKALRSDDTAVYFCARHRSDYWDFDVWGSGTQVTVSSASTKG

SEQ ID NO: 4338 - protein, 128 aa, synthetic construct
  REGION 1..128: note = anti-HIV_Chain
QVHLSQSGAVVTKPGASVRVSCEASGYKISDHFIHWWRQAPGQGLQWVGWINPKTGQPNIPRQFQGRISLTRQASGDFDTFSFYMDLKALRSDDTAVYFCARQRSDYWDFGVWGSGTQVTVSSASTKG

SEQ ID NO: 4339 - protein, 128 aa, synthetic construct
  REGION 1..128: note = anti-HIV_Chain
QVHLSQSGAVVTKPGASVRVSCEASGYKISGHFIHWWRQAPGQGLQWVGWINPKTGQPNNPRQFQGRISLTRQASWDFDTFSFYMDLKALRSDDTAVYFCARHRSDYWDFDVWGSGTQVTVSSASTKG

SEQ ID NO: 4340 - protein, 128 aa, synthetic construct
  REGION 1..128: note = anti-HIV_Chain
QVHLSQSGAAVTKPGASVRVSCEASGYKISDHFIHWWRQAPGQGLQWVGWINPKTGQPNNPRQFQGRISLTRQASWDFDTFSFYMDLKALRSDDTAVYFCARHRSDYWDFDVWGSGTQVTVSSASTKG

SEQ ID NO: 4341 - protein, 128 aa, synthetic construct
  REGION 1..128: note = anti-HIV_Chain
QVHLSQSGAAVTKPGASVRVSCEASGYKISDHFIHWWRQAPGQGLQWVGWINPKTGQPNNPRQFQGRVSLTRQASWDFDTYSFYMGLKAVRSDDTAIYFCARQRSDFWDFDVWGSGTQVTVSSASTKG

SEQ ID NO: 4342 - protein, 128 aa, synthetic construct
  REGION 1..128: note = anti-HIV_Chain
QVHLSQSGAVVTKPGASVRVSCEASGYKISDHFIHWWRQAPGQGLQWVGWINPKTGQPNNPRQFQGRISLTRQASWDFDTFSFYMDLKALRSDDTAVYFCARHRSDYWDFDVWGSGTQVTVSSASTKG

SEQ ID NO: 4343 - protein, 128 aa, synthetic construct
  REGION 1..128: note = anti-HIV_Chain
QVHLSQSGAVVTKPGASVRVSCEASGYKISDHFIHWWRQAPGQGLQWVGWINPKTGQPNNPRQFQGRISLTRQASWDFDTFSFYMDLEALRSDDTAVYFCARQRSDYWDFDVWGSGTQVTVSSASTKG

SEQ ID NO: 4344 - protein, 128 aa, synthetic construct
  REGION 1..128: note = anti-HIV_Chain
QVHLSQSGAAVTKPGASVRVSCEASGYKIRDYSIHWWRQAPGQGLQWVGWINPQTGQPNIPRPFQGRISLTRQASWDFDTFSFYMDLEALRSDDTAVYFCARQRSDYWDFDVWGSGTQVTVSSASTKG

SEQ ID NO: 4345 - protein, 128 aa, synthetic construct
  REGION 1..128: note = anti-HIV_Chain
QVHLSQSGAAVTKPGASVRVSCEASGYKISDHFIHWWRQAPGQGLQWVGWINPKTGQPNNPRQFQGRISLTRQASWDFDTFSFYMDLKALRSDDTAVYFCARQRSDYRDFDVWGSGTQVTVSSASTKG

SEQ ID NO: 4346 - protein, 128 aa, synthetic construct
  REGION 1..128: note = anti-HIV_Chain
QVHLSQSGAVVTKPGASVRVSCEASGYKISDHFIHWWRQAPGQGPQWVGWINPKTGQPNNPRQFQGRISLTRQASWDFDTFSFYMDLKALRSDDTAVYFCARHRSDYWDFDVWGSGTQVTVSSASTKG

SEQ ID NO: 4347 - protein, 128 aa, synthetic construct
  REGION 1..128: note = anti-HIV_Chain
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTAVYFCARQRSDYWDFDVWGSGTQVTVSSASTKG

SEQ ID NO: 4348 - protein, 128 aa, synthetic construct
  REGION 1..128: note = anti-HIV_Chain
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTGVYFCARQRSDYWDFDVWGSGTQVTVSSASTKG

SEQ ID NO: 4349 - protein, 128 aa, synthetic construct
  REGION 1..128: note = anti-HIV_Chain
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTAVYFCARQRSDYWDFDVWGSGSQVTVSSASTKG

SEQ ID NO: 4350 - protein, 128 aa, synthetic construct
  REGION 1..128: note = anti-HIV_Chain
QVQLLQSGAAVTKPGASVRVSCEASGYNIRDYFIHWWRQAPGQGLQWVGWINPKTGQPNNPCQFQGRVSLTRQASWDFDTISFYMDLKALRLDDTAVYFCARQRSDYWDFDVWGSGTQVTVSSASTKG

SEQ ID NO: 4351 - protein, 128 aa, synthetic construct
  REGION 1..128: note = anti-HIV_Chain
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVIVSSASTKG

SEQ ID NO: 4352 - protein, 128 aa, synthetic construct
  REGION 1..128: note = anti-HIV_Chain
QVQLVQSGADVKKPGATVTVSCKTDEDEDDFRAHLMQWMRQAPGQRLEWVGWIKPQTGQPSYGQKFQGRVTLTREVSTSTVFLQLRNLRSDDTAVYYCARPRGGRDNWSFHVWGRGTLVTVSSASTKG

SEQ ID NO: 4353 - protein, 128 aa, synthetic construct
  REGION 1..128: note = anti-HIV_Chain
EVQLVESGAEVKKPGASVKVSCKVSGNSLTEFSIHWVRQAPGKGLEWMGGFDPEEGETVPAQKFKGRLTMTEDTSTNTAYMELSSLRSEDTAVYYCSTEPREMGTLTAGFEYWGQGTLVTVSSASTKG

SEQ ID NO: 4354 - protein, 128 aa, synthetic construct
  REGION 1..128: note = anti-HIV_Chain
RVQLGQSGAEVKKPGASVKVSCKVSGNSLTEFSIHWVRQAPGKGLEWMGGFDPEEGETVPAQKFKGRVTMTEDTSTNTAYMELSSLRSEDTAVYYCSTEPREMGTLTAGFEYWGQGTLVIVSSASTKG

SEQ ID NO: 4355 - protein, 128 aa, synthetic construct
  REGION 1..128: note = anti-HIV_Chain
QVQLVQSGADVKKPGASVTVSCKTDEDEDDFRAHLVQWMRQAPGQRLEWVGWIKPQTGQPSYAQKFQGRVTLTREVSTSTVFLQLRNLRSDDTAVYYCARPRGGRDNWSFHVWGRGTLVTVSSASTKG

SEQ ID NO: 4356 - protein, 128 aa, synthetic construct
  REGION 1..128: note = anti-HIV_Chain
QVQLQESGPGLVKPSETLSLTCSVSGASISNFYWTWIRQPAGKGLEWVGRLYSSDRTNYNPSLNGRVTMSLDTSKNQFSLRLTSMTDADTAIYFCAREKGQWLTVPPYYFDSWGQGILVTVSSASTKG

SEQ ID NO: 4357 - protein, 128 aa, synthetic construct
  REGION 1..128: note = anti-HIV_Chain
QVQLVQSGAEVRKPGASVKVSCKTSGYTFTNSYIHWVRQAPGQGLEWMGIINPPGGNTYYAQKFHGRVTLTRDTSTSTVYMELNSLRSEDTAVYFCARPHSPTNIPSRPLDYWGQGTLVTVSSASTKG

SEQ ID NO: 4358 - protein, 128 aa, synthetic construct
  REGION 1..128: note = anti-HIV_Chain
QVQLQESGPGLVKPSGTLSLTCNVYGGSMISYYWSWIRQPPGKGLEWIGHVYNSGNTKYSPSLKNRVTISMDTSRNLFSLKVTSVTPADTAVYYCARADYDNIWDSRGGFDLWGQGTLVTVSSASTKG

SEQ ID NO: 4359 - protein, 128 aa, synthetic construct
  REGION 1..128: note = anti-HIV_Chain
QVQLVQSGAEVKKPGSSVKVSCKASGGTLSSYTISWVRQAPGQGLEWMGRLIPLVDITTYAQKFQGRVTITADTSTNTAYMELSNLRSEDTAIYHCATSTMIAAVINDAFDLWGQGTTVTVSSASTKG

SEQ ID NO: 4360 - protein, 128 aa, synthetic construct
  REGION 1..128: note = anti-HIV_Chain
QVQLVQSGAEVKKPGASVKISCKASGYSFRNYAVHWVRQAPGQGLEWMGEINGGNGNTEYSQKSQGRLTITRDISATTAYMELSSLRSDDTAVYYCARVAYVHVVTTRSLDNWGQGTLVTVSSASTKG

SEQ ID NO: 4361 - protein, 128 aa, synthetic construct
  REGION 1..128: note = anti-HIV_Chain
QVRLSQSGAAVMKTGASVTISCETEGFNFVNYIIHWVRRPPGRGFEWLGMIDPRNGHPWFAQTVRGRLSLRRDTFNEIVYMTLSGLTTDDTGLYFCARNEPQYHSLPGMFDYWGQGTPVTVSSASTKG

SEQ ID NO: 4362 - protein, 128 aa, synthetic construct
  REGION 1..128: note = anti-HIV_Chain
QVRLSQSGAAVVKTGASVTISCETEGYNFVNYIIHWVRRPPGRGFEWLGMIDPRNGHPWFAQTVRGRLSLRRDTFKETVYMTLSGLTSDDTGVYFCARNEPQYHSLPGMFDYWGHGTPVTVSSASTKG

SEQ ID NO: 4363 - protein, 128 aa, synthetic construct
  REGION 1..128: note = anti-HIV_Chain
QGQLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTS

SEQ ID NO: 4364 - protein, 128 aa, synthetic construct
  REGION 1..128: note = anti-HIV_Chain
QVQLVQSGAEVKKPGASVKVSCKASGYTFTSYDINWVRQATGQGLEWMGWMNPNSGNTGYAQTFQGRVTMTRNTSISTAYMELSSLRSEDTAVYYCARDRWLPQYYYYGMDVWGQGTTVTVSSASTKG

SEQ ID NO: 4365 - protein, 128 aa, synthetic construct
  REGION 1..128: note = anti-HIV_Chain
QVQLVQSGAEVKKPGSSMKVSCKSSGGTFSNHAISWVRQAPGKGLEWMGGIIPMSGTTNYLQKFQGRVTITADEFATTAYMELSSLTSEDTAVYYCARARADSHTPIDAFDIWGPGTRVIVSSASTKG

SEQ ID NO: 4366 - protein, 128 aa, synthetic construct
  REGION 1..128: note = anti-HIV_Chain
QVQLVQSGAEVKKPGASVKVSCKVSGYTLTELSIHWVRQAPGKRLEWMGGFDPEDGERIYAQKFQGRVTMTEDTSTDTAYMELNSLRSDDTAVYYCATGGLYCSSISCIMDVWGQGTTVTVSSASTKG

SEQ ID NO: 4367 - protein, 128 aa, synthetic construct
  REGION 1..128: note = anti-HIV_Chain
QVQLVQSGAEVKMPGASVKVSCKVSGYSLTELSIHWVRQAPGKRLEWMGGFDPEDDERIYAQKFQDRVTMTEDTSTDTAYMDLNSLRSEDTAVYYCTTGGLYCSSISCIMDVWGQGTTVIVSSASTKG

SEQ ID NO: 4368 - protein, 129 aa, synthetic construct
  REGION 1..129: note = anti-HIV_Chain
EVQLSESGGGFVKPGGSLRLSCEASGFTFNNYAMSWVRQAPGKGLEWVSVTSAHGGSAYYGEFVKGRFTMSRDHFIDTVYLEMNGLTVEDTAVYYCVRVTFYHEGSGYYYRAGNYFDSWGKGTRVVVSA

SEQ ID NO: 4369 - protein, 129 aa, synthetic construct
  REGION 1..129: note = anti-HIV_Chain
EVQLSESGGGFVKPGGSLRLSCEASGFTFNNYAMSWVRQAPGKGLEWVSVTSAHGGSAYYGEFVKGRFTMSRDHFIDTVYLEMNRLTVEDTAVYYCVRVTFYHEGSGYYYRAGNYFDSWGKGTRVVVSA

SEQ ID NO: 4370 - protein, 129 aa, synthetic construct
  REGION 1..129: note = anti-HIV_Chain
EVQLSESGGGVVKPGGSLRLSCEASGFTFSNYAMSWVRQAPGKGLEWVSVTGGHGTYGYYGEFVKGRFTISRDHSMDTVYLQMNRLRVEDTAVYYCVRTPYYHESSGYYYRAGNYFDFWGKGTLVIVSA

SEQ ID NO: 4371 - protein, 129 aa, synthetic construct
  REGION 1..129: note = anti-HIV_Chain
EVQLSESGGGFVKPGGSLRLSCEASGFTFNNYAMGWVRQAPGKGLEWVSVTSAHGGSAYFGEFVKGRFTMSRDHFIDTVYLEMNRLTVEDTAVYYCVRVTFYHEGSGYYYRAGNYFDSWGQGTLVIVSA

SEQ ID NO: 4372 - protein, 129 aa, synthetic construct
  REGION 1..129: note = anti-HIV_Chain
QVQLVESGGGLVQPGGSLRLSCAASGFTFSTHWMHWVRQAPGKGLVWVSRIHSDGRSTSYADSVKGRFTISRDNAKNTLYLQMNSLRAEDTAVYYCARGAAVFGVVIIGGMDLWGQGTTVTVSSASTKG

SEQ ID NO: 4373 - protein, 129 aa, synthetic construct
  REGION 1..129: note = anti-HIV_Chain
QVQLVESGGALVQPGGSLRLSCAASGFSFSSYAMSWVRQAPGKGLEWVSAISRSGGSTYYADSVKGRFTISIDNSNNTLYLQMNSLRVEDTAVYYCAKREAFYYGAGGYGMDVWGQGTTVTVSSASTKG

SEQ ID NO: 4374 - protein, 129 aa, synthetic construct
  REGION 1..129: note = anti-HIV_Chain
FQGHLVQSGGGVKKPGTSVTLSCLASEYTFTEFTIHWIRQAPGQGPLWLGLIKRSGRLMTSYRFQDRLSLRRDRSTGTVFMELRSLRTDDTAVYYCARDGLGELAPAYHYGIDAWGQGTTVIVTSASTS

SEQ ID NO: 4375 - protein, 129 aa, synthetic construct
  REGION 1..129: note = anti-HIV_Chain
QGLLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 4376 - protein, 129 aa, synthetic construct
  REGION 1..129: note = anti-HIV_Chain
NFMLTQPASVSGSPGQSITISCSGTGSDIGVYNYVSWYQQHPGKAPRLMIYDVTNRPSGVSNRFSGSKSGFTASLTISGLQGDDEADYYCSSYSSTNTYVFGTGTHVTVLGQPKANPTVTLFPPSSEEL

SEQ ID NO: 4377 - protein, 129 aa, synthetic construct
  REGION 1..129: note = anti-HIV_Chain
QSALTQPRSVSGSPGQSVTISCTGTSSDVGAYNYVSWYRQHPGKAPKLMINDVSKRPSGVPDRFSGSKSGNTASLTISGLQAEDEADYYCCSYAGTYSYVFGTGTKVTVLGQPKANPTVTLFPPSSEEL

SEQ ID NO: 4378 - protein, 129 aa, synthetic construct
  REGION 1..129: note = anti-HIV_Chain
QGQLVQSGGGLKKPGTSVTISCLASEYTFNEFVIHWIRQAPGQGPLWLGLIKRSGRLMTAYNFQDRLSLRRDRSTGTVFMELRGLRPDDTAVYYCARDGLGEVAPDYRYGIDVWGQGSTVIVTAASTKG

SEQ ID NO: 4379 - protein, 129 aa, synthetic construct
  REGION 1..129: note = anti-HIV_Chain
NFMLTQPPSASGAPGQRVTISCSGGPSNVGGNYVYWYRQFPGTAPNLLILRDDQRPSGVPDRFSASKSGNSASLAISGLRPDDEAFYFCATYDSDGSIRLFGGGTTLTVLSQPKAAPSVTLFPPSSEEL

SEQ ID NO: 4380 - protein, 129 aa, synthetic construct
  REGION 1..129: note = anti-HIV_Chain
QLVLTQPPSVSGAPGQRVTISCSGGPSNVGGNLVYWYKQFPGTAPKLLIRRDDQRPSGVPDRFSGSKSGNSASLTISGLRPDDEAFYFCATYDSQGSTRLFGGGTVLTVLSQPKAAPSVTLFPPSSEEL

SEQ ID NO: 4381 - protein, 129 aa, synthetic construct
  REGION 1..129: note = anti-HIV_Chain
NFMLTQPPSVSGAPGQRVTISCSGGPSNVGGNLVYWYKQFPGTAPKLLIRRDDQRPSGVPDRFSGSKSGNSASLAISGLRPDDEAFYFCATYDSHGSIRLFGGGTLLTVLSQPKAAPSVTLFPPSSEEL

SEQ ID NO: 4382 - protein, 129 aa, synthetic construct
  REGION 1..129: note = anti-HIV_Chain
QSALTRTPSVSGAPGQRVTISCSGGPSNVGGNYVYWYQQFPGAAPKLLIRRDDQRPSGVPDRFSGSKSGNSASLAISGLRLDDEAYYFCATYDSGWSIRLFGGGTRLTVLSQPKAAPSVTLFPPSSEEL

SEQ ID NO: 4383 - protein, 129 aa, synthetic construct
  REGION 1..129: note = anti-HIV_Chain
QSALTQPPSVSATPGQTVTISCSGSGSNVGGNHVYWYRQLPGAAPTLLISKTDHRPSRVPDRFSASKSGNSASLAISGLRPDDEAIYFCATYDTGLSLRLFGGGTRLTVLSQPKAAPSVTLFPPSSEEL

SEQ ID NO: 4384 - protein, 129 aa, synthetic construct
  REGION 1..129: note = anti-HIV_Chain
QVQLLESGPGLVTPSGTLSLACAVSGASISSSHWWTWVRQSPGKGLEWIGEIDRRGTTNYNPSLRSRVTILLDNSKNQFSLSLRSVTAADTAVYYCTKVYAGLFNERTYGMDVWGHGTTVLVSSASTKG

SEQ ID NO: 4385 - protein, 129 aa, synthetic construct
  REGION 1..129: note = anti-HIV_Chain
QAVVTQPPSVSATPGQTVTISCSGSGSNVGGNHVYWYRQLPGAAPTLLISKTNRRPSQVPDRFSGSKSGNSASLAISGLRPDDEADYFCATYDTDLSLRLFGGGTRLTVLSQPKAAPSVTLFPPSSEEL

SEQ ID NO: 4386 - protein, 129 aa, synthetic construct
  REGION 1..129: note = anti-HIV_Chain
QSALTQPPSVSGTPGQNVTISCSGGGSDVGGNLVSWYQHFPGAAPKLLIHRDNQRPSGVPDRFSALKSGNSASLAISGLRSDDEAFYFCAVYDSSLSLGLFGGGTKLTVLSQPKAAPSVTLFPPSSEEL

SEQ ID NO: 4387 - protein, 129 aa, synthetic construct
  REGION 1..129: note = anti-HIV_Chain
QSALTQPPSASGTPGQRVTISCSGGGSNIGGNLVSWYQHFPGTAPKLLIYRNDQRPSGVPDRFSGSKSGTSASLTISGLRSDDEATYFCAAYDSSLSLRLFGGGTTLNVLSQPKAAPSVTLFPPSSEEL

SEQ ID NO: 4388 - protein, 129 aa, synthetic construct
  REGION 1..129: note = anti-HIV_Chain
QSALTQPPSVSATPGQTVTISCSGSGSNVGGNHVYWYRQLPGAAPTLLISKTNHRPSQVPDRFSASKSGNSASLAISGLRPDDEADYFCGTYDTSLSLRLFGGGTRLTVLSQPKAAPSVTLFPPSSEEL

SEQ ID NO: 4389 - protein, 129 aa, synthetic construct
  REGION 1..129: note = anti-HIV_Chain
QSVLTQVLSVSGTPGQRVIISCSGTSSNVGGNLVSWYQHLPGAAPRLLIHRDDQRPSGVPDRFSGSKSGNSASLVISGLRSDDEADYFCGAYDSTFSLPVFGGGTRLTVLSQPKAAPSVTLFPPSSEEL

SEQ ID NO: 4390 - protein, 129 aa, synthetic construct
  REGION 1..129: note = anti-HIV_Chain
QSALTQPPATSGTPGQRVTISCSGGGSNVGGNLVSWYQQFPGAAPKLILHRDGQRPSGVPDRFSASKSGTSASLTISGLRSDDEATYFCAAFDSALSLPLFGGGTKLTVLSQPKAAPSVTLFPPSSEEL

SEQ ID NO: 4391 - protein, 129 aa, synthetic construct
  REGION 1..129: note = anti-HIV_Chain
QLVLTQPPSVSATPGQTVTISCSGSGSNVGGNHVYWYRQLPGAAPTLVISKTDHRPSRVPDRFSGSKSGNSASLAISGLRPDDEAAYFCATYDTGLSLRLFGGGTRLAVLSQPKAAPSVTLFPPSSEEL

SEQ ID NO: 4392 - protein, 129 aa, synthetic construct
  REGION 1..129: note = anti-HIV_Chain
QSALTQPPSVSGTPGQNVTISCSGGGSNVGGNLVSWYQHFPGAAPKLLIHRDNQRPSGVPDRFSVLKSGNSASLAISGPRSDDEAFYFCAVYDSSLSLGLFGGGTKLTVLSQPKAAPSVTLFPPSSEEL

SEQ ID NO: 4393 - protein, 129 aa, synthetic construct
  REGION 1..129: note = anti-HIV_Chain
QTVVTQPPSASGTPGQRVTISCSGGGSNIGGNLVSWYQHFPGAAPKLLIYRNDQRPSGVPDRFSGSKSGTSASLTISGLRSDDEATYFCAAYDCTLSLRLFGGGTTLNVLSQPKAAPSVTLFPPSSEEL

SEQ ID NO: 4394 - protein, 129 aa, synthetic construct
  REGION 1..129: note = anti-HIV_Chain
QSALTQTPSVSGAPGQRVTISCSGGPSNVGGNYVYWYQQFPGAAPKLLIRRDDQRPSGVPDRFSGSKSGNSASLAISGLRLDDEAYYFCATYDSGWSIRLFGGGTRLTVLSQPKAAPSVTLFPPSSEEL

SEQ ID NO: 4395 - protein, 129 aa, synthetic construct
  REGION 1..129: note = anti-HIV_Chain
QSVLTQPPSASGAPGQRVTISCSGGPSNVGGNYVYWYRQFPGTAPNLLILRDDQRPSGVPDRFSASKSGNSASLAISGLRPDDEAFYFCATYDSDGSVRLFGGGTTLTVLSQPKAAPSVTLFPPSNGGR

SEQ ID NO: 4396 - protein, 129 aa, synthetic construct
  REGION 1..129: note = anti-HIV_Chain
QGQLVQSGGGVKKPGTSVTISCLASEYTFNEFVIHWIRQAPGQGPLWLGLIKRSGRLMTSYKFQDRLNLRRDRSTGTVFMELRGLRPDDTAVYYCARDGLGEVAPDYRYGIDVWGQGSTVIVTAASTKG

SEQ ID NO: 4397 - protein, 129 aa, synthetic construct
  REGION 1..129: note = anti-HIV_Chain
EVQLVESGAEVKKPGASVKVACKVSGKKLSDLSIHWVRQAPGKGLEWMGGFDEEDGKISYERKFQGRVTMTEDTARDTAFMEMSSLRSDDTAVYFCAAAPRLDLGELSSGFHFWGLGTLVSVSSASTKG

SEQ ID NO: 4398 - protein, 129 aa, synthetic construct
  REGION 1..129: note = anti-HIV_Chain
QGQLVQSGGGGKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVSSASTKG

SEQ ID NO: 4399 - protein, 129 aa, synthetic construct
  REGION 1..129: note = anti-HIV_Chain
EVQLVESGAEVKKPGASVKVSCKVSGYTLSDLSMHWVRQAPGKGLEWMGGFDEEDGEITYAQKFQGRVSMTEDTSRDTAYMELSSLRSEDTAVYYCATAPRLELGELSSGFHYWGLGTLVTVSSASTKG

SEQ ID NO: 4400 - protein, 129 aa, synthetic construct
  REGION 1..129: note = anti-HIV_Chain
QGQLVQSGGGVKKTGTSVTISCLASEYTFTEFTIHWIRQAPGQGPLWLGLIKRSGRLMTANRFQDRLSLRRDRSTGTVFMELRSLRIDDTAVYYCARDGLGELAPAYHYGIDVWGQGTTIIVTSASTKG

SEQ ID NO: 4401 - protein, 129 aa, synthetic construct
  REGION 1..129: note = anti-HIV_Chain
QGQLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 4402 - protein, 129 aa, synthetic construct
  REGION 1..129: note = anti-HIV_Chain
QGQLVQSGGGVKKLGTSVTIPCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 4403 - protein, 129 aa, synthetic construct
  REGION 1..129: note = anti-HIV_Chain
QGQLVQSGGGVKKPGTSVTISCLASEYTFNEFVIHWIRQAPGQGPVWLGLIKRSGRLMTSYKFQDRLSLRRDRSTGTVFMELRGLRLDDTAVYYCARDGLGEVAPAYLYGIDAWGQGSKVIVTPASTKG

SEQ ID NO: 4404 - protein, 129 aa, synthetic construct
  REGION 1..129: note = anti-HIV_Chain
QARLDQWGTGLLKPSETLSLKCAVFGVLFTDYNWTWVRQSPGKELEWIGHLDHRGGGNYNPSLESRVTISLDYSKAQFSLHLKSVTVADTARYYCAGAVKGFWFDDPYTWFGPWSQGTLVTVASASTKG

SEQ ID NO: 4405 - protein, 129 aa, synthetic construct
  REGION 1..129: note = anti-HIV_Chain
QARLDQWGTGLLKPSETLSLKCAVFGVLFTDYNWTWVRQSPGKGLEWIGHLDHRGGGSYNPSLESRVSISLDYSKAQFSLHLKSVTVADTALYYCAGAVKGFWFDEPSTWFGPWSQGTMVTVASASTKG

SEQ ID NO: 4406 - protein, 129 aa, synthetic construct
  REGION 1..129: note = anti-HIV_Chain
QGHLVQSGGGVKKLGTSVTISCLASEDTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 4407 - protein, 129 aa, synthetic construct
  REGION 1..129: note = anti-HIV_Chain
QVQLVQSEAEVKKPGSSVKVSCKASGGTFRGYTISWVRQAPGQGLEWMGRIIPILGKAIYAPSFQGRVTLTADKSTGTAYMELSRLRSDDTAVYYCAKVKMRGSSGYYYLFDDWGQGTLVTVSSASTKG

SEQ ID NO: 4408 - protein, 129 aa, synthetic construct
  REGION 1..129: note = anti-HIV_Chain
QARLDQWGTGLLKPSETLSLKCAVFGVLFTDYNWTWVRQSPGKGLEWIGHLDHRGGGNYNPSLESRVTISLDYSKAQFSLHLKSVTVADTALYYCAGAVKGFWFDEVYNWFGPWSQGTLVTVASASTKG

SEQ ID NO: 4409 - protein, 129 aa, synthetic construct
  REGION 1..129: note = anti-HIV_Chain
QGQLVQSGGGVKKPGTSVTISCLASEYTFTEFTIHWIRQAPGQGPLWLGLIKRSGRLMTAYRFQDRLSLRRDRSTGTVFMELRNLRMDDTAVYYCARDGLGELAPAYQYGIDVWGQGTTVIVSSASTKG

SEQ ID NO: 4410 - protein, 129 aa, synthetic construct
  REGION 1..129: note = anti-HIV_Chain
QVRLVQSGPQVKRPGASIRLSCESSGYRFQDYIVAWIRQTRGQGFEFVGMVNPRGGRPWPSSRFRDRVTLTRDIESETFYLGLNDLTSDDTATYFCARLEADGSDYSPKMFDFWGQGTKIVVSPASTKG

SEQ ID NO: 4411 - protein, 129 aa, synthetic construct
  REGION 1..129: note = anti-HIV_Chain
QVRLVQSGPQVKTPGASMRVSCEASGYRFLDYIIVWIRQTHGQHFEYVGMINPRGGTPWPSSKFRDRLSLTRDIHTDTFYLGLNNLGSDDTAIYFCARLEADGDDYSPKMFDHWGQGTRIIVSAASTKG

SEQ ID NO: 4412 - protein, 129 aa, synthetic construct
  REGION 1..129: note = anti-HIV_Chain
QVRLVQSGPQVKTPGASIRLSCEASGYRFLDYFIVWVRQTPGQGFEYVGMINPRGGRPWSSWKFRDRLSLTREIDTDTFYLGLSNLRSDDTAIYFCARLEADGDDYSPKMVDYWGQGTKIIVSAASTKG

SEQ ID NO: 4413 - protein, 129 aa, synthetic construct
  REGION 1..129: note = anti-HIV_Chain
QVRLVQSGPQVKRPGASIRLSCETSGYRFQDYIVAWIRQTRGQRFEFVGMVNPRGGRPWPSSKFRDRVTLTRDIESETFHLGLNDLTSDDTATYFCARLEADGADYSPKMFDFWGQGTKIVVSPASTKG

SEQ ID NO: 4414 - protein, 129 aa, synthetic construct
  REGION 1..129: note = anti-HIV_Chain
QVRLVQSGPQVKTPGASMRISCEASGYRFQDYIIVWIRQTHGQGFEYVGMINPRGGTPWSSSKFRDRLSLTRDIYTDTFYLGLNNLGSDDTAIYFCARLEADGGDYSPKMFDYWGQGTRIIVSAASTKG

SEQ ID NO: 4415 - protein, 129 aa, synthetic construct
  REGION 1..129: note = anti-HIV_Chain
QGQLVQSGGGVKKPGASVTISCLASEYTFNEFVIHWIRQAPGQGPLWLGLIKRSGRLMTAYKFQDRLSLRRDRSTGTVFMELRGLRPEDTAVYYCARDGLGEVAPDYRYGIDVWGQGSTVIVSAASTKG

SEQ ID NO: 4416 - protein, 129 aa, synthetic construct
  REGION 1..129: note = anti-HIV_Chain
QVRLVQSGPQMKTPGASLRLSCEVSGYRFLDYFIVWVRQTGGQGFEYVGMINPRGGRPWSSWKFRDRLSLTRDIETDTFYLGLNNLRSDDTAIYFCARLEADGDNYSPKMVDYWGQGTKIIVSPASTKG

SEQ ID NO: 4417 - protein, 129 aa, synthetic construct
  REGION 1..129: note = anti-HIV_Chain
QVSLVQSGPQVKTPGASMRVSCETSGYRFLDYIIVWIRQTHGQHFEYVGMINPRGGTPWPSSKFRDRLTMTRDIHTDTFYLGLNNLRSDDTAIYFCARLEADGDDYSPKMFDYWGQGTRIIVSAASTKG

SEQ ID NO: 4418 - protein, 129 aa, synthetic construct
  REGION 1..129: note = anti-HIV_Chain
QVRLVQSGPQVKTAGASMRVSCEASGYRFLDYIIVWIRQTHGQHFEYVGMINPRGGTPWPSSKFRDRLTLTRDIYTDTFYLGLNNLGSGDTAIYFCARLEADGDDYSPKMFDYWGQGTRIIVSAASTKG

SEQ ID NO: 4419 - protein, 129 aa, synthetic construct
  REGION 1..129: note = anti-HIV_Chain
QGQLVQSGGGVKKPGTSVTISCLASEYTFNEFVIHWIRQAPGQGPVWLGLIKRSGRLMTSYKFQDRLSLRRDRSTGTVFMELRGLRLDDTAVYYCARDGLGEVAPAYLYGIDAWGQGSTVIVTSASTKG

SEQ ID NO: 4420 - protein, 129 aa, synthetic construct
  REGION 1..129: note = anti-HIV_Chain
QGQLVQSGGGLKKPGTSVTISCLASEYTFNEFVIHWIRQAPGQGPLWLGLIKRSGRLMTAYNFQDRLRLRRDRSTGTVFMELRGLRPDDTAVYYCARDGLGEVAPDYRYGIDVWGQGSTVIVTAASTKG

SEQ ID NO: 4421 - protein, 129 aa, synthetic construct
  REGION 1..129: note = anti-HIV_Chain
QGHLVQSGGGVKKLGTSVTISCLVSEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 4422 - protein, 129 aa, synthetic construct
  REGION 1..129: note = anti-HIV_Chain
QGQLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVSSASTKG

SEQ ID NO: 4423 - protein, 129 aa, synthetic construct
  REGION 1..129: note = anti-HIV_Chain
QGHLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 4424 - protein, 129 aa, synthetic construct
  REGION 1..129: note = anti-HIV_Chain
QVQLVQSGSELKKPGASVKVSCKASGYTFTSYAINWVRQAPGQGLEWMGWINTNTGNPTYAQGFTGRFVFSLETSVSTAYLQINSLKAEDTAVYYCARDLLESRTYYNDIRDCWGQGTLVTVSSASTKG

SEQ ID NO: 4425 - protein, 129 aa, synthetic construct
  REGION 1..129: note = anti-HIV_Chain
QVQLVQSGAEVKKPGASVKVSCKASGYTFTDYYIHWVRQAPGQGLEWMGWINPSTGGTNFVQKFLGRVTMTSDTSINTAYMELRRLKNDDAAIYYCATYSTRQFFHYYYVTDVWGQGTTVTVSSASTKG

SEQ ID NO: 4426 - protein, 129 aa, synthetic construct
  REGION 1..129: note = anti-HIV_Chain
FQGQLVQSGGGVKKPGSSVTISCLASEYTFTEFTIHWIRQAPGQGPLWLGLIKRSGRLMTSYGFQDRLSVRRDRSTGTVFMELRSLRTDDTAVYYCARDGLGELAPAYHYGIDVWGQGTTVIVTSASTS

SEQ ID NO: 4427 - protein, 129 aa, synthetic construct
  REGION 1..129: note = anti-HIV_Chain
QVQLVESGGGVVQPGRSLRLSCAASGFTFSSYAMHWVRQAPGKGLEWVAVISYDGSNKYYADSVKGRFTISRDDSKSTVYLQINSLRAADTAVYFCAREGGLRFLEWLFWGQGTLVTVSSGESSASTKG

SEQ ID NO: 4428 - protein, 130 aa, synthetic construct
  REGION 1..130: note = anti-HIV_Chain
QVQLVQSGAVVKSPGSSAKLSCRLLGDEFGTYFISWIRQAPGRGLEWVGGIVPHSQLQSSAQKFHGRFFITGGVTPPIIFLQLTNVTFEDTGTYFCARERGRHRDPKTGKSLRGRYFDFWGRGTGVTVSP

SEQ ID NO: 4429 - protein, 130 aa, synthetic construct
  REGION 1..130: note = anti-HIV_Chain
QIELRQSGAAMKSPGSSVKLSCTVLGENFGTYFISWIRQAPGQGLEWVGGIVPHSQLQSSAQKFHGRIKISGGGTPPVVSLELTNVTFDDTGTYFCARERGRHVEPKTGDRLAGRYFDIWGRGTGLRVSP

SEQ ID NO: 4430 - protein, 130 aa, synthetic construct
  REGION 1..130: note = anti-HIV_Chain
EVQLVESGGGLVKPGGSLRLSCEASGFTFTNAWMNWVRQAPGKGLEWVGRIKSQTHGGTTRYAAPVKGRFTISRDDSKHTLYLQMDRLTTEDTAVYYCTGTITGSTFYYYGMDVWGQGTTVTVSPASTKG

SEQ ID NO: 4431 - protein, 130 aa, synthetic construct
  REGION 1..130: note = anti-HIV_Chain
VVQLVQSGPGLVKPSQTLSLTCTVSGGSISSGDFYWSWIRQPPGKGLEWIGYIYYSGSTYYNPSLKSRLTISVDTSKNQFSLRLSSVTAADTAVYYCARDLNSRIVGALDAFDIWGQGTMVTVSSASTKG

SEQ ID NO: 4432 - protein, 130 aa, synthetic construct
  REGION 1..130: note = anti-HIV_Chain
EVQLVQSGGGLVQPGRSLRLSCAASGFTFDDYAMHWVRQAPGKGLEWVSGISWNSGTIGYADSVRGRFTISRDDAKSSLYLQMNSLRTEDTALYYCAKDGWVGSGSSTLRGSDYWGQGTLVTVSSASTKG

SEQ ID NO: 4433 - protein, 130 aa, synthetic construct
  REGION 1..130: note = anti-HIV_Chain
QSVLTQPPSASGSPGQSITISCTGTSSDVGGYNYVSWYQQPPGKAPKVIIYEVSKRPSGVPDRFSGSKSGNTASLTVSGLQAEDEADYYCSSYAGSNNFVFGTGTEVTVVGQPKANPTVTLFPPSSEELL

SEQ ID NO: 4434 - protein, 130 aa, synthetic construct
  REGION 1..130: note = anti-HIV_Chain
QAVVTQEPSLTVSPGGTVTLTCASSTGAVTSGFYPHWFQQKPGQAPRALIYSTSNRYSWTPARFSGSLLGGKAALTLSGVQPEDEAEYYCLLLPYYGGPWIFGGGTKLTVLGQPKAAPSVTLFPPSSEEL

SEQ ID NO: 4435 - protein, 130 aa, synthetic construct
  REGION 1..130: note = anti-HIV_Chain
QSALTQPPSASGAPGQRVTISCSGGPSNVGGNYVYWYRQFPGTAPTLLILRDDQRPSGVPDRFSASKSGNSASLAISGLRPDDEGFYFCATYDSDGSIRLFGGGTALTVLSQPKAAPSVTLFPPSSEELK

SEQ ID NO: 4436 - protein, 130 aa, synthetic construct
  REGION 1..130: note = anti-HIV_Chain
QVQLVESGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 4437 - protein, 130 aa, synthetic construct
  REGION 1..130: note = anti-HIV_Chain
EVQLVESGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 4438 - protein, 130 aa, synthetic construct
  REGION 1..130: note = anti-HIV_Chain
EVQLVQSGSDVRKPGATVTVSCKADEDEDDFTAYDYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 4439 - protein, 130 aa, synthetic construct
  REGION 1..130: note = anti-HIV_Chain
QVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 4440 - protein, 130 aa, synthetic construct
  REGION 1..130: note = anti-HIV_Chain
QVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSRGRGTSLTVSSASTKG

SEQ ID NO: 4441 - protein, 130 aa, synthetic construct
  REGION 1..130: note = anti-HIV_Chain
EVQLVESGSDVRKPGATVTVSCKADEDEDDFTAYNYFMHWVRQAPGQGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 4442 - protein, 130 aa, synthetic construct
  REGION 1..130: note = anti-HIV_Chain
VVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 4443 - protein, 130 aa, synthetic construct
  REGION 1..130: note = anti-HIV_Chain
EVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 4444 - protein, 130 aa, synthetic construct
  REGION 1..130: note = anti-HIV_Chain
EVQLVQSGSDVKKPGTTVTISCKADEDEDDFTAYNYFMHWVRQAPGQGLEWIGWINPRTGQPNHAKQLQGRVTLTRERSTSTVFMKLTNLRLDDTAVYFCARPLRGGDTWHYHSWGRGTSLIVSSASTKG

SEQ ID NO: 4445 - protein, 130 aa, synthetic construct
  REGION 1..130: note = anti-HIV_Chain
QVQLVESGGGLVKPGGSLRLSCAASGFSFNEYYMSWIRQAPGQGLEWVANIGSSDAYTIYADSVKGRFTISRDNAENTVYLQMNSLRGEDTAVYYCARIEGYCSNSRCSNYFDPWGQGALVTVSSASTKG

SEQ ID NO: 4446 - protein, 130 aa, synthetic construct
  REGION 1..130: note = anti-HIV_Chain
QVQLVQSGAEVKKPGASVKVSCKVSGYPLAELSVHWVRQVPGKGLEWVGGFDPEEGKTVYAQKFQGRVTMTEDRSTDTVYMELISLRYEDTAVYYCATDNPVLQLGELSSSLDYWGQGTLVTVSSASTKG

SEQ ID NO: 4447 - protein, 130 aa, synthetic construct
  REGION 1..130: note = anti-HIV_Chain
EVQLVQSGAEVKKPGESLRISCKTSGYNFNDDWIAWVRQRPDKGPEWMGIFYPGDSQATYSPSFQGHVTFSADTSISTAYLQWTSLKASDTAIYYCARTRCFGANCFNFMDVWGKGTALTVTVSSASTKG

SEQ ID NO: 4448 - protein, 130 aa, synthetic construct
  REGION 1..130: note = anti-HIV_Chain
QVQLVQLLQSGAEVKKPGSSVKVSCQISGYGFSNYAISWVRQAPGQGLEWLGRIVPAVGMTEYAQKFQGRVTFTADRSTITAYMDLRGLRSDDTAVYYCVRDPQVEVRGNAFDIWGQGTMVTVSSASTKG

SEQ ID NO: 4449 - protein, 130 aa, synthetic construct
  REGION 1..130: note = anti-HIV_Chain
QVHLQQWGAGLLKPSETLSLTCAVSGGSFSGFFWTWIRQSPGKGLEWIGEVNHSGFTHSNPSLESRATISVAASNTQFSLRLASVTAADTAIYFCALRYFDWSPFRRDTYGTDVWGQGTTVIVSSASTKG

SEQ ID NO: 4450 - protein, 130 aa, synthetic construct
  REGION 1..130: note = anti-HIV_Chain
QVRLEQSGGALRKPGASVTLSCQASGYNFVKYIIHWVRQRPGLGFEWVGMIDPYRGRPWYAHSFAGRLSLSRDTSTETLYMTLSSLKSDDTATYFCARAEAASDSHSRPIMDWTWRILCLLAVVPASTKG

SEQ ID NO: 4451 - protein, 130 aa, synthetic construct
  REGION 1..130: note = anti-HIV_Chain
QVRLEQSGAAVRKPGASVTLSCQASGYNFVNYIIHWVRQRPGLDFEWVGMIDPYRGRPWSAHKFQGRLSLSRDVSTEILYMTLNSLRSDDTATYFCARAEAESQSHSRPIMFDSWGQGSRVTVSSASTKG

SEQ ID NO: 4452 - protein, 130 aa, synthetic construct
  REGION 1..130: note = anti-HIV_Chain
QVRLEQSGAAVKKPGASVTISCQASGYNFVKFFIHWVRQRPGQGFEWVGMIEPYRGRPWSAGNFQGRLSLSRDVSTETLYMTLNNLRSDDTAVYFCARLEAESDSHSRPIMFDHWGHGSLVTVSSASTKG

SEQ ID NO: 4453 - protein, 130 aa, synthetic construct
  REGION 1..130: note = anti-HIV_Chain
QVRLEQSGAAVRKPGASVTLSCQASGYNFVNYIIHWVRQRPGLDFEWVGMIDPYRGRPWSAHKFEGRLSLSRDVSTEVLYMTLSSLRSDDTATYFCARAEAESQSHSRPIMFDYWGQGSRVTVSSASTKG

SEQ ID NO: 4454 - protein, 130 aa, synthetic construct
  REGION 1..130: note = anti-HIV_Chain
QVRLEQSGTAVRKPGASVTISCQASGYNFVKFFIHGVRQRPGQGFEWVGMIEPFRGRPWSAGNFQGRLSLSRDVSTETLYMTLNNLRSDDTAVYFCARLEAESDSHSRPIMFDHWGHGSLVTVSSASTKG

SEQ ID NO: 4455 - protein, 130 aa, synthetic construct
  REGION 1..130: note = anti-HIV_Chain
QVRLEQSGTAMRKPGASVTLSCQASGYNFVKYIVHWVRQKPGLGFEWVGMIDPYRGRPWSAHKFQGRLSLSRDTSMEILYMTLTSLKSDDTATYFCARAEAASDSHSRPIMFDHWGQGSRVTVSSASTKG

SEQ ID NO: 4456 - protein, 130 aa, synthetic construct
  REGION 1..130: note = anti-HIV_Chain
QVRLEQSGAAMRKPGASVTLSCQASGYNFVKYIVHWVRQKPGLGFEWVGMIDPYRGRPWSAHKFQGRLSLSRDTSMEILYMTLTSLKSDDTATYFCARAEAASDSHSRPIMFDHWGQGSRVTVSSASTKG

SEQ ID NO: 4457 - protein, 130 aa, synthetic construct
  REGION 1..130: note = anti-HIV_Chain
QVRLEQSGAAMRKPGASVTLSCQASGYNFVKYIIHWVRQKPGLGFEWVGMIDPYRGRPWSAHKFQGRLSLSRDTSMEILYMTLTSLKSDDTATYFCARAEAASDSHSRPIMFDHWGQGSRVTVSSASTKG

SEQ ID NO: 4458 - protein, 130 aa, synthetic construct
  REGION 1..130: note = anti-HIV_Chain
QVRLEQSGNAVRKPGASVTISCQASGYNFVKFFIHWVRQRPGQGFEWVGMIEPFRGRPWSAGNFQGRLSLSRDVSTETLYMTLNNLRSDDTAVYFCARLEAESDSHSRPIMFDHWGHGSLVTVSSASTKG

SEQ ID NO: 4459 - protein, 130 aa, synthetic construct
  REGION 1..130: note = anti-HIV_Chain
QVRLEQSGAAVRKPGASVTLSCQASGYNFVRYIIHWVRQRPGLDFEWVGMIDPYRGRPWSAHKFGGRLSLTRDVSTEILYMTLTSLRSDDTATYFCARAEAESQSHSRPIMFDSWGQGSRVTVSSASTKG

SEQ ID NO: 4460 - protein, 130 aa, synthetic construct
  REGION 1..130: note = anti-HIV_Chain
QVRLEQSGAAVRKPGASVTLSCQASGYNFVNYIIHWVRQRPGLDFEWVGMIDPYRGRPWSAHKFQGRLSLSRDVSTEILYMTLSSLRSDDTATYFCARAEAESQSHSRPIMFDFWGQGSRVTVSSASTKG

SEQ ID NO: 4461 - protein, 130 aa, synthetic construct
  REGION 1..130: note = anti-HIV_Chain
QVRLEQSGTAVRKPGASVTISCQASGYNFVKFFIHWVRQRPGQGFEWVGMIEPFRGRPWSAGNFQGRLSLSRDVSTETLYMTLNNLRSDDTAVYFCARLEAESDSHSRPIMFDHWGHGSLVTVSSASTKG

SEQ ID NO: 4462 - protein, 130 aa, synthetic construct
  REGION 1..130: note = anti-HIV_Chain
QVRLEQSGAAMRKPGASVTLSCQASGYNFVKYIVHWVRQKPGLGFEWVGMIDPYRGRPWSAHKFQGRLSLSRDTSMEILYMTLTSLTSDDTATYFCARAEAASDSHSRPIMFDHWGQGSRVTVSSASTKG

SEQ ID NO: 4463 - protein, 130 aa, synthetic construct
  REGION 1..130: note = anti-HIV_Chain
EVQLVQSGGGLVQPGGSLRLSCAASGLTFRNFAMSWVRQAPGKGLEWVSSISGSGGSTYYADSVKGRFTISRDNSKNTLYLQMNSLRGEDTAVYFCAKGVGYDILTGLGDAFDIWGQGTVVAVSSASTKG

SEQ ID NO: 4464 - protein, 131 aa, synthetic construct
  REGION 1..131: note = anti-HIV_Chain
QVQLVQSGAAVRKPGASVTVSCKFAEDDDYSPHWVNPAPEHYIHFLRQAPGQQLEWLAWMNPTNGAVNYAWQLHGRLTATRDGSMTTAFLEVRSLRSDDTAVYYCARAQKRGRSEWAYAHWGQGTPVLVSS

SEQ ID NO: 4465 - protein, 131 aa, synthetic construct
  REGION 1..131: note = anti-HIV_Chain
QVQLQQWGAGLLKPSETLSLTCAVYAGSFSGYYWTWIRQPPGKGLEWIGEVNHGGSTNYNPSLKSRVTLSVDTSKNQFSLKLTSVTAADTAVYYCARVSRYDFWSGNYGSYGLDVWGQGTTVTVSSASTKG

SEQ ID NO: 4466 - protein, 131 aa, synthetic construct
  REGION 1..131: note = anti-HIV_Chain
EVQLVQSGGGVVQPGRSLRLSCVVSGFTFSSFTFHWVRQAPGKGLEWVAGMSFHATYIYYADSVKGRFTISRDDSQDTLYLEMDSLRSEDTAIYYCARDPGIHDYGDYAPGAFDYWGQGSPVTVSSASTKG

SEQ ID NO: 4467 - protein, 131 aa, synthetic construct
  REGION 1..131: note = anti-HIV_Chain
QVQLVQSGTEVQKPGASVKVSCKTSGYTFSKYYIHWVRQAPGQGLEWVGRINTDSGGTDYAEKFQGRVTMTRDTSITTVYLEMRGLTSDDTAAFYCARGPPHAGGWTIYYYGLDVWGQGTSVIVSSASTKG

SEQ ID NO: 4468 - protein, 131 aa, synthetic construct
  REGION 1..131: note = anti-HIV_Chain
RTVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSGVFGTGTKVTVLGQPKANPTVTLFPPSSEEL

SEQ ID NO: 4469 - protein, 131 aa, synthetic construct
  REGION 1..131: note = anti-HIV_Chain
QVQLQQWGSGLLKPSETLSLTCAVYGGSFRSYYWNWIRQSPGKGLEWIGEVSHSGSTNYNPALKSRVTISVDTSKNQFSLKVKSVTAADTALYYCSRGRGKRCSGAYCFAGYFDSWGQGGLVVVSSASTKG

SEQ ID NO: 4470 - protein, 131 aa, synthetic construct
  REGION 1..131: note = anti-HIV_Chain
QVHLVQSGAEVKKPGSSVRVSCEASGWTFGSVNSAITWVRQAPGQGLEWMGRTIPFLGISNYAQKFQGRVTITADKSTNIAYVDVTSLTSQDTAVYYCARLITGMTAPWFYYMDVWGKGTTVTVSSASTKG

SEQ ID NO: 4471 - protein, 131 aa, synthetic construct
  REGION 1..131: note = anti-HIV_Chain
QVHLQESGPRLVRSSETLSLTCSVPGGSIVNPITNYYWSWIRQSPRKGLQWIGDIYYTGTSSRNPSLDSRVSISMDVSRKQISLTLYSVTAADTAVHYCASQSLSWYRPSGYFESWGQGILVTVSSASTKG

SEQ ID NO: 4472 - protein, 131 aa, synthetic construct
  REGION 1..131: note = anti-HIV_LightChain
MKLPVRLLVLMFWIPASSSDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIK

SEQ ID NO: 4473 - protein, 132 aa, synthetic construct
  REGION 1..132: note = anti-HIV_Chain
QVQLQESGPGLVKPSETLSVTCSVSGDSMNNYYWTWIRQSPGKGLEWIGYISDRASATYNPSLNSRVVISRDTSKNQLSLKLNSVTPADTAVYYCATARRGQRIYGVVSFGEFFYYYSMDVWGKGTTVTVSS

SEQ ID NO: 4474 - protein, 132 aa, synthetic construct
  REGION 1..132: note = anti-HIV_Chain
QVQLQESGPGLVKPPETLSLTCSVSGASVNDAYWSWIRQSPGKRPEWVGYVHHSGDTNYNPSLKRRVTFSLDTAKNEVSLKLVALTAADSAVYFCARALHGKRIYGIVALGELFTYFYMDVWGKGTTVTVSS

SEQ ID NO: 4475 - protein, 132 aa, synthetic construct
  REGION 1..132: note = anti-HIV_Chain
QVQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSS

SEQ ID NO: 4476 - protein, 132 aa, synthetic construct
  REGION 1..132: note = anti-HIV_Chain
QVHLQESGPGLVKPSETLSLTCNVSGTLVRDNYWSWMRQPLGKQPEWIGYVHDSGDTNYNPSLKSRVHLSLDKSNNLVSLRLTAVTAADSATYYCATTKHGRRIYGIVAFNEWFTYFYMDVWGKGTTVTVSS

SEQ ID NO: 4477 - protein, 132 aa, synthetic construct
  REGION 1..132: note = anti-HIV_Chain
QVQLQESGPGLVKPSETLSVTCSVSGDSMNNYYWTWIRQSPGKGLEWIGYISDRESATYNPSLNSRVVISRDTSTNQLSLKLNSVTPADTAVYYCATARRGQRIYGVVSFGEFFYYYSMDVWGRGTTVTVSS

SEQ ID NO: 4478 - protein, 132 aa, synthetic construct
  REGION 1..132: note = anti-HIV_Chain
QVQLVESGPGLVTPSETLSLTCTVSNGSVSGRFWSWIRQSPGRGLEWIGYFSDTDRSEYSPSLRSRLTLSLDASRNQLSLKLKSVTAADSATYYCARAQQGKRIYGIVSFGEFFYYYYMDAWGKGTAVTVSS

SEQ ID NO: 4479 - protein, 132 aa, synthetic construct
  REGION 1..132: note = anti-HIV_Chain
QVQLQESGPGLVKPPETLSLTCSVSGASINDAYWSWIRQSPGKRPEWVGYVHHSGDTNYNPSLKRRVTFSLDTAKNEVSLKLVDLTAADSAVYFCARALHGKRIYGIVALGELFTYFYMDVWGKGTTVTVSS

SEQ ID NO: 4480 - protein, 132 aa, synthetic construct
  REGION 1..132: note = anti-HIV_Chain
QVQLQESGPGLVKPPETLSLTCSVSGASINDAYWSWIRQSPGKRPEWVGYVHHSGDTNYNPSLKRRVSFSLDTAKNEVSLKLVDLTAADSAIYFCARALHGKRIYGIVALGELFTYFYMDVWGKGTTVTVSS

SEQ ID NO: 4481 - protein, 132 aa, synthetic construct
  REGION 1..132: note = anti-HIV_Chain
QVQLQESGPGLVKPSETLSVTCSVSGDSMNNSYWTWIRQSPGKGLEWIGYISKSESANYNPSLNSRVVISRDTSKNQLSLKLNSVTPADTAVYYCATARHGQRIYGVVSFGEFFTYYSMDVWGKGTTVTVSS

SEQ ID NO: 4482 - protein, 132 aa, synthetic construct
  REGION 1..132: note = anti-HIV_Chain
QVQLQESGPGLVKPSETLSLTCSVSNGSVSGRFWSWIRQSPGRGLEWIGYFSDTEKSNYNPSLRSRLTLSVDASKNQLSLKLNSVTAADSATYYCARTQQGKRIYGVVSFGEFFHYYYMDAWGKGTAVTVSS

SEQ ID NO: 4483 - protein, 132 aa, synthetic construct
  REGION 1..132: note = anti-HIV_Chain
QVQLVQSGTALKSPGSSAKLSCTVLGDEFGTYFISWIRQAPGQGLEWVGGIVPHSQLQSSAQKFHGRIIISAGAGVTPPVVSLQLTNLTFEDTGTYFCARERGRHRDPKTGDALRGRYFDFWGRGTGVSVSA

SEQ ID NO: 4484 - protein, 132 aa, synthetic construct
  REGION 1..132: note = anti-HIV_Chain
QVQLVQSGTALKSPGSSAKLSCTVLGDEFGTYFISWIRQAPGQGLEWVGGIVPHSQLQSSAQKFHGRIIISAGAGVTPPVVSLQLTNLTFEDTGTYFCARERGRHRDPKTGKAPRGRYFDFWGRGTGVTVSA

SEQ ID NO: 4485 - protein, 132 aa, synthetic construct
  REGION 1..132: note = anti-HIV_Chain
QVQLVQSGTALKSPGSSAKLSCTVLGDEFGTYFISWIRQAPGQGLEWVGGIVPHSQLQSSAQKFHGRITISAGAGVTPPVVSLQLTNLTFEDTGTYFCARERGRHRDPKTGDALRGRYFDFWGRGTGVRVST

SEQ ID NO: 4486 - protein, 132 aa, synthetic construct
  REGION 1..132: note = anti-HIV_Chain
QVQLVQSGAAVKSPGSSAKLSCTVLGDEFGTYFISWIRQAPGQGLEWVGGIVPHSQLQSSAQRFHGRITISAGAGVTPPVVSLQLTNLTFDDAGTYFCARERGRHRDPKTGDALRGRYFDFWGRGTGISVSP

SEQ ID NO: 4487 - protein, 132 aa, synthetic construct
  REGION 1..132: note = anti-HIV_Chain
EVQLVQSGAEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 4488 - protein, 132 aa, synthetic construct
  REGION 1..132: note = anti-HIV_Chain
EVQLVESGGGLLQPGGSLRLSCAASGFSFNDFEMNWVRQAPGKGLEWVSYISNDGTMIHYADSVKGRFTISRDNAKKSLFLQMNSLRAEDTAVYYCARLAEVPPAIRGSYYYGMDVWGQGTTVTVASASTKG

SEQ ID NO: 4489 - protein, 132 aa, synthetic construct
  REGION 1..132: note = anti-HIV_Chain
QVQLMQSGAEVKRPGASVKVSCKAFRHSLNNLGISWIRRAPGRGLEWLGWINVYEGNTKYGRRFQGRVTMTTDRSTNTVSMELRSLTSDDTAVYYCARDNHFWSGSSRYYYFGMDVWGQGTTVIVSSASTKG

SEQ ID NO: 4490 - protein, 132 aa, synthetic construct
  REGION 1..132: note = anti-HIV_Chain
QVQLVQWGAGLLKPLETLSLTCAVYGGSFNGYFWSWIRQTPGKGLEWIGEINHGGSANFNPSLKSRVTMSVDTSKNQFSLKLASVTAADTAIYYCARGRITMVRGDPQRGGVRMDVWGQGTSVTVSSASTKG

SEQ ID NO: 4491 - protein, 132 aa, synthetic construct
  REGION 1..132: note = anti-HIV_Chain
LVQLVQSGAEVKKPGASVKVSCKVSGHTLSELSINWVRHVPGKGLEWMGGLDPEDGEAIHEPKFQGRLTMTEDTSTDTAYSTLSVWAPVAAAMYYCATADPFKVAQDEGLYVIFDYWGQGTLVTVSSASTKG

SEQ ID NO: 4492 - protein, 132 aa, synthetic construct
  REGION 1..132: note = anti-HIV_Chain
QVQLLQSGGEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 4493 - protein, 132 aa, synthetic construct
  REGION 1..132: note = anti-HIV_Chain
QVQLVQSGAEVKKPGASVKVSCKVSGYTLTELSIHWVRQAPGKGLEWMGGFDSEDGEAFYKQNFQGRVTMTEDTSTDTAYMELRRLRSEDTAVYYCATADRFKVAQDEGLFVIFDYWGQGTLVTVSSASTKG

SEQ ID NO: 4494 - protein, 132 aa, synthetic construct
  REGION 1..132: note = anti-HIV_Chain
QVHLVQSGAEVKKPGASVRVSCKASGYTFTTYGISWVRQAPGQGLEWMGWISAHSGDTNYAQKLQARVTMTTDTSTNTAYMELRSLTSDDTAVYYCARDRPRHYYDRGGYYSPFDYWGQGTLVTVSSASTKG

SEQ ID NO: 4495 - protein, 132 aa, synthetic construct
  REGION 1..132: note = anti-HIV_Chain
LVQLLQSGAEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 4496 - protein, 132 aa, synthetic construct
  REGION 1..132: note = anti-HIV_Chain
QVQLVQSGAEVKKPGASVKVSCKVSGHTLSELSINWVRHVPGKGLEWMGGLDPEDGEAIHEPKFQGRLTMTEDTSTDTAYVELSSLRSEDTAMYYCATADPFKVAQDEGLYVIFDYWGQGTLVTVSSASTKG

SEQ ID NO: 4497 - protein, 132 aa, synthetic construct
  REGION 1..132: note = anti-HIV_Chain
QVQLLQSGAEVKKPGASVKVSCKVSGYTLTELSINWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 4498 - protein, 132 aa, synthetic construct
  REGION 1..132: note = anti-HIV_Chain
QPQLVQSGSGAEVKKPGASVRISCEASEYNVFDHFMQWVRQAPGQGLEWMGWINPRGGYPSYSPTFQGRLTFTRQPSWDDSTITFHMELRGLGHDDTAVYYCARPHSPDDAWSLDVWGRGTLVTVSSASTKG

SEQ ID NO: 4499 - protein, 132 aa, synthetic construct
  REGION 1..132: note = anti-HIV_Chain
QPQLVQSGSGAEVKKPGASVRISCEASEYNVFDHFMQWVRQAPGQGLEWMGWINPRGGYPSYSPRFQGRLTFTRQPSWDDSSVTFHMELRGLRHDDTAVYYCARPHSPDDAWSLDVWGRGTLVTVSSASTKG

SEQ ID NO: 4500 - protein, 132 aa, synthetic construct
  REGION 1..132: note = anti-HIV_Chain
EVQLVESGGGVVEPGESLRLSCAASGFTFRSYDMFWVRQATGKSLEWVSAIGIAGDTYYSGSVKGRFTISRENARTSLYLQLSGLRVEDSAVYFCVRGSPPRIAATEYNYYYGLDVWGQGTTVSVFSASTKG

SEQ ID NO: 4501 - protein, 132 aa, synthetic construct
  REGION 1..132: note = anti-HIV_Chain
QVQLVQSGAEVKKPGSSVKVSCKASGGTFTTYDISWVRQAPGQGLEWMGGILPDFGAPSYAQKFQDRVTITTDESSSTAYMELNSLRSEDTAIYYCARGRGDDFWSGESPSWYFDYWGQGTLVTVSSASTKG

SEQ ID NO: 4502 - protein, 132 aa, synthetic construct
  REGION 1..132: note = anti-HIV_Chain
QPQLVQSGSGAEVKKPGASVRISCEASEYNVFDHFMQWVRQAPMEGLEWMGWINPRGGYPSYSPTFQGRLTFTRQPSWDDSTITFHMELRGLRHDDTAVYYCARPHSPDDAWSLDVWGRGTLVTVSSASTKG

SEQ ID NO: 4503 - protein, 132 aa, synthetic construct
  REGION 1..132: note = anti-HIV_Chain
EVRLLESGGGLVQPGGSLRLSCSASGFTFSNSALSWVRQAPGKGLEWVSSVVSSGGDTFYADSVKGRFTISRDNSRNTLYLQMKSLRAEDTALYYCAKVQIQQLNFGVITDAGMDVWGKGTTVIVSSASTKG

SEQ ID NO: 4504 - protein, 132 aa, synthetic construct
  REGION 1..132: note = anti-HIV_Chain
QVQLVESGGGVVQPGRSLRLSCVGSGFTFSSSGMHWVRQAPGKGLEWVAVISSDGSDEYYGDSVEGRFTISRDNSKNTLFLQLDSLEAEDSAVYYCAKTPPHYDALTGYPSSVLEFWGLGTLVTVSSASTKG

SEQ ID NO: 4505 - protein, 132 aa, synthetic construct
  REGION 1..132: note = anti-HIV_Chain
EVQLVQSGAEVKKPGSSVKVSCKASGGTFTTYDISWVRQAPGQGLEWIGGILPDFGAPSYAQKFQDRVTITTDESSRTAYMELNSLRSEDTAIYYCARGRGDDFWSGESPSWYFDYWGQGTQVTVSSASTKG

SEQ ID NO: 4506 - protein, 132 aa, synthetic construct
  REGION 1..132: note = anti-HIV_Chain
QVQLLQSGTEVKKPGSSVKVSCRASGWTLGNSPNSAIGWVRQAPGQGLEWIGRIIPILDVTNYAQKFQGRVTISADKSTNIAYMEISSLGSEDTAFYYCARVITGMTSPWYFYMDVWGEGTTVIVSSASTKG

SEQ ID NO: 4507 - protein, 132 aa, synthetic construct
  REGION 1..132: note = anti-HIV_Chain
QVHLVQSGAEVKKPGSSVRVSCKASGWTFGDSVNSAITWVRQAPGQGLEWMGRFIPILGLSNYAQKFQDRVTINVDRSTNTAYMELSGLRSEDTAVYYCARLITGMNAPWFYYMDVWGKGTTITVSSASTKG

SEQ ID NO: 4508 - protein, 132 aa, synthetic construct
  REGION 1..132: note = anti-HIV_Chain
QVHLVQSGAEAKRPGSSVRVSCRASGGDFSSYTLSWVRQAPGQGLERMGGVVPMLDTVHYAQKFQGRLTLSVDEGTSTAYMELSSLRSEDTAMYYCTRGRQTFRAIWSGPPVVFDIWGQGTLVSVSSASTKG

SEQ ID NO: 4509 - protein, 132 aa, synthetic construct
  REGION 1..132: note = anti-HIV_Chain
QVHLVQSGAEAKRPGSSVRVSCRASGGDFSSYTLSWVRQAPGQGIEWMGGVVPMLDTVHYAQKFQGRLTLSVDEGTSTAYMELSSLRSEDTAMYYCTRGRQTFRAIWSGPPAVFDIWGQGTLVIVSSASTKG

SEQ ID NO: 4510 - protein, 132 aa, synthetic construct
  REGION 1..132: note = anti-HIV_Chain
QVQLVQSGAELKKPGSSVKVSCKASGGTFNNHTFNWVRQAPGQGLEWMGRTIPILGSRDYAKTFQDRVTIIADKSTSTVYLELRRLKSEDTGVYYCATSMYYFDSGGYYRNTDLDKWGQGSLVTVSSASTKG

SEQ ID NO: 4511 - protein, 132 aa, synthetic construct
  REGION 1..132: note = anti-HIV_Chain
QVYLVQSGPELKKPGASVKISCKASGYNFPKYAIHWVRQAPGQGLQWMGWINGDNGDARYSQKLQGRVTPSTDTSASVVYMELKRLRSEDTAVYYCARALYPWEIGGVPSTMGDDYWGQGTLITVSSASTKG

SEQ ID NO: 4512 - protein, 132 aa, synthetic construct
  REGION 1..132: note = anti-HIV_Chain
QVQLVQSGPELMKPGSSVKVSCRASGDNFLTSTFNWLRQAPGQRLEWMGRFIPSLGLITSAPKFSDRLTITADQATLTAYMELTGLTSEDTALYYCARGLCRGGNCRLGPSGWLDPWGRGTQVTVSSASTKG

SEQ ID NO: 4513 - protein, 132 aa, synthetic construct
  REGION 1..132: note = anti-HIV_Chain
GVHFQGHLVQSGGGVKKPGSSVTISCLASEYTFTEFTIHWIRQAPGQGPLWLGLIKRSGRLMTSYRFQDRLSLRRDRSTGTVFMELRGLRIDDTAVYYCARDGLGEVAPAYLYGIDVWGQGSTVIVTSASTS

SEQ ID NO: 4514 - protein, 132 aa, synthetic construct
  REGION 1..132: note = anti-HIV_Chain
QVQLLQSGAEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 4515 - protein, 132 aa, synthetic construct
  REGION 1..132: note = anti-HIV_Chain
QVQLVQSGAEVKKPGASVKVSCKVSGYTLTELSIHWVRQAPGKGLEWMGGFDPEDGEASFEPKFQGRLTMTEDTSTDTAYMELSSLRSEDTAVYYCATADPFKVAQDEGLYVIFDYWGQGTLVTVSSASTKG

SEQ ID NO: 4516 - protein, 132 aa, synthetic construct
  REGION 1..132: note = anti-HIV_Chain
GVHFQGHLVQSGGGVKKPGSSVTISCLASEYTFTEFTIHWIRQAPGQGPLWLGLIKRSGRLMTSYRFQDRLSLRRDRSTGTVFMELRGLRIDDTAVYYCARDGLGEVAPAYLYGIDVWGQGTTVIVTSASTS

SEQ ID NO: 4517 - protein, 132 aa, synthetic construct
  REGION 1..132: note = anti-HIV_Chain
QVQLGESGGGLVEPGGSLRLSCAASGFLFSDYQMSWIRLAPGKGLEWISFISGFGSVYYADSVEGRFTISRDNARNSLYLQMNNLRAEDTAVYYCARAYGTGNWRGLYYYYYGMDVWGHGTTVTVSSASTKG

SEQ ID NO: 4518 - protein, 133 aa, synthetic construct
  REGION 1..133: note = anti-HIV_Chain
QVQLVQSGTALKSPGSSAKLSCTVLGDEFGTYFISWIRQAPGQGLEWVGGIVPHSQLQSSAQKFHGRIIISAGAGVTPPVVSLQLTNLTFEDTGTYFCARERGRHRDPKTGDALRGRYFDFWGRGTGLRVSTS

SEQ ID NO: 4519 - protein, 133 aa, synthetic construct
  REGION 1..133: note = anti-HIV_Chain
EVQLVQSGGGLVKPGGSLRLSCAASGFTFKNAWMSWVRQAPGKGLEWVGHIKSKTDGGTIDYAAPVKGRFTISRDDSKNTLYLQMNSLKIEDTAVYYCTTDIGSGRGWDFHYYDSNDWGQGTLVTVSSASTKG

SEQ ID NO: 4520 - protein, 133 aa, synthetic construct
  REGION 1..133: note = anti-HIV_Chain
QVQLVESGGGVVQPGRSLRLFCAASGFAFNTYGMHWVRQAPGKGLEWVAVTWHDGSQKYYADSVKGRFTISRDNSKNTLYLQMNSLRAEDTAIYYCASDQGGFDDSSGYFAPGGMDVWGRGTTVIVSSAPTKG

SEQ ID NO: 4521 - protein, 133 aa, synthetic construct
  REGION 1..133: note = anti-HIV_Chain
GYSEVQLVQSGPGLVKPSQTLSLTCTVSGGSISNGGHYWNWIRQHPGKGLEWIGHIYNIATTYYNPSLKSRVSISVDTSKNQFSLKLSSVTAADTAVYYCARGSGRWTIGARIYFDNWGQGALVAVSSASTKG

SEQ ID NO: 4522 - protein, 133 aa, synthetic construct
  REGION 1..133: note = anti-HIV_Chain
QLQLKESGPGMVKPSETLSLTCSVSGASVVSANDYWGWIRQAPGKGLECIGIILYTGSTFYNPSLQSRVTISRDPSKNHVSLTLTSVTAADSAVYYCARIPYHSESYYNVVIGGFDVWGQGTRVTVSSASTKG

SEQ ID NO: 4523 - protein, 133 aa, synthetic construct
  REGION 1..133: note = anti-HIV_Chain
CQVQLVESGGGVVQPGRSLRLSCVGSGFTFSSSGMHWVRQAPGKGLEWVAVISSDGSDEYYGDSVEGRFTISRDNSKNTLFLQLDSLEAEDSAVYYCAKTPPHYDALTGYPSSVLEFWGLGTLVTVSSASTKG

SEQ ID NO: 4524 - protein, 133 aa, synthetic construct
  REGION 1..133: note = anti-HIV_Chain
QVQLVQSGADVKKPGASVKVSCKVSGYTVSELSIHWVRQAPGKGLEWMGGFDPEDGKTVSAQNFQGRVTMTEDKSTGTANMELRSLRSEDTAVYYCATTVQLIVDFCNGGPCYNFDDWGQGTLVTVSSASTKG

SEQ ID NO: 4525 - protein, 133 aa, synthetic construct
  REGION 1..133: note = anti-HIV_Chain
GLDLEHDGHHKEEPRASVTVSCEASGYNFVNYIIHWVRLTPGRGFEWMGMIDPRRGRPWSAQKFQGRLTLTRDIDSERLYMQLSGLRGDDTAVYFCARQEPDFHDGHGHTLRGMFDSWGQGSPVSVSSASTKG

SEQ ID NO: 4526 - protein, 133 aa, synthetic construct
  REGION 1..133: note = anti-HIV_Chain
QVRLVQSGAQLKKPGASVTVSCEASGYNFVNYIINWVRQTPGRSFEWVGMIDPRRGRPWSAQKFQGRLTLTRDIDSEKLYMHLSGLRGDDTAVYYCARQDSDFHDGHGHTLRGMFDSWGQGSPVTVSSASTKG

SEQ ID NO: 4527 - protein, 133 aa, synthetic construct
  REGION 1..133: note = anti-HIV_Chain
QVRLSQSGAAVVKTGASVTISCETEGYTFVNYIIHWVRQPPGRGFEWLGMIDPRNGHPWFGQRFRGRLSLRRDRSTETVFMTLSGLTSDDNGIYFCARNEPQYYDGSGHSLPGMFDYWGQGTRVVVSSASTKG

SEQ ID NO: 4528 - protein, 133 aa, synthetic construct
  REGION 1..133: note = anti-HIV_Chain
QVRLSQSGAAVMKTGASVTISCETEGYNFVNYIIHWVRRPPGRGFEWLGMIDPKNGHPWFAQAVRGRLSLRRDTFNEVVYMTLSGLTSDDTGLYFCARNEPQYHDGNGHSLPGMFDFWGQGTLVTVSSASTKG

SEQ ID NO: 4529 - protein, 133 aa, synthetic construct
  REGION 1..133: note = anti-HIV_Chain
QVRLSQSGAAVVKTGASVTISCETEGYTFVNYIIHWVRQPPGRGFEWLGMIDPRNGHPWFGQRLQGRLSLRRDRSTETVFMTLSGLTSDDTGIYFCARNEPQYYDGSGHSLPGMFDYWGQGTRVVVSSASTKG

SEQ ID NO: 4530 - protein, 133 aa, synthetic construct
  REGION 1..133: note = anti-HIV_Chain
QVRLSQSGAAVVKTGASVTISCETEGYTFVNHIIHWVRQPPGRGFEWLGMIDPRNGHPWFGQRLRGRLSLRRDRSTETVFMTLSGLTSDDIGIYFCARNEPQYFDGSGHSLPGMFDYWGQGTRVVVSSASTKG

SEQ ID NO: 4531 - protein, 133 aa, synthetic construct
  REGION 1..133: note = anti-HIV_Chain
QVQFFQSGSSMKKSGASVTISCEATGYNIKNHILHWVRQKPGRGFEWVGMIDPINGRPWFGQAFRGRLTLTRDLSTETFYMSLSGLTSDDTATYFCARREADYHDGNGHTLPGMFDFWGPGTLVTVSSASTKG

SEQ ID NO: 4532 - protein, 133 aa, synthetic construct
  REGION 1..133: note = anti-HIV_Chain
QVRLSQSGAAVVKTGASVTISCETEGYTFVNYIIHWVRQSPGRGFEWLGMIDPRNGHPWFGQRLRGRLSLRRDRSTETVFMTLSGLTSDDTAIYFCARNEPQYYDGSGHSLPGMFDYWGQGTRVVVSSASTKG

SEQ ID NO: 4533 - protein, 133 aa, synthetic construct
  REGION 1..133: note = anti-HIV_Chain
QVRLSQSGAAMKKPGASVTISCETEGYTFINYIIHWVRQPPGRGFEWLGMIDPRNGRPWFGQSVQGRLSLRRDTYTEVVYMTLSGLTSDDAGLYFCARNEPQYHDGNGHSLPGMFDYWGQGTLVAVSSASTKG

SEQ ID NO: 4534 - protein, 133 aa, synthetic construct
  REGION 1..133: note = anti-HIV_Chain
QVRLVQSGAQLKKPGASVTVSCEASGYNFVNYIINWVRQTPGRGFEWVGMIDPRRGRPWSAQKFQGRLTLTRDIDSEKLYMHLSGLRGDDTAVYYCARQDSDFHDGHGHTLRGMFDSWGQGSPVTVSSASTKG

SEQ ID NO: 4535 - protein, 133 aa, synthetic construct
  REGION 1..133: note = anti-HIV_Chain
QVHTFQSGSSMKKSGASVTISCEATGYNIKNYILHWVRQKPGRGFEWVGMIDPINGRPWFGQPFRGRLTLTRDLSTETFYMSLSGLTSDDTATYFCARREADYHDGNGHTLPGMFDFWGPGTLITVSSASTKG

SEQ ID NO: 4536 - protein, 133 aa, synthetic construct
  REGION 1..133: note = anti-HIV_Chain
QVRLFQSGAAMKKPGASVTISCEASGYNFMNYFVHWVRQRPGRGFEWLGMINPRGGRPWSAQSVQGRLTLTRDISTEMFYMRLDGLRSDDTATYFCARNEADYHDGNGHSLRGMFDYWGQGSLITVSSASTKG

SEQ ID NO: 4537 - protein, 133 aa, synthetic construct
  REGION 1..133: note = anti-HIV_Chain
QVQLFQSGAAMRKPGASVTISCEASGYNFMNYFVHWVRQRPGRGFEWLGMINPRGGRPWSAQSVQGRLTLTRDTSTEMFYMRLDGLRSDDTATYFCARNEADYHDGNGHSLRGMFDYWGQGSLITVSSASTKG

SEQ ID NO: 4538 - protein, 133 aa, synthetic construct
  REGION 1..133: note = anti-HIV_Chain
QVRLSQSGAAIKKPGASVTISCETEGYTFINYIIHWVRQPPGRGFEWLGMIDPRNGRPWFGQSVQGRLSLRRDTYTEVVYMTLSGLTSDDTGLYFCARNEPQYHDGNGHSLPGMFDSWGQGTLVAVSSASTKG

SEQ ID NO: 4539 - protein, 133 aa, synthetic construct
  REGION 1..133: note = anti-HIV_Chain
QVRLFQSGAAMRKPGASVTISCEASGYNFLNYFVHWVRQRPGRGFEWLGMINPRGGRPWSAQSVQGRLTLTRDTSTEMFYMRLDGLRSDDTATYFCARNEADYHDGNGHSLRGMFDYWGQGSLITVSSASTKG

SEQ ID NO: 4540 - protein, 133 aa, synthetic construct
  REGION 1..133: note = anti-HIV_Chain
QVRLSQSGAAVKKPGASVTIVCETEGYNFIDYIIHWVRQPPGRGFEWLGMIDPRNGRPWSGQKVHGRLSLWRDTSTEKVYMTLTGLTSDDTGLYFCGRNEPQYHDDNGHSLPGMIDYWGQGTMVTVSSASTKG

SEQ ID NO: 4541 - protein, 133 aa, synthetic construct
  REGION 1..133: note = anti-HIV_Chain
QVRLSQSGAAIKKPGASVTISCETEGYTFINYIIHWVRQPPGRGFEWLGMIDPRNGRPWFGQSVQGRLSLRRDTYTEVVYMTLSGLTSDDAGHYFCARNEPQYHDGNGHSLPGMFDYWGQGTLVAVSSASTKG

SEQ ID NO: 4542 - protein, 133 aa, synthetic construct
  REGION 1..133: note = anti-HIV_Chain
QVRLFQSGAAMRKPGASVTISCEASGYNFMNYFVHWVRQRPGRGFEWLGMINPRGGRPWSAQSVQGRLTLTRDTSTEMFYMRLDGLRSDDTATYFCARNEADYHDGNGHSLRGMFDYWGQGSLITVSSASTKG

SEQ ID NO: 4543 - protein, 133 aa, synthetic construct
  REGION 1..133: note = anti-HIV_LightChain
MKLPVRLLVLMFWIPASSSDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKRK

SEQ ID NO: 4544 - protein, 134 aa, synthetic construct
  REGION 1..134: note = anti-HIV_Chain
QPYIVQSGPAVKGAGSSVTVTCKVDGDDDGIFSFGTYFMVWVRQAPGQGLQYMGGLVPSYAPTYAHKFEGRITISAAGTPPVVSLTLLNLTNDDAATYFCARERGRHYDSKTRENRRGRYFDMWGRGTRITVSP

SEQ ID NO: 4545 - protein, 134 aa, synthetic construct
  REGION 1..134: note = anti-HIV_Chain
QPYIVQSGPAVKGAGSSVTVTCRVDGDDDGIFNFGTYFMVWVRQAPGQGLQYMGGLVPSYAPTYAHKFEGRITISAAGTPPVVSLTLINLTNADAATYFCARERGRHYDSKTRENRRGRYFDMWGRGTRITVSP

SEQ ID NO: 4546 - protein, 134 aa, synthetic construct
  REGION 1..134: note = anti-HIV_Chain
RVHSQVQLVESGPGLVKPSQTLSLTCTVSGGSISNGGHYWNWIRQHPGKGLEWIGHIYNIATTYYNPSLKSRVSISVDTSKNQFSLKLSSVTAADTAVYYCARGSGRWTIGARIYFDNWGQGALVAVSSASTKG

SEQ ID NO: 4547 - protein, 134 aa, synthetic construct
  REGION 1..134: note = anti-HIV_Chain
SVDERLLEFGGRLVQPGGSLRLSCSASGFTFSNSAMSWVRQAPGKGLEWVSSILSSGVGTFYADSVKGRFTVSRDNSRNTLYLQMKSLRAEDTALYYCAKVQIQQLNFGVITDAGLDVWGKGTTLIVSSASTKG

SEQ ID NO: 4548 - protein, 134 aa, synthetic construct
  REGION 1..134: note = anti-HIV_Chain
VQSQVYLVQSGGEVKKPGSSVKVSCKASGDSFSSSVITWVRQAPGQGPEWMGRIIPVLGVAAYAQNFYGRVTISADTSSNTAYMELSSLRFEDTAVFYCARETGRGGNLALRQYFFDSWGQGTLVTVSSPSTKG

SEQ ID NO: 4549 - protein, 134 aa, synthetic construct
  REGION 1..134: note = anti-HIV_Chain
QLQLQESGPGLVKPSETLSLTCSVSDGSINSNSYYWAWIRQSPGKGLEWIGSVYYFGGTYYSPSLKSRVTMSVDRSKNQFSLNVSSVTAADTAIYYCARHVRPYDRSGYPERPNWFDPWGRGTLVTVSSASTKG

SEQ ID NO: 4550 - protein, 134 aa, synthetic construct
  REGION 1..134: note = anti-HIV_Chain
QVQLHQWGAGLLKPSDTLSLTCGILGVSPPGSLTGYYWTWIRQPPGKGLEWIGEVYHSGSTNYNPSLASRVTISMGTTKTQFSLRLTSVTAADSAVYYCASGKVWGITARPRDAGLDVWGQGTTVTVTSASTKG

SEQ ID NO: 4551 - protein, 134 aa, synthetic construct
  REGION 1..134: note = anti-HIV_Chain
QVQLVQSGAEVKKPGSSVKVSCRASGGSFGNYAINWVRQAPMQGLEWMGGIIPIFGTTNYAQNFRGRVTINADTFTNTVNMDLSSLRSEDTAVYYCGRSINAAVPGLEGVYYYYGMAVWGQGTTVTVSSASTKG

SEQ ID NO: 4552 - protein, 134 aa, synthetic construct
  REGION 1..134: note = anti-HIV_Chain
FVQLVESGGGLVQPGGSLRLSCAASGFNFNTYWMNWVRQAPGKGLEWVANMKEDGSEKYYVDSVKGRFTISRDNAKNSLYLQMNSLRAEDTAVYYCARNPESRCIVGRNRGWCRYFDLWGRGSLVTVSPASTKG

SEQ ID NO: 4553 - protein, 135 aa, synthetic construct
  REGION 1..135: note = anti-HIV_Chain
QLQLDQPGAAMKSLGSSLTITCRVSGDDLGSFHFGTYFMIWVRQGPGQGLEYMGGILPSTKTPTYAHKFRGRVSISAPGVPPVLSLALTNLTYDDTATYFCARERGRHFEPKNRDHLEGKFLDLWGRGTFVRVSP

SEQ ID NO: 4554 - protein, 135 aa, synthetic construct
  REGION 1..135: note = anti-HIV_Chain
QVQLVQPGTAMKSLGSSLTITCRVSGDDLGSFHFGTYFMIWVRQAPGQGLEYMGGILPSTKTPTYAHKFRGRVSISAPGVPPVLSLALTNLTYDDTATYFCARERGRHFEPKNRDNLEGKFFDLWGRGTFVRVSP

SEQ ID NO: 4555 - protein, 135 aa, synthetic construct
  REGION 1..135: note = anti-HIV_Chain
QVQLVQPGTAMKTLGSSLTISCRVSGDDGNFHFGTYFMAWVRQVPGQGLEYMGGILPSTKSPTYAHKFRGRVSISTAGVPPVVSLALTNLTYDDTATYFCARERGRHYDSKKQENYRGKFFDLWGRGTWVRVSPT

SEQ ID NO: 4556 - protein, 135 aa, synthetic construct
  REGION 1..135: note = anti-HIV_Chain
HLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDQWSGLHHDGVMAFSSWGQGTLISVSAASTKG

SEQ ID NO: 4557 - protein, 135 aa, synthetic construct
  REGION 1..135: note = anti-HIV_Chain
QVQLVQSGAEVKKPGSSVKVSCKASGGTFSTYAFSWVRQAPIEGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 4558 - protein, 135 aa, synthetic construct
  REGION 1..135: note = anti-HIV_Chain
QVQLVQSGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 4559 - protein, 135 aa, synthetic construct
  REGION 1..135: note = anti-HIV_Chain
EVQLVESGGGLVQPGGSLRLSCAASGFTFSSYSMNWVRQAPGKGLEWVSYISGSSYTIYYADSVRGRFTISRDNAKNSLYLQMNSLRDEDTAVYFCARATPPNPLNLYNYDSSGSSFDYWGQGTLVTVSSASTKG

SEQ ID NO: 4560 - protein, 135 aa, synthetic construct
  REGION 1..135: note = anti-HIV_Chain
EVQLVQSGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 4561 - protein, 135 aa, synthetic construct
  REGION 1..135: note = anti-HIV_Chain
EVQLVESGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 4562 - protein, 135 aa, synthetic construct
  REGION 1..135: note = anti-HIV_Chain
PLVQLEPSGVEVKKRGASVKVSCKVSGYSLTELSMHWVRQAPGKGLEWMGSFDPLDGDTIYAQKFQGRVTMTVDTSTDTAYMDLSSLRFEDTAVYYCATPSKAYYYDSPNYEGDFYMDVWGKGTTVIVSSASTKG

SEQ ID NO: 4563 - protein, 136 aa, synthetic construct
  REGION 1..136: note = anti-HIV_HeavyChain
QIHLVQSGTEVKKPGSSVTVSCKAYGVNTFGLYAVNWVRQAPGQSLEYIGQIWRWKSSASHHFRGRVLISAVDLTGSSPPISSLEIKLTSDDTAVYFCTTTSTYDKWSGLHHDGVMAFSSRGQGTLISVSAASTKG

SEQ ID NO: 4564 - protein, 136 aa, synthetic construct
  REGION 1..136: note = anti-HIV_HeavyChain
QIHLVQSGTEVKKPGSSVTVSCKAYGVNTFGLYAVNWVRQAPGQGLEYIGQIWRWKSSASHHFRGRVLISAVDLTGSSPPISSLEIKVTSDDTAVYFCTTTSTYDEWSDLHHDGVMAFSSWGQGTLISVSAASTKG

SEQ ID NO: 4565 - protein, 136 aa, synthetic construct
  REGION 1..136: note = anti-HIV_HeavyChain
QIHLVQSGTEVKKPGSSVTVSCKAYGVNTFGLYAVNWVRQAPGQSLEYIGQIWRWKSSASHHFRGRVLISAVDLTGSSPPISSLEIKLTSDDTAVYFCTTTSTYDRWSGLHHDGVMAFSSWGQGTLISVSAASTKG

SEQ ID NO: 4566 - protein, 136 aa, synthetic construct
  REGION 1..136: note = anti-HIV_Chain
CNPRVHSEVQLVESGAEVKKPGASVKVACKVSGKKLSDLSIHWVRQAPGKGLEWMGGFDEEDGKISYERKFQGRVSMTEDTARDTAFMEMSSLRSDDTAVYFCAAAPRLDLGELSSGFHFWGLGTLVTVSSASTKG

SEQ ID NO: 4567 - protein, 136 aa, synthetic construct
  REGION 1..136: note = anti-HIV_Chain
IWAPLIAVTFLVLHCESLGTCCCCQASGGTFNTFAINWVRQAPGQGLEWVGGIIPVFGTASYAQKFQGRVTVTTDESRGTAYMELNSLRSEDTAVYYCARGQTDLNDDLWSDYSTPGFDYWGQGTLVTVSSASTKG

SEQ ID NO: 4568 - protein, 136 aa, synthetic construct
  REGION 1..136: note = anti-HIV_Chain
LQPRVHSEVQLVESGAEVKKPGASVKVSCKVSGYTLSDLSMHWVRQAPGKGLEWMGGFDEEDGEITYAQKFQGRVSMTEDTSRDTAYMELSSLRSEDTAVYYCATAPRLELGELSSGFHYWGLGTLVTVSSASTKG

SEQ ID NO: 4569 - protein, 136 aa, synthetic construct
  REGION 1..136: note = anti-HIV_Chain
QSQVHLVQSGAEVKKPGSSVKVSCQASGGTFNTFAINWVRQAPGQGLEWVGGIIPVFGTASYAQKFQGRVTVTTDESRGTAYMELNSLRSEDTAVYYCARGQTDLNDDLWSDYSTPGFDYWGQGTLVTVSSASTKG

SEQ ID NO: 4570 - protein, 136 aa, synthetic construct
  REGION 1..136: note = anti-HIV_Chain
GSEVQLVESGAEVKKRGASVKVSCKVSGYSLTELSMHWVRQAPGKGLEWMGSFDPLDGDTIYAQKFQGRVTMTVDTSTDTAYMDLSSLRFEDTAVYYCATPSKAYYYDSPNYEGDFYMDVWGKGTTVIVSSASTKG

SEQ ID NO: 4571 - protein, 136 aa, synthetic construct
  REGION 1..136: note = anti-HIV_Chain
QVQLVQSGGEVKKPGASVKVSCKVSGYSLTELSMHWVRQAPGKGLEWMGVFDPLEGDGVYVQKFRGRVIMTEDTSTDTAYMELTSLRSEDTAIYYCATKAKDYYYESSDYSPYYYYYMDVWGKGTTVTVSSASTKG

SEQ ID NO: 4572 - protein, 136 aa, synthetic construct
  REGION 1..136: note = anti-HIV_Chain
EVQLVQSGAEVKKPGASVKVSCKVSGYTLTELSMHWVRQAPGKGLEWMGVFDPLEGDGVYAEKFRGRVIMTEDTSTDTGYMELTSLRSEDTAIYYCATKAKDYYYESSDYSPYYYYYMDVWGKGTTVTVSSASTKG

SEQ ID NO: 4573 - protein, 136 aa, synthetic construct
  REGION 1..136: note = anti-HIV_Chain
QVQLVQSGAEVKKPGASVKVSCKASGYTFTRYHIHWVRHAPGQGLEWMGKINPSRASTKYAKKFQDRVTMTRDTSTSTVYMELSSLRGDDTAVYYCGREMGTFTLLGVVIDHYDFYPMDVWGQGTPVTVSSASTKG

SEQ ID NO: 4574 - protein, 136 aa, synthetic construct
  REGION 1..136: note = anti-HIV_Chain
SRPPSCLLGCWCCSGFLLPAVILPNLHSPCLSLLESQPPSLADLVSAFAVMDIPIYIGTYRSQASLHSSSTKFPTDFLGSQTGSVAVGQGQISHLRSVEWRLRMWEFITALKVHMFLSRSDRGPRWKNVSSLLNSR

SEQ ID NO: 4575 - protein, 137 aa, synthetic construct
  REGION 1..137: note = anti-HIV_HeavyChain
QIHLVQSGTEVKKPGSSVTVSCKAYGVNTFGLYAVNWVRQAPGQSLEYIGQIWRWKSSASHHFRGRVIISAVDLTGSSPPISPLEIKNLTSDDTAVYFCTTTSTSDRWSGLHHDGVMAFSSWGQGTLISVSAASTKG

SEQ ID NO: 4576 - protein, 137 aa, synthetic construct
  REGION 1..137: note = anti-HIV_HeavyChain
QIHLVQSGTEVKKPGSSVTVSCKAYGVNTFGLYAVNWVRQAPGQSLEYIGQIWRWKSSASHHFRGRVIISAVDLTGSSPPISSLEIKNLTSDDTAVYFCTTASTYDKWSGLHHDGVMAFSSWGQGTLISVSAASTKG

SEQ ID NO: 4577 - protein, 137 aa, synthetic construct
  REGION 1..137: note = anti-HIV_HeavyChain
QIHLVQSGTEVKKPGSSVTVSCKAYGVNTFGLYAVNWVRQAPGQSLEYIGQIWRWKSSASHHFRGRVLISAVDLTGPSPPISSLEIKNLTSDDTAVYFCTTTSTYDKWSGLHHDGVMAFSSWGQGTLISVSAASTKG

SEQ ID NO: 4578 - protein, 137 aa, synthetic construct
  REGION 1..137: note = anti-HIV_HeavyChain
QIHLVQSGTEVKKPGSSVAVSCKAYGVNTFGLYAVNWVRQAPGQSLEYIGQIWRWKSSASHDFRGRVIISAVDLTGSSPPISSLEIKNLTSDDTAVYFCTATSTPDYWSGLHHDGVMAFSSWGQGTLISVSAASTKG

SEQ ID NO: 4579 - protein, 137 aa, synthetic construct
  REGION 1..137: note = anti-HIV_HeavyChain
QIHLVQSGTGVKKPGSSVTVSCKAYGVNTFGLYAVNWVRQAPGQGLEYIGQIWRWKSSASHHFRGRVLISAVDLTGSSPPITSLEIKNVTSDDTAVYFCTTTSTYDKWSGLYHDGVMAFSSWGQGTLISVSAASTKG

SEQ ID NO: 4580 - protein, 137 aa, synthetic construct
  REGION 1..137: note = anti-HIV_HeavyChain
QIHLVQSGTEVKKPGSSVTVSCKAYGVNTFGLYAVNWVRQAPGQSLEYIGQIWRWKSSASHHFRGRVIISAVDLTGSSPPISSLEIKNLTSDDTAVYFCTTTSTSDYWSGLHHDGVMAFSSWGQGTLISVSAASTKG

SEQ ID NO: 4581 - protein, 137 aa, synthetic construct
  REGION 1..137: note = anti-HIV_HeavyChain
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDRWSGLHHDGVMAFSSWGQGTLISVSAASTKG

SEQ ID NO: 4582 - protein, 137 aa, synthetic construct
  REGION 1..137: note = anti-HIV_HeavyChain
QIHLVQSGTEVRKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDKWSGLHHDGVMAFSSWGQGTLISVSAASTKG

SEQ ID NO: 4583 - protein, 137 aa, synthetic construct
  REGION 1..137: note = anti-HIV_HeavyChain
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDQWSGLHHDGVMAFSSWGQGTLISVSAASTKG

SEQ ID NO: 4584 - protein, 137 aa, synthetic construct
  REGION 1..137: note = anti-HIV_HeavyChain
QIHLVQSGTEVKKPGSSVTVSCKAYGVNTFGLYAVSWVRQAPGQRLEYIGQIRRWKSSASHHFRGRVTVSAVDPTGSSPPISSLEIRDLTTDDTAVYFCTTTSTSDYWSGLHNERGTAFSSWGQGTLISVSAASTKG

SEQ ID NO: 4585 - protein, 137 aa, synthetic construct
  REGION 1..137: note = anti-HIV_HeavyChain
QIHLVQSGTEVKKPGSSVTVSCKAYGVNTFGLYAVNWVRQAPGQGLEYIGQIWRWKSSASHHFRGRVLISAIDLTGSSPPISSLEIKNVTSDDTAVYFCTTMSTYDKWSGLHHDGVMAFSSWGQGTLISVSAASTKG

SEQ ID NO: 4586 - protein, 137 aa, synthetic construct
  REGION 1..137: note = anti-HIV_HeavyChain
QIHLVQSGTEVKKPGSSVTVSCKAYEVNTFGLYAVNWVRQAPGQSLEYIGQIWRWKSSASHHFRGRVLISAVDLTGSSPPISSLEIKNVTSDDTAVYFCTTTSTHDKWSGLHHDGVMAFSSWGQGTLISVSAASTKG

SEQ ID NO: 4587 - protein, 137 aa, synthetic construct
  REGION 1..137: note = anti-HIV_HeavyChain
QIHLVQSGTEVKKPGSSVTVSCKAYGVNTFGLYAVNWVRQAPGQGLEYIGQIWRWKSSASHHFRGRVLISAVDLTGSSPPISSLEIKNVTSDDTAVYFCTTTSTYDKWSGLHHDGVVAFSSWGQGTLISVSAASTKG

SEQ ID NO: 4588 - protein, 137 aa, synthetic construct
  REGION 1..137: note = anti-HIV_Chain
QVTLVQSGAEVKKPGASVRISCRASGFTFDDYSDYSFIPTTYLIHWFRQAPGQGLEWMAWINSVNGGRNIARQFQGRVTVARDRSNSIAFLEFSGLRHDDTAVYFCARDRRDDDRAWLLDPWGQGTRVTVSSASTKG

SEQ ID NO: 4589 - protein, 137 aa, synthetic construct
  REGION 1..137: note = anti-HIV_Chain
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDKWSGLHHDGVMAFSSWGQGTLISVSAASTKG

SEQ ID NO: 4590 - protein, 138 aa, synthetic construct
  REGION 1..138: note = anti-HIV_Chain
VVQLVQSGAEVRKPGSSLKVSCKSSGGTFSRFVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 4591 - protein, 138 aa, synthetic construct
  REGION 1..138: note = anti-HIV_Chain
QVQLVQSGAEVRKPGSSLKVSCKSSGGTFSRFVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 4592 - protein, 138 aa, synthetic construct
  REGION 1..138: note = anti-HIV_Chain
EVQLVESGAEVRKPGSSLKVSCKSSGGTFSRFVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 4593 - protein, 138 aa, synthetic construct
  REGION 1..138: note = anti-HIV_Chain
QVQLVESGAEVRKPGSSLKVSCKSSGGTFSRYVVNWVRQAPGQGLEWMGGIIPIFGIAKYAQKFQDRVTMTADEPKNTVYLDFNSLRSDDTAVYYCARDRGDTRLLDYGDYEDERYYYGMDVWGQGTTVIVSSASTKG

SEQ ID NO: 4594 - protein, 138 aa, synthetic construct
  REGION 1..138: note = anti-HIV_Chain
QVQLVQSGAEVRKPGSSLKVSCKSSGGTFSRYVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 4595 - protein, 138 aa, synthetic construct
  REGION 1..138: note = anti-HIV_Chain
QVQLVQSGAEVRKPGSSLKVSCKSSGGTFSRYVVNWVRQAPGQGLEWMGGIIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 4596 - protein, 138 aa, synthetic construct
  REGION 1..138: note = anti-HIV_Chain
QVQLVESGAEVRKPGSSLKVSCKSSGGTFSRYVVNWVRQAPGQGLEWMGGIIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 4597 - protein, 138 aa, synthetic construct
  REGION 1..138: note = anti-HIV_Chain
QVQLVQSGAEVRKPGSSLKVSCKSSGGTFSRYVVNWVRQAPGQGLEWMGGIIPIFGIAKYAQKFQDRVTMTADEPKNTVYLDFNSLRSDDTAVYYCARDRGDTRLLDYGDYEDERYYYGMDVWGQGTTVIVSSASTKG

SEQ ID NO: 4598 - protein, 138 aa, synthetic construct
  REGION 1..138: note = anti-HIV_Chain
VVQLVQSGAEVRKPGSSLKVSCKSSGGTFSRYVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 4599 - protein, 138 aa, synthetic construct
  REGION 1..138: note = anti-HIV_Chain
FICFSVVVRLLEFGGRLVQPGGSLRLSCSASGFTFSNSAMSWVRQAPGKGLEWVSSILSSGVGTFYADSVKGRFTVSRDNSRNTLYLQMKSLRAEDTALYYCAKVQIQQLNFGVITDAGLDVWGKGTTLIVSSASTKG

SEQ ID NO: 4600 - protein, 138 aa, synthetic construct
  REGION 1..138: note = anti-HIV_Chain
QVQLVQSGAEVRKPGSSLKVSCKSSGGTFSRYVVNWVRQAPGQGLEWMGGIIPIFGIAKYAQKFQDRVTMTADESKNTVYLDFSSLRSGDTAVYYCARDRGDTRLLDYGDYEDERYYYGMDVWGQGTTVTVSSASTKG

SEQ ID NO: 4601 - protein, 139 aa, synthetic construct
  REGION 1..139: note = anti-HIV_Chain
QVQLVESGAEVKKPGSSVKVSCKASGGTFNIFAFSWVRQAPGQGLEWMGGIIPIFASPNYAQRFQGRVTITADESTSTVHMELSSLRSEDTAIYYCAKDAHMHIEEPRDYDYIWGTSPYYFDYWGQGTLVTVSSASTKG

SEQ ID NO: 4602 - protein, 139 aa, synthetic construct
  REGION 1..139: note = anti-HIV_Chain
QVQLVESGAEVKKPGASVKVSCKASGYTFTSHDINWVRQATGQGLEWMGWMNPNSGDTGYAHKFQGRVTMTRNTPISTAYMELSSLRSEDTAVYYCARGRATSRNTPWAHYYDSSGYYGAGDYWGQGTLVTVSSASTKG

SEQ ID NO: 4603 - protein, 139 aa, synthetic construct
  REGION 1..139: note = anti-HIV_Chain
QVQIRQSGPGLVKPLETLSLSCIVFGGSFIAYHWTWIRQAPLKGLEWIGDIDQGGDITYSPSLKSRVTMSVDRSKSQFSLKLSSVTAADAAVYYCVRGPPNRYAVTSFTSGTHRERSSYYFDYWGPGTLVTVSSASTKG

SEQ ID NO: 4604 - protein, 141 aa, synthetic construct
  REGION 1..141: note = anti-HIV_Chain
NGGSLRLSCRVSGFGFHLYEMNWVRQAPGKGLEWISSISGSGESTHYSDSITGRFSMSRDEAKDSLYLQMNNLRVEDTAVYYCTRGFSMGDGTGFSFDTWGRGTMVTVSSGLDTVSLASTKGPSVFPLAPCSRSTSDARLS

SEQ ID NO: 4605 - protein, 141 aa, synthetic construct
  REGION 1..141: note = anti-HIV_Chain
QVQLVQSGAEVKKPGSSVKVSCKASGGTFSTYAISWVRQAPGQGLEWMGGIIPSFSMSNYAQDFQGRLTITADESTSSVYMELNSLRSEDTAVYYCARDFPRFHRLVGNYDFWRGTLDRFSYMDLWGRGTAVTVSSASTKG

SEQ ID NO: 4606 - protein, 141 aa, synthetic construct
  REGION 1..141: note = anti-HIV_Chain
LVQLVESGGGVVQPGRSLRLSCAASGFTFSTYAMHWVRQAPGKGLEWVAVISYDGSNKFYADSVKGRFTISRDNSKNTLYLQMNSLRAEDTAVYYCARPKFLPGADIVVVVAATPFDYWGQGNPGHRLLSFHQGPIGLPPG

SEQ ID NO: 4607 - protein, 141 aa, synthetic construct
  REGION 1..141: note = anti-HIV_HeavyChain
MEWSGVFIFLLSVTAGVHSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSS

SEQ ID NO: 4608 - protein, 141 aa, synthetic construct
  REGION 1..141: note = anti-HIV_HeavyChain
MEWSGVFIFLLSVTAGVHSQVQLVQSGPDVKKPGTSMKMSCKTSGYTFSNYWIGWVRQAPGQGLEWIGDIYPGGNYIRNNEKFKDKTTLTADTSTSTAYMQLGSLRSEDTAVYYCGSSFGSNYVFAWFTYWGQGTLVTVSS

SEQ ID NO: 4609 - protein, 143 aa, synthetic construct
  REGION 1..143: note = anti-HIV_Chain
QVFVQLVQSGGGLVQPGGSVRLSCTASGFLFSTYSMNWVRQAPGKGLEWVSSISTTSNYIYYADSVKGRFTISRSNGQGSLYLQLNSLRVEDTAVYYCARDTKVGAPRQDCYAMDLWGQRDHGHRLLSFHQGPIGLPPGALLQ

SEQ ID NO: 4610 - protein, 144 aa, synthetic construct
  REGION 1..144: note = anti-HIV_Chain
IILFLVATATGVHSDIQMTQSPSSLSASVGDRVTITCRASQSIDRYLNWYQHKPGKAPKLLIYAASNLHTDVPSRFSGSGAGTYFTLTITSLQPEDFATYYCQQSHSPSFGQESYSIAFGQGTRLEIKRTVAAPSVFIFPPSDE

SEQ ID NO: 4611 - protein, 144 aa, synthetic construct
  REGION 1..144: note = anti-HIV_Chain
LQQLQVPRLSMWRVFKVAAATGAQTLTVEEPGSSVKVSCKASGGSSTAYGYSWVRQAPGQGFEWMGRIIPFYGIITYAPKFQGRVTITADRSTSTVYMELTSLTFADTALFFCARDFGDPRNGYYFDSWDQGLWLTVSSASTKG

SEQ ID NO: 4612 - protein, 144 aa, synthetic construct
  REGION 1..144: note = anti-HIV_Chain
QVRLEQSGVAMRKPGASVTLSCQASGYNFVKYIIHWVRQKPGLGFEWVGMIDPYRGRPWSAHKFQGRLSLSRDTSMEILYMTLTSLKSDDTATYFCARAEAASDIHSRPIILTGPGEYGLDLEHMDWTWRILCLLAVAPGCHSQ

SEQ ID NO: 4613 - protein, 145 aa, synthetic construct
  REGION 1..145: note = anti-HIV_Chain
MFLFLVAGATGVQSQVYLVPFGPEVKKPGSSVKVSCKASGDSFTSSVITWVRQAPGQGPEWMGRVIPVLGVAAYAQKFYGRVTITADTSSNTAYMEVNSLRFEDTAVYYCARETGRGGNLALRQYFFDSWGQGTLVTVSSPSTKG

SEQ ID NO: 4614 - protein, 146 aa, synthetic construct
  REGION 1..146: note = anti-HIV_Chain
QVQLQESGPGLVKPSGTLSLTCAVSGASISSRNWWTWVRQPPGKGLEWIGEIYESGATNYNPSLKSRVTISVDKSKNQFSLRLTSVTAADTAVYFCARLMTFGGLIGTLDYWGQGTLVTVLQPPPRAHRYHPRNLLQEHLCARVMP

SEQ ID NO: 4615 - protein, 148 aa, synthetic construct
  REGION 1..148: note = anti-HIV_HeavyChain
MEWSGVFIFLLSVTAGVHSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSGESLKPL

SEQ ID NO: 4616 - protein, 148 aa, synthetic construct
  REGION 1..148: note = anti-HIV_HeavyChain
MEWSGVFIFLLSVTAGVHSQVQLVQSGPDVKKPGTSMKMSCKTSGYTFSNYWIGWVRQAPGQGLEWIGDIYPGGNYIRNNEKFKDKTTLTADTSTSTAYMQLGSLRSEDTAVYYCGSSFGSNYVFAWFTYWGQGTLVTVSSGESLKPL

SEQ ID NO: 4617 - protein, 149 aa, synthetic construct
  REGION 1..149: note = anti-HIV_Chain
QARLDQWGTGLLKPSETLSLKCAVFGVLFTDYNWTWVRQSPGKGLEWIGHLDHRGGGNYNPSLESRVTISLDYSKAQFSLHLKSVTVADTALYYCAGAVKGFWFDEVYNWFGPGVREPWLPSPQPPPRAHRSSPWHPPPRAPLVTATVP

SEQ ID NO: 4618 - protein, 149 aa, synthetic construct
  REGION 1..149: note = anti-HIV_Chain
QARLDQWGTGLLKPSETLSLKCAVFGVLFTDYNWTWVRQSPGKGLEWIGHLDHRGGGNYNPSLESRVTISLDYSKAQFSLHLKSVTVADTALYYCAGAVKGLWFDETYTWFGPWSQGTRVTVASASTKGPSVFPLAPSSKSTSGTRDLS

SEQ ID NO: 4619 - protein, 149 aa, synthetic construct
  REGION 1..149: note = anti-HIV_Chain
AARLDQWGTGLVKPSETLSLKCAVFGVDFPDYTWTWARQAPGKGLEWIGHRDHRGGSSYNPSLSGRATISLDTSKAQFSLHIKSVTVADTATYYCAGAVAGLWFEDAYNWFGPWSQGTLVTVAAASTKGPSVFPLAPSSKSTSGHASVL

SEQ ID NO: 4620 - protein, 150 aa, synthetic construct
  REGION 1..150: note = anti-HIV_Chain
LAQLEQSGGGVVKPGGSLRLPCAASGFTFIDYYMAWIRLAPGKGLEWLSYISKNGDYTKYSESLKGRFTISRDNAKNLVILQLNRLRADDTAIYFCARADGLTYFGELLQYIFDLWGQGARVIVSSASTKGPSVFPLAPSSKSTSGHASV

SEQ ID NO: 4621 - protein, 153 aa, synthetic construct
  REGION 1..153: note = anti-HIV_Chain
QVQLVQSGAEVKKPGASVKVSCKVSGYTLTELSIHWVRQAPGKGLEWMGGFDSEDGEAIYKQNFQGRVTMTEDTSTDTAYMELSRLRSEDTAVYYCATADRFKVAQDEGLFVIFDYWGQGNPGHRLLSLHQGPIGLPPGTLPPKATSGHAARR

SEQ ID NO: 4622 - protein, 154 aa, synthetic construct
  REGION 1..154: note = anti-HIV_Chain
LVQLVQSGAEVKKPGASVKVSCKVSGYSLTELSIHWVRQAPGKGLEWMGGFDSEDGEAIYKQNFQGRVTMTEDTSTDTAYMELSRLRSEDTAVYYCATADPFKVAQDEGLFVIFDYWGQGTTGHRLLSLHQGPHRLYSLGTLLSRAPIVQTHMA

SEQ ID NO: 4623 - protein, 157 aa, synthetic construct
  REGION 1..157: note = anti-HIV_Chain
QIHLVQSGTDVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDQWSGLHHDGVMAFSSRGQGTLISVSAASTKGPSVFPLAPSSKSTYGLAHVL

SEQ ID NO: 4624 - protein, 159 aa, synthetic construct [sequence omitted]

SEQ ID NO: 4625 - protein, 214 aa, synthetic construct
  REGION 1..214: note = anti-HIV_LightChain
DIVITQSTKFMSTSVGDRVSITCKASQDVSTAVAWYQQKPGQSPKLLIYWASTRHTGVPDRFTGSGSGTDYTLTISRVQAEDLALYYCQQHYTTPWTFGGGTKLEIKRTVAAPSFVIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4626 - protein, 217 aa, synthetic construct
  REGION 1..217: note = anti-HIV_Chain
QSVLTQPPSVSAAPGQKVTISCSGSSSNIGNNYVLWYQQFPGTAPKLLIYGNNKRPSGIPDRFSGSKSGTSATLGITGLQTGDEADYFCATWDSGLSADWVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4627 - protein, 219 aa, synthetic construct
  REGION 1..219: note = anti-HIV_Chain
DIVMTQSPDSLAVSLGERVTMNCKSSQSLLYSTNQKNYLAWYQQKPGQSPKLLIYWANSTESGVPDRFSGSGSGTDFTLTISSVQAEDVAVYYCQQYYSYRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4628 - protein, 251 aa, synthetic construct
  REGION 1..251: note = anti-HIV_SingleChain
MQVQLEQSGAEVKKPGASVKVSCQASGYRFSNFTVHWVRQAPGQRFEWMGWINPYNGNKEFSAKFQDRVTFTADTSANTAYMELRSLRSADTAVYYCARVGEWGWDDSPQDNYYMDVWGKGTTVIVSSGGGGSGGGGSGGGGSDIELTQSPGTLSLSPGERATFSCRSSHSIRSRRVAWYQHKPGQAPRLVIHGVSNRASGISDRFSGSGSGTDFTLTITRVEPEDFALYYCQVYGASSYTFGQGTKLERK

SEQ ID NO: 4629 - protein, 446 aa, synthetic construct
  REGION 1..446: note = anti-HIV_LightChain
EVKLEESGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4630 - protein, 460 aa, synthetic construct
  REGION 1..460: note = anti-HIV_Chain
EVQLVESGGGLVKPGGSLRLTCVASGFTFSDVWLNWVRQAPGKGLEWVGRIKSRTDGGTTDYAASVKGRFTISRDDSKNTLYLQMNSLKTEDTAVYSCTTDGFIMIRGVSEDYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4631 - protein, 471 aa, synthetic construct
  REGION 1..471: note = anti-HIV_Chain
MEWSGVFMFLLSVTAGVHSQVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4632 - protein, 215 aa, synthetic construct
  REGION 1..215: note = anti-influenza_Fab
IVLTQSPATLSVSPGERATLSCRASQVISHNLAWYQQKPGQAPRLLIYGASTRASGIPARFSGSGSGTDYTLTITSLQPEDFAVYYCQHYSNWPPRLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4633 - protein, 227 aa, synthetic construct
  REGION 1..227: note = anti-influenza_Fab
VQLVESGGGVVQPGKSPRLSCAASGPTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4634 - protein, 505 aa, synthetic construct
  REGION 1..505: note = anti-influenza_Fab
AGSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVSPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGSGRLVPR

SEQ ID NO: 4635 - protein, 219 aa, synthetic construct
  REGION 1..219: note = anti-influenza_Fab
QVQLVQSGGGVVQPGRSLRLSCAASEFTFRMYATHWVRQAPGKGLEWVALISYDGSNKYYADSVKGRFTISRDNSMNTVYLQMNTLRPEDTAVYYCARDLGGYFIRGIMDVWGQGTLVTVSSASTKGPSVFPLAPSSGGTAALGCLVKDYFPEPVTVSWNSGALTSGVHTFPAVLQSSGLYSLSSVVTVPSSSLGTQTYICNVNHKPSNTKVDKRVEPK

SEQ ID NO: 4636 - protein, 214 aa, synthetic construct
  REGION 1..214: note = anti-influenza_Fab
ELQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4637 - protein, 331 aa, synthetic construct
  REGION 1..331: note = anti-influenza_Fab
ADPGDTICIGYHANNSTDTVDTVLEKNVTVTHSVNLLEDSHNGKLCKLKGIAPLQLGKCNIAGWLLGNPECDLLLTASSWSYIVETSNSENGTCYPGDFIDYEELREQLSSVSSFEKFEIFPKTSSWPNHETTKGVTAACSYAGASSFYRNLLWLTKKGSSYPKLSKSYVNNKGKEVLVLWGVHHPPTGTDQQSLYQNADAYVSVGSSKYNRRFTPEIAARPKVRDQAGRMNYYWTLLEPGDTITFEATGNLIAPWYAFALNRGSGSGIITSDAPVHDCNTKCQTPHGAINSSLPFQNIHPVTIGECPKYVRSTKLRMATGLRNIPSIQSR

SEQ ID NO: 4638 - protein, 179 aa, synthetic construct
  REGION 1..179: note = anti-influenza_Fab
GLFGAIAGFIEGGWTGMIDGWYGYHHQNEQGSGYAADQKSTQNAIDGITNKVNSVIEKMNTQFTAVGKEFNNLERRIENLNKKVDDGFLDIWTYNAELLVLLENERTLDFHDSNVRNLYEKVKSQLKNNAKEIGNGCFEFYHKCDDACMESVRNGTYDYPKYSEESKLNREEIDGVSGR

SEQ ID NO: 4639 - protein, 214 aa, synthetic construct
  REGION 1..214: note = anti-influenza_Apo
QSVLTQPPSVSVAPGQTARITCGGNDIGRKSVHWNQQKPGQAPVLVVCYDSDRPSGIPERFSGSNSGNTATLTISRVEAGDEADYYCQVWDSSSDHVIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4640 - protein, 229 aa, synthetic construct
  REGION 1..229: note = anti-influenza_Apo
EVQLVQSGAEVKKPGASVKVSCKASGYTFTDYHINWVRQAPGQGLEWMGWIHPNSGDTNYAQKFQGWVTMTRDTAISTAYMEVNGLKSDDTAVYYCARGGLEPRSVDYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4641 - protein, 111 aa, synthetic construct
  REGION 1..111: note = anti-influenza-A_kappa_LightChain_V-Region
DIVMTQSPDSLAVSLGARATINCKSSQSVTFNYKNYLAWYQQKPGQPPKVLIYWASARESGVPDRFSGSGSGTDFTLTISSLQAEDVAVYYCQQHYRTPPTFGQGTKVEIK

SEQ ID NO: 4642 - protein, 111 aa, synthetic construct
  REGION 1..111: note = anti-influenza-A_kappa_LightChain_V-Region
DIVMTQSPDSLAVSLGERATINCKSSQSVSSNNKNYLAWYQQKPGQPPKVLIYWASARESGVPDRFSGSGSGTDFTLTISSLQAEDVAVYYCQQHYRTPPTFGQGTKVEIK

SEQ ID NO: 4643 - protein, 111 aa, synthetic construct
  REGION 1..111: note = anti-influenza-A_kappa_LightChain_V-Region
DIVMTQSPDSLAVSLGERATINCRSSQSVSSNNKNFLAWYQEKPGQPPKVLIYWASARESGVPDRFSGSGSGTDFTLTISGLQAEDVAVYYCQQHYRTPPTFGQGTKVEIK

SEQ ID NO: 4644 - protein, 111 aa, synthetic construct
  REGION 1..111: note = anti-influenza-A_kappa_LightChain_V-Region
DIVMTQSPDSLAVSLGERATINCKSSQSVTFNYKNYLAWYQQKPGQPPKLLIYWASTRESGVPDRFSGSGSGTDFTLTISSLQAEDVAVYYCQQHYRTPPTFGQGTKVEIK

SEQ ID NO: 4645 - protein, 113 aa, synthetic construct
  REGION 1..113: note = anti-influenza-A_kappa_LightChain_V-Region
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIK

SEQ ID NO: 4646 - protein, 111 aa, synthetic construct
  REGION 1..111: note = anti-influenza-A_kappa_LightChain_V-Region
DIQMTQSPDSLAVSLGARATINCKSSQSVTFNYKNYLAWYQQKPGQPPKVLIYWASARESGVPDRFSGSGSGTDFTLTISSLQAEDVAVYYCQQHYRTPPTFGQGTKVEIK

SEQ ID NO: 4647 - protein, 129 aa, synthetic construct
  REGION 1..129: note = anti-influenza-A_HeavyChain_V-Region
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDSQLRSLLYFDWLSQGYFDYWGQGTLVTVSS

SEQ ID NO: 4648 - protein, 129 aa, synthetic construct
  REGION 1..129: note = anti-influenza-A_HeavyChain_V-Region
QVQLVQSGGGVVQPGRSLRLSCVASGFTFSTYAMHWVRQAPGRGLEWVAVISYDGNYKYYADSVKGRFSISRDNSNNTLHLEMNTLRTEDTALYYCAKDSQLRSLLYFEWLSQGYFDPWGQGTLVTVSS

SEQ ID NO: 4649 - protein, 129 aa, synthetic construct
  REGION 1..129: note = anti-influenza-A_HeavyChain_V-Region
QVQLVQSGGGVVQPGRSLRLSCAASGFTFSTYGMHWVRQAPGKGLEWVAVISYDGNYKYYADSVKGRFTISRDNSKNTLYLEMNSLRTEDTALYYCAKDSQLRSLLYFDWLSQGYFDHWGQGTLVTVSS

SEQ ID NO: 4650 - protein, 129 aa, synthetic construct
  REGION 1..129: note = anti-influenza-A_HeavyChain_V-Region
QVQLVQSGGGVVPPGRSLRLSCAASGFTFSTYGMHWVRQAPGKGLEWVAVISYDGNYKYYADSVRGRFTISRDNSKNTLNLDMNSLRTEDTALYYCAKDSQLRSLLYFDWLSQGYFDHWGQGTLVTVSS

SEQ ID NO: 4651 - protein, 129 aa, synthetic construct
  REGION 1..129: note = anti-influenza-A_HeavyChain_V-Region
QVQLVESGGGVVQPGRSLRLSCAASGFTFSTYAMHWVRQAPGKGLEWVAVISYDANYKYYADSVKGRFTISRDNSKNTLYLQMNSLRAEDTAVYYCAKDSQLRSLLYFEWLSQGYFDYWGQGTLVTVSS

SEQ ID NO: 4652 - protein, 129 aa, synthetic construct
  REGION 1..129: note = anti-influenza-A_HeavyChain_V-Region
QVQLVESGGGVVQPGRSLRLSCAASGFTFSTYAMHWVRQAPGKGLEWVAVISYDGNYKYYADSVKGRFTISRDNSKNTLYLQMNSLRAEDTAVYYCAKDSQLRSLLYFEWLSQGYFDPWGQGTLVTVSS

SEQ ID NO: 4653 - protein, 129 aa, synthetic construct
  REGION 1..129: note = anti-influenza-A_HeavyChain_V-Region
QVQLVQSGGGVVQPGRSLRLSCVASGFTFSTYAMHWVRQAPGRGLEWVAVISYDGNYKYYADSVKGRFSISRDNSNNTLHLEMNTLRTEDTALYYCAKDSQLRSLLYFEWLSQGYFDPWGQGTLVTVTS

SEQ ID NO: 4654 - protein, 110 aa, synthetic construct
  REGION 1..110: note = anti-influenza-A_LightChain_V-Region
NFMLTQPPSASGTPGQRVTISCSGSSSNIGGNTVHWFQQLPGTAPKLLIYTNSLRPSGVPDRFSGSKSGTSASLAISGLQSEDEADYYCAAWDDSLNGQVFGGGTKLTVL

SEQ ID NO: 4655 - protein, 130 aa, synthetic construct
  REGION 1..130: note = anti-influenza-A_HeavyChain_V-Region
QVQLLESGGGVVQPGRSLRLSCAASGFTFSNYGMHWVRQAPGKGLEWVAIISFDGSKKYYANSVKGRSTISRDNSKNTLSLQMNSLGPEDTALYYCAKLPSPYYFDSRFVWVAASAFHFWGQGILVTVSS

SEQ ID NO: 4656 - protein, 44 aa, synthetic construct
  REGION 1..44: note = anti-influenza_Chain
NVPEWSYIVEKANPANDLCYPGNFNDYEELKHLLSRINHFEKIQ

SEQ ID NO: 4657 - protein, 54 aa, synthetic construct
  REGION 1..54: note = anti-influenza_Chain
SGRLVPRGSPGSGYIPEAPRDGQAYVRKDGEWVLLSTFLGKPIPNPLLGLDSTG

SEQ ID NO: 4658 - protein, 97 aa, synthetic construct
  REGION 1..97: note = anti-influenza_Chain
MSLLTEVETPIRNEWGCRCNGSSDPLAIAANIIGILHLILWILDRLFFKCIYRRFKYGLKGGPSTEGVPKSMREEYRKEQQSAVDADDGHFVSIELE

SEQ ID NO: 4659 - protein, 100 aa, synthetic construct
  REGION 1..100: note = anti-influenza_Chain
MNNATFNCTNINPITHIRGSIIITICVSLIVILIVFGCIAKIFINKNNCTNNVIRVHKRIKCPDCEPFCNKRDDISTPRAGVDIPSFILPGLNLSEGTPN

SEQ ID NO: 4660 - protein, 100 aa, synthetic construct
  REGION 1..100: note = anti-influenza_Chain
ELTQSPSSLSASVGDSVTITCRTSERISTYLNWYQQKPGKAPRLLVSGASTLQGGVPSRFSGSGSGTAFTLTINSLQPEDFATYYCQQSYSTPLTFGGGT

SEQ ID NO: 4661 - protein, 100 aa, synthetic construct
  REGION 1..100: note = anti-influenza_Chain
MTQSPSSMSVSLGDTVSITCHASQDISGHIGWLQQKPGKSFKGLIYHGTNLEDGVPSRFSGSGSGADFSLTISSLESEDFADYYCVQYVQFPWTFGGGTK

SEQ ID NO: 4662 - protein, 102 aa, synthetic construct
  REGION 1..102: note = anti-influenza_Chain
DIQVTQSPSSLSASVGDRVTISCRAQSLSSYLHWYQQKPGQPPKLLIYAATTLQSGVPSRFSGSGSGTDFTLTISTFQAEDVATYYCQQSRTFGQGTKVEIK

SEQ ID NO: 4663 - protein, 102 aa, synthetic construct
  REGION 1..102: note = anti-influenza_Chain
DIQMTQSPSSLSASVGDRVTISCRAQSLSSYLHWYQQKPGQPPKLLIYAATTLQSGVPSRFSGSGSGTDFTLTISTFQAEDVATYYCQQSRTFGQGTKVEIK

SEQ ID NO: 4664 - protein, 103 aa, synthetic construct
  REGION 1..103: note = anti-influenza_Chain
DIQITQSPSSLSASVGDRVTITCRTSQSLSSYLHWYQQKPGKAPKLLIYAASSLQSGVPSRFSGSGSGTDFTLTISSLQPEDFATYYCQQSRTFGQGTKVEIK

SEQ ID NO: 4665 - protein, 103 aa, synthetic construct
  REGION 1..103: note = anti-influenza_Chain
DIQMTQSPSSLSASVGDRVTITCRTSQSLSSYLHWYQQKPGKAPKLLIYAASSLQSGVPSRFSGSGSGTDFTLTISSLQPEDFATYYCQQSRTFGQGTKVEIK

SEQ ID NO: 4666 - protein, 103 aa, synthetic construct
  REGION 1..103: note = anti-influenza_Chain
DIQVTQSPSSLSASVGDRVTISCRASQRLNSYLHWYQQTPGQAPKLLIYATSTLQSGVSPRFSGSGSGTDFTLTISSLQPEDVATYYCQLSRTFGHGTKVEIK

SEQ ID NO: 4667 - protein, 103 aa, synthetic construct
  REGION 1..103: note = anti-influenza_Chain
DIQMTQSPSSLSASVGDRVTISCRASQRLNSYLHWYQQTPGQAPKLLIYATSTLQSGVSPRFSGSGSGTDFTLTISSLQPEDVATYYCQLSRTFGHGTKVEIK

SEQ ID NO: 4668 - protein, 103 aa, synthetic construct
  REGION 1..103: note = anti-influenza_Chain
DIQVTQSPSSLSASVGDRITISCRTSQSLRSYLHWYQQKPGKAPKLLIYASSTLQSGVPSRFSGSGSGTDFTLTISNLQPEDFATYYCQLSRTFGQGTKVEIK

SEQ ID NO: 4669 - protein, 103 aa, synthetic construct
  REGION 1..103: note = anti-influenza_Chain
DIQMTQSPSSLSASVGDRITISCRTSQSLRSYLHWYQQKPGKAPKLLIYASSTLQSGVPSRFSGSGSGTDFTLTISNLQPEDFATYYCQLSRTFGQGTKVEIK

SEQ ID NO: 4670 - protein, 103 aa, synthetic construct
  REGION 1..103: note = anti-influenza_Chain
DIQMTQSPSSLSASVGDRVTITCRTSQSLSSYTHWYQQKPGKAPKLLIYAASSRLSGVPSRFSGSGSGTDFTLTISSLQPEDFATYYCQQSRTFGQGTKVEIK

SEQ ID NO: 4671 - protein, 103 aa, synthetic construct
  REGION 1..103: note = anti-influenza_Chain
DIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIK

SEQ ID NO: 4672 - protein, 103 aa, synthetic construct
  REGION 1..103: note = anti-influenza_Chain
DIQMTQSPSSLSASVGDRVTITCRTSQSLSSYDHWYQQKPGKAPKLLIYAASSRLSGVPSRFSGSGSGTDFTLTISSLQPEDFATYYCQQSRTFGQGTKVEIK

SEQ ID NO: 4673 - protein, 106 aa, synthetic construct
  REGION 1..106: note = anti-influenza_Chain
EIVMTQSPDTLSVSPGERATLSCRASQSVNRRLAWYQQKPGQAPRLLIHDASTRATGIPARFSGSGSGTEFTLTISSLQSEDFAVYYCQQYDNWLSFGQGTRLEIK

SEQ ID NO: 4674 - protein, 106 aa, synthetic construct
  REGION 1..106: note = anti-influenza_Chain
DIQLTQSPSSLSASVGDRVTITCRASQGILNCLAWYQQKPGKVPNLLMYAASTLQSGVPSRFSGSGFGTDFTLTISSLQPEDVATYYCQTYGGVSTFGGGTKVEIR

SEQ ID NO: 4675 - protein, 106 aa, synthetic construct
  REGION 1..106: note = anti-influenza_Chain
SYVLTQPPSVSVAPGQTARISCGGSNIGGKSVHWYQQKPGQAPVLVVYDDSGRPSGIPERFSGSNSGDTATLTISRVEAGDEADYFCQVWDNFGGVFGTGTKVTVL

SEQ ID NO: 4676 - protein, 106 aa, synthetic construct
  REGION 1..106: note = anti-influenza_Chain
DIQMTQSPSSLSASVGDRVTITCRTSQSISSYLNWYQQKPGKAPKLLIYAASSLQSGVPSRFSGSGSGTDFTLTISGLQPEDFATYYCQQSYSMPAFGQGTKLEIK

SEQ ID NO: 4677 - protein, 106 aa, synthetic construct
  REGION 1..106: note = anti-influenza_Chain
DIQMTQSPLSVSVSVGDRVTIACRASQSIDKFLNWYQQKPGKAPKLLIYGASNLHSGAPSRFSASGSGTDFTLTITNIQTEDFATYLCQQSFSVPAFGGGTKVEIK

SEQ ID NO: 4678 - protein, 106 aa, synthetic construct
  REGION 1..106: note = anti-influenza_Chain
DIQMTQSPSSLSASVGDRVTITCRASQSISTYLNWYQKRPGKAPKLLVYGASTLQSGVPSRFSGSGSGTDFTLTIASLQPEDSATYYCQQTYSIPLFGQGTRLEIK

SEQ ID NO: 4679 - protein, 106 aa, synthetic construct
  REGION 1..106: note = anti-influenza_Chain
DIQMTQSPSSLSASVGDRVTITCRASQSISTYLNWYQKRPGKAPKLLVYGASSLQSGVPSRFSGSGSGTDFTLTIASLQPEDSAVYYCQQTYSIPLFGQGTRLEIK

SEQ ID NO: 4680 - protein, 106 aa, synthetic construct
  REGION 1..106: note = anti-influenza_Chain
DIQMTQSPSSLSASVGDRVTITCRASQSISRYLNWYQQKPGKAPKLLIYGASTLQNGAPSRFSGSGSGTDFTLTISSLQPEDSATYLCQQSYSVPAFGGGTKVEVK

SEQ ID NO: 4681 - protein, 106 aa, synthetic construct
  REGION 1..106: note = anti-influenza_Chain
GIQMTQSPSSLSASVGDRVTITCRASQSISRYLNWYLQKPGKAPKLLISGASSLQSGVPSRFSGTGSGTEFTLTISSLQPEDFATYYCQQTFSIPLFGQGTKVEIK

SEQ ID NO: 4682 - protein, 107 aa, synthetic construct
  REGION 1..107: note = anti-influenza_Chain
DIQMTQSPSSLSASVGDRVSITCQASQDISRYLNWYQQKPGEAPKLLIYDASNLETGVPSRFSGSGSGTDFTFTISSLQPEDIATYFCQQYGYLPLTFGPGTKVDSK

SEQ ID NO: 4683 - protein, 107 aa, synthetic construct
  REGION 1..107: note = anti-influenza_Chain
DIQMTQSPSSFSVSLGDRVTITCKASEDIYNRLAWYQQKPGNAPRLLISDTTNLWIGVPSRFSGSGSGKDYTLSITSLQSEDVATYYCQQYWSSRTFGGGTKLEIKR

SEQ ID NO: 4684 - protein, 107 aa, synthetic construct
  REGION 1..107: note = anti-influenza_Chain
DIQMTQSPSSFSVSLGDRVTITCKASEDIYNRVAWYQQKPGNAPRLLMSDATSLGAGVPSRFSGSGSGKDHTLSITSLQTEDVATYYCQQYWNTRTFGGGTKLEIKR

SEQ ID NO: 4685 - protein, 107 aa, synthetic construct
  REGION 1..107: note = anti-influenza_Chain
DIQMTQSPSSLSASVGDRVTITCRASQSISTYLNWYQQKPGIPPKLLINVASSLQSGVPSRFSGSGSGTDFTLTISSLQPEDFASYYCQQTYSSPPTFGQGTKVEIK

SEQ ID NO: 4686 - protein, 107 aa, synthetic construct
  REGION 1..107: note = anti-influenza_Chain
DIQMTQSPSTLSGSVGDRVTITCRASQNIGPWLAWYQQESGKAPKLLISRASILESGVPSRFSGTGTGTEFTLTISSLQPDDFATYYCQHYNAYWGTFGQGTKVEIN

SEQ ID NO: 4687 - protein, 107 aa, synthetic construct
  REGION 1..107: note = anti-influenza_Chain
VIWMTQSPSLLSASTGDRVTISCRMSQGISSYLAWYQQKPGKAPELLIHTAYTLKSGVPSRFSGSGSGKDFTLTISGLQSEDFATYYCQQYYSFPYTFGQGTKVEIK

SEQ ID NO: 4688 - protein, 107 aa, synthetic construct
  REGION 1..107: note = anti-influenza_Chain
DIQMTQSPSSVSASVGDRVTITCRASQDVSTWLAWYQLKPGKAPKLLIYAASSLQSGVPSRFSGSGSGTDFTLTVSSLQPEDFATYYCQQANSFPFTFGPGTKVDIK

SEQ ID NO: 4689 - protein, 107 aa, synthetic construct
  REGION 1..107: note = anti-influenza_Chain
DIQLTQSPSFLSASVGDGVTITCRASQDIYIYLAWYQQKPGKAPKLLIYAASTLQGGVPSRFSGSGSGTEFTLTINNLQPEDFATYFCQQLNGYPLTFGGGTKVEIK

SEQ ID NO: 4690 - protein, 107 aa, synthetic construct
  REGION 1..107: note = anti-influenza_Chain
DIQLTQSPSSLSASVGDRVTLTCQASQDIRKFLNWYQQKPGKGPKLLIYDASNLQRGVPSRFSGGGSGTDFTLIISSLQPEDVGTYYCQQYDGLPFTFGGGTKLEIK

SEQ ID NO: 4691 - protein, 107 aa, synthetic construct
  REGION 1..107: note = anti-influenza_Chain
DIQLTQSPSSLSASIGDRVTITCQASQDIRNSLNWYEHKPGKAPKLLIHDASNLETGVPSRFSGGGSGTDFTLTISSLQPEDFATYYCQQANSFPLTFGGGTKVEIK

SEQ ID NO: 4692 - protein, 107 aa, synthetic construct
  REGION 1..107: note = anti-influenza_Chain
DIQLTQSPSSLSASVGDRVTITCRASQGIRNDLGWYQQKPGNAPKRLIFGASSLQSGVPSRFSGSGSGTEFTLTISSLQPEDFATYYCLQHNSYPYTFGQGTKLEIK

SEQ ID NO: 4693 - protein, 107 aa, synthetic construct
  REGION 1..107: note = anti-influenza_Chain
DIQLTQSPSSLSASVGDRVTITCRASQSISRYLNWYQQKPGKAPKLLLFAASTLLDGVPSRFSGSGSGTDFTLTISSLQPEDFATYYCQRNHSPSWTFGQGTRVEIK

SEQ ID NO: 4694 - protein, 107 aa, synthetic construct
  REGION 1..107: note = anti-influenza_Chain
DIQMTQSPSSLSASVGDRVTMTCRASQNIRSYLNWYQQRPGTAPKLLIYAASTLHSGVPSRFSGGGSGTDFTLTINNLQPEDFASYYCQQSYDNPQTFGQGTKVEIK

SEQ ID NO: 4695 - protein, 107 aa, synthetic construct
  REGION 1..107: note = anti-influenza_Chain
DIQMTQSPSSLSASVGDRVTITCRANQDIGIYLNWYQQNPGKVPKLLLHGASSLQGGVPSRFSASGSGTDFTLTIHSLQPEDLATYYCQQSRRLPYTFGQGTRVELK

SEQ ID NO: 4696 - protein, 107 aa, synthetic construct
  REGION 1..107: note = anti-influenza_Chain
DIQMTQSPSTLSASIGDRVTITCRASQSIASWLAWYQQKPGKAPKLLIYEAVNLESGVPSRFSGSGSGTDFTLTISSLQPDDFATYFCQHYGTISQTFGGGTKVEIK

SEQ ID NO: 4697 - protein, 107 aa, synthetic construct
  REGION 1..107: note = anti-influenza_Chain
DIQMTQSPSSLSASVGDRVTITCRASQSISSYLNWYQHKPGKAPKVLMYAVSILQSGVPSRFSGSGSGADFTLTISSLQPEDFATYYCQQSYSSPLTFGGGTKVEIK

SEQ ID NO: 4698 - protein, 107 aa, synthetic construct
  REGION 1..107: note = anti-influenza_Chain
DIQMTQSPSSLSASVGDRVTITCRASQNIKRYFNWYQQKPGKAPKLLIYAASNLENGVPSRFSGSGSGTDFTLTISSLQPEDFATYYCQQSFSKSWTFGQGTNVDIK

SEQ ID NO: 4699 - protein, 107 aa, synthetic construct
  REGION 1..107: note = anti-influenza_Chain
DIQMTQSPSSLSASVGDRVTITCRASQNIYKYLNWYQQRPGKAPKGLISAASGLQSGVPSRFSGSGSGTDFTLTITSLQPEDFATYYCQQSYSPPLTFGGGTRVEIK

SEQ ID NO: 4700 - protein, 107 aa, synthetic construct
  REGION 1..107: note = anti-influenza_Chain
DIQMTQSPSSLSSSVGDRVTITCRASQSIGAYVNWYQQKAGKAPQVLIFGASNLQSGVPSRFSGSGSGTDFTLTISSLQPEDFATYFCQQTYSTPITFGQGTRLEIK

SEQ ID NO: 4701 - protein, 107 aa, synthetic construct
  REGION 1..107: note = anti-influenza_Chain
DIQMTQSPSSLSASVGDRVTISCRASQSISTYLNWYQQQPGKAPKVLIFGATNLQSGVPSRFSGSGSGTDFTLTISSLQPEDFATYYCQQSYNTPLIFGQGTKLEIK

SEQ ID NO: 4702 - protein, 107 aa, synthetic construct
  REGION 1..107: note = anti-influenza_Chain
DIQMTQSPSSLSASVGDRVTISCRASQSISTYLNWYQQQPGKAPKVLISGATNLQSGVPSRFSGSGSGTDFTLTISSLQPEDFATYYCQQSYNTPLIFGQGTKLEIK

SEQ ID NO: 4703 - protein, 107 aa, synthetic construct
  REGION 1..107: note = anti-influenza_Chain
DIQMTQSPSSLSASVGDRLTITCRASQSISTYLHWYQQKPGKAPKLLIYAASSLQSGVPSRFSGSRSGTDFTLTISSLQPDDFATYYCQQSYSPPLTFGPGTKVDMK

SEQ ID NO: 4704 - protein, 107 aa, synthetic construct
  REGION 1..107: note = anti-influenza_Chain
DIQMTQSPSSLSASVGDRVTITCRASQSISNYLNWYQHKPGEAPKLLNYAASSLQSGVPSRFSASGSGTDFTLTISSLQPEDFATYYCQQSYNTPITFGQGTRLEIK

SEQ ID NO: 4705 - protein, 107 aa, synthetic construct
  REGION 1..107: note = anti-influenza_Chain
DIQMTQSPSSLSASVGDRVTITCRASQSISNYLNWYQHKPGEAPKLLNYAASSLQSGVPSRFSASGSGTDFTLSISGLQPEDFATYYCQQSYNTPITFGPGTRLEIK

SEQ ID NO: 4706 - protein, 107 aa, synthetic construct
  REGION 1..107: note = anti-influenza_Chain
DIQMTQSPSSLSASVGDRVTITCRASQSISTYLNWYQQKPGKAPKLLIYAASSLHSGVPSRFSGSGSGTDFALTISSLQPEDFATYYCQQSYSPPITFGQGTRLEIK

SEQ ID NO: 4707 - protein, 107 aa, synthetic construct
  REGION 1..107: note = anti-influenza_Chain
DIQMTQSPSSLSASVGDRVTITCRASQTISTYLNWYQQKSGKAPKLLIYAASGLQSGVPSRFSGSGSGTDFTLTISSLQPEDFATYFCQQSYNTPLTFGQGTKVEIK

SEQ ID NO: 4708 - protein, 107 aa, synthetic construct
  REGION 1..107: note = anti-influenza_Chain
DIQMTQSPSSLSASVGDRVTISCRASQSISTYLNWYQQQPGKAPKVLISGATDLQSGVPSRFSGSGSGTDFTLTISSLQPEDFATYYCQQSYNTPLIFGQGTKLEIK

SEQ ID NO: 4709 - protein, 107 aa, synthetic construct
  REGION 1..107: note = anti-influenza_Chain
DIQVTQSPSSLSASVGDRVTITCRASQNIYKYLNWYQQRPGKAPKGLISAASGLQSGVPSRFSGSGSGTDFTLTITSLQPEDFATYYCQQSYSPPLTFGGGTRVDIK

SEQ ID NO: 4710 - protein, 107 aa, synthetic construct
  REGION 1..107: note = anti-influenza_Chain
QSVLTQPPSESVSPGQTASVTCSGHKLGDKYVSWYQQKPGQSPVLLIYQDNRRPSGIPERFIGSNSGNTATLTISGTQALDEADYYCQAWDSSTAVFGGGTKLTVLG

SEQ ID NO: 4711 - protein, 107 aa, synthetic construct
  REGION 1..107: note = anti-influenza_Chain
DIQLTQSPSSLSASVGDRVTITCRASQGISTYLAWYQQKPGKVPKLLIYAASTLQSGVPSRFSGSGSGTDFTLTISSLQPEDVATYYCQKYNSAPSFGPGTKVDIKR

SEQ ID NO: 4712 - protein, 107 aa, synthetic construct
  REGION 1..107: note = anti-influenza_Chain
SVLTQPPSASGSRGQSITISCTGSTSDIGSYNYVSWYQQHPGTAPKVILYEVSQRPSGVPDRFSGSKSGNTAFLTVSGLQAEDEADYYCASYAGNNIYVFGSGTKVT

SEQ ID NO: 4713 - protein, 107 aa, synthetic construct
  REGION 1..107: note = anti-influenza_Chain
SALTQPPSASGSRGQSITISCTGSTSDIGSYNYVSWYQQHPGTAPKVILYEVSQRPSGVPDRFSGSKSGNTAFLTVSGLQAEDEADYYCASYAGNNIYVFGSGTKVT

SEQ ID NO: 4714 - protein, 107 aa, synthetic construct
  REGION 1..107: note = anti-influenza_Chain
EIVLTQSPATLSLSPGERATLSCRASQSVSTFLAWYQQKPGQAPRLLMYDASNRATGIPARFSGSGSGTDFTLTISSLEPEDFAIYYCQQRSHWPPIFGQGTRLEIK

SEQ ID NO: 4715 - protein, 107 aa, synthetic construct
  REGION 1..107: note = anti-influenza_Chain
DIQMTQSPASLSVSVGETVTITCRASEKIYSNLAWYQQKEGKSPQLLVYAAIRLADGVPSRFSGSGSGTQFSLKINSLQSEDFGTYYCQHFWGTPLTFGAGTKLELK

SEQ ID NO: 4716 - protein, 107 aa, synthetic construct
  REGION 1..107: note = anti-influenza_Chain
DIQMTQSPSSVSASVGDRVTITCRASQDISTWLAWYQQKPGKAPKLLIYAASSLQSGVPSRFSGSGSGTDFTLTISSLQPEDFATYFCQQANSFPPTFGQGTKLEIK

SEQ ID NO: 4717 - protein, 107 aa, synthetic construct
  REGION 1..107: note = anti-influenza_Chain
DIQMTQSPSSVSASVGDRVTITCRASQDISTWLAWYQQKPGKAPKLLIYAASSLQSGVPSRFSGSGSGTDFTLTISSLQPEDFATYFCQQANSFPPTFGCGTKLEIK

SEQ ID NO: 4718 - protein, 107 aa, synthetic construct
  REGION 1..107: note = anti-influenza_Chain
DIQMTQSPSSVSASVGDRVTITCRASQDISTWLAWYQQKPGKCPKLLIYAASSLQSGVPSRFSGSGSGTDFTLTISSLQPEDFATYFCQQANSFPPTFGQGTKLEIK

SEQ ID NO: 4719 - protein, 107 aa, synthetic construct
  REGION 1..107: note = anti-influenza_Chain
DIQMTQSPSSVSASVGDRVTITCRASQDISTWLAWYQQKPGKAPKLLIYAASSLQSGVPSRFSGSGSGTDFTLTISSLQPEDFATYYCQQANSFPPTFGQGTKLEIK

SEQ ID NO: 4720 - protein, 107 aa, synthetic construct
  REGION 1..107: note = anti-influenza_Chain
DIQMTQSPSSVSASVGDRVTITCRASQDISTWLAWYQQKPGKAPKLLIYAASSLQSGVPSRFSGSGSGTDFTLTISSLQPEDFATYYCQQANSFPPTFGCGTKLEIK

SEQ ID NO: 4721 - protein, 107 aa, synthetic construct
  REGION 1..107: note = anti-influenza_Chain
DIQMTQSPSSVSASVGDRVTITCRASQDISTWLAWYQQKPGKCPKLLIYAASSLQSGVPSRFSGSGSGTDFTLTISSLQPEDFATYYCQQANSFPPTFGQGTKLEIK

SEQ ID NO: 4722 - protein, 107 aa, synthetic construct
  REGION 1..107: note = anti-influenza_Chain
EIVLTQSPATLSLSPGERATLSCRASRSITTFLAWYQQKPGQAPRLLIYDASNRATGVPARFSGSGSGTDFTLTINSLEPDDFAIYYCQQRDHWPPIFGQGTRLEIK

SEQ ID NO: 4723 - protein, 107 aa, synthetic construct
  REGION 1..107: note = anti-influenza_Chain
EIVLTQSPATLSLSPGERATLSCRASRSITTFLAWYQQKPGQAPRLLIYDASNRATGVPARFSGSGSGTDFTLTINSLEPDDFAIYYCQQRDHWPPIFGCGTRLEIK

SEQ ID NO: 4724 - protein, 108 aa, synthetic construct
  REGION 1..108: note = anti-influenza_Chain
EIVLTQSPGTLSLSPGERATLSCRASQTVSSSYLAWYQQKPGQAPRLLIYGASSRATGIPDRFSGSGSGTDFTLTISRLEPEDFAVYYCQQYGNSPYTFGQGTKLEIK

SEQ ID NO: 4725 - protein, 108 aa, synthetic construct
  REGION 1..108: note = anti-influenza_Chain
EIVLTQSPGTLSVSPGERATLSCRASQSISSGYLAWYQQKPGQAPRLLIYGASSRATGIPDRFSGSGSGTDFTLTISRLEPEDFAVYYCQQYGTSPQTFGQGTKVEIK

SEQ ID NO: 4726 - protein, 108 aa, synthetic construct
  REGION 1..108: note = anti-influenza_Chain
EVVLTQSPGTLSLSPGQRATLSCRASQSVSSSYLAWYQQKPGQAPRLLIYDASNRATGIPDRFSGSGSGTDFTLTISRLEPEDFAVYYCQQYGSSPYTFGQGTKLEIK

SEQ ID NO: 4727 - protein, 108 aa, synthetic construct
  REGION 1..108: note = anti-influenza_Chain
DIQLTQSPSSLSASVGDRVTITCRASQGIITYLNWYQQKPGKAPKLLIYATYSLQNGVPSRFSGSGSGTDFTLTISSLQPEDFATYYCQQSYSSLMFTFGQGTKLDIK

SEQ ID NO: 4728 - protein, 108 aa, synthetic construct
  REGION 1..108: note = anti-influenza_Chain
ETVLTQSPGTLSLTPGERATLSCRVGQSVSGSHLAWYQQKPGQAPRLLIYGASSRATGIPDRFGGSVSGTDFTLTISRLEPEDSAVYYCQQYGDSRYTFGQGTKLEIK

SEQ ID NO: 4729 - protein, 108 aa, synthetic construct
  REGION 1..108: note = anti-influenza_Chain
EIVLTQSPGTLSLSPGERATLSCRASQSVSSSQLAWYQQKPGQAPRLIIYGASTRATGIPDRFSGSGSGTDFTLTIGRLEPEDFAVFFCQQYSTSPPTFGQGTKVDFK

SEQ ID NO: 4730 - protein, 108 aa, synthetic construct
  REGION 1..108: note = anti-influenza_Chain
DIVLTQSPGTLSLSPGERATLSCRASQSVSSSYLAWYQQKPGQAPRLVMYGAATRATGIPDRFSGSGSGPDFTLTISRLEPEDFAMYYCQQYGNSPITFGQGTRLEIK

SEQ ID NO: 4731 - protein, 108 aa, synthetic construct
  REGION 1..108: note = anti-influenza_Chain
EIVLTQSPATLSLSPGERATLSCRASQSVSSYLAWYQQKPGQAPRLLIYDASNRATGIPARFSGSGSGTDFTLTISSLEPEDFAVYYCQQRSHWPPITFGQGTRLEIK

SEQ ID NO: 4732 - protein, 108 aa, synthetic construct
  REGION 1..108: note = anti-influenza_Chain
SYELTQPPSVSVSPGQTARITCSGDALPKQNAYWYQQKPGQAPVLLIYKDSERPSGIPERFSGSSSGTTVTLTISGVQAEDEADYYCQSADSSGTSWVFGGGTKLTVL

SEQ ID NO: 4733 - protein, 108 aa, synthetic construct
  REGION 1..108: note = anti-influenza_Chain
SYVLTQAPSVSVAPGQTARITCGGNAIGSKKVHWYQHKAGQAPVLVVYDDTDRPSGIPERFSGSNSWSTATLTINRVEAGDEADYYCQVWDFTIDHVVFGGGTKLTVL

SEQ ID NO: 4734 - protein, 108 aa, synthetic construct
  REGION 1..108: note = anti-influenza_Chain
EIVLTQSPGTLSLSPGERATLSCRASQSVSSSYLAWYQKKPGQAPRLLIYGASTRATGIPDRFTGSGSGTDFTLSISRLEPEDFAVYYCQHFGTSVFTFGGGTKVEIK

SEQ ID NO: 4735 - protein, 108 aa, synthetic construct
  REGION 1..108: note = anti-influenza_Chain
EIVMTQSPATLSVSPGERATLSCRASQSVGNSLAWYQQRPGQAPRLLIYGASTRATGIPPRFSGSGSGTEFTLTISSLQTEDFAVYYCQQYINWRPLSFGGGTKVEIK

SEQ ID NO: 4736 - protein, 108 aa, synthetic construct
  REGION 1..108: note = anti-influenza_Chain
QESGAELVRPGASVKLSCKDSGYTFTTYWMNWVKQRPEQGLEWIGRIDPYDSETHYNQKFKDKAILTVDKSSNTAYMQLSSLTSEDSAVYYCVRGGSTVAYFGVWGQG

SEQ ID NO: 4737 - protein, 108 aa, synthetic construct
  REGION 1..108: note = anti-influenza_Chain
EIVLTQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKR

SEQ ID NO: 4738 - protein, 108 aa, synthetic construct
  REGION 1..108: note = anti-influenza_Chain
EIVMTQSPGTLSLSPGERATLSCRASQSVSSSYLAWYQQKPGQAPRLLIFGASSRATGIPDRFSGSGSGTDFTLTISRLEPEDFAVYYCQQYGSSLTFGGGTKLEIKR

SEQ ID NO: 4739 - protein, 108 aa, synthetic construct
  REGION 1..108: note = anti-influenza_Chain
EIVLYQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKR

SEQ ID NO: 4740 - protein, 108 aa, synthetic construct
  REGION 1..108: note = anti-influenza_Chain
DIVLTQAPSVSVSPGQTASITCSGDRLGEKFASWYQQKPGQSPVLVIYEDSKRPSGIPDRFSGSNSGNTATLTISGTQIMDEGDFFCQAWDSSTVVFGGGTKLTVLGQ

SEQ ID NO: 4741 - protein, 108 aa, synthetic construct
  REGION 1..108: note = anti-influenza_Chain
DIELTQSPSVSVSPGQTASITCSGDKLGDKFVCWYQQKAGQSPIVVIYQDDKRPSGIPERFSGSNSGNTATLTISGTQAMDEADYFCQAWDSTTVVFGGGTKLTVLGQ

SEQ ID NO: 4742 - protein, 108 aa, synthetic construct
  REGION 1..108: note = anti-influenza_Chain
QSVLTQPPSASGSRGQSITISCTGSTSDIGSYNYVSWYQQHPGTAPKVILYEVSQRPSGVPDRFSGSKSGNTAFLTVSGLQTDDEADYYCASYAGNNIYVFGSGTKVT

SEQ ID NO: 4743 - protein, 109 aa, synthetic construct
  REGION 1..109: note = anti-influenza_Chain
NFMLTQPHSVSESPGKTVTISCTGSGGNIARNYVQWYQQRPGSAPVTVILEDDKRPSGIPDRFSGSIDRSSNSASLTISGLRTEDEALYYCQSYDDSDLVVFGGGTKLT

SEQ ID NO: 4744 - protein, 109 aa, synthetic construct
  REGION 1..109: note = anti-influenza_Chain
MLEPLQILSICSFILSALHFMAWTIGHLNQIKRGVNLKIQIRNPNKEAINREVSILRHNYQKEIQAKETMKKILSDNMEVLGDHIVVEGLSTDEIIKMGETVLEVEELQ

SEQ ID NO: 4745 - protein, 109 aa, synthetic construct
  REGION 1..109: note = anti-influenza_Chain
DIRLTQSPATLSVSPGERATLSCRASHSVSRNLAWYQQKPGRAPRLLVYDTSSRATGIPARFSGSGSGTEFTLTISSLQSEDFAVYYCQQYNNWPRTFGQGTKVDIKRT

SEQ ID NO: 4746 - protein, 109 aa, synthetic construct
  REGION 1..109: note = anti-influenza_Chain
EIVMTQSPGTLSLSPGERATLSCRASQSVSSSYLAWYQQKPGQAPRLLIYGASTRATGVPDRFHGGGSGTDFTLTISRLEPEDFAVYYCQQYDTSSGLTFGGGTKVEIK

SEQ ID NO: 4747 - protein, 109 aa, synthetic construct
  REGION 1..109: note = anti-influenza_Chain
EIVMTQFPATLSVSPGERVTLSCRASQSVSNNLAWYQQKPGQPPRLLIYDASTRATGVPAKFSGTGSGTEFTLSISSLQSEDFAVYYCQQYHNWPPSYSFGLGTKLEIK

SEQ ID NO: 4748 - protein, 109 aa, synthetic construct
  REGION 1..109: note = anti-influenza_Chain
EIILAQSPGTLSLSPGERATLSCRASQFVSTRSLAWYQQRPGQAPRLLIYGASSRATGIPDRFSGSGSGTDFTLTISRLEPEDFAVYYCQHYGYSPRYAFGQGSKVEIK

SEQ ID NO: 4749 - protein, 109 aa, synthetic construct
  REGION 1..109: note = anti-influenza_Chain
EIVLTQSPGTLSLSPGERATLSCRASHFVNYRSLAWYQQTPGQVPRLLIYGASTRATGIPDRFSGSGSGTDFTLTISRLEPEDFAVYFCQQYGGSPRYTFGQGTRLEIK

SEQ ID NO: 4750 - protein, 109 aa, synthetic construct
  REGION 1..109: note = anti-influenza_Chain
EIVLTQSPGTLSLSPGERATLSCRASHFVIGRAVAWYQQKPGQAPRLLIYGASSRATGIPDRFSGSGSGTDFTLTISRLETEDFAVFYCQHYGSSPRYAFGQGTKLEIK

SEQ ID NO: 4751 - protein, 109 aa, synthetic construct
  REGION 1..109: note = anti-influenza_Chain
EIVLTQSPATLSLSPGERATLSCRASQSVGNYLAWYQQKPGQAPRLLIYDSSNRAPGIPARFSGSGSGTDFTLTISSLAPEDFAVYYCQQRSKWPPMYSFGHGTKLEIK

SEQ ID NO: 4752 - protein, 109 aa, synthetic construct
  REGION 1..109: note = anti-influenza_Chain
QAVVTQEPSLTVSPGGTVTLTCGSSTGPVTSGHYPYWFQQKPGQAPRTLISATSNTHSWTPARFSGSLLGGRAALTLSGAQPEDEADYYCFLSYSGAWVFGGGTTLTVL

SEQ ID NO: 4753 - protein, 109 aa, synthetic construct
  REGION 1..109: note = anti-influenza_Chain
AIQMTQSPSSLSASVGDRVTITCRASQNIRSYLNWYQQKPGKAPNLLIYGTTSLESGVPSRFSGSGSGTDFTLTISSLQPEDFATYYCQQSYHTPQTFGQGTKVEIKRT

SEQ ID NO: 4754 - protein, 109 aa, synthetic construct
  REGION 1..109: note = anti-influenza_Chain
DIQMTQSPSSLSASVGDRITITCRASQGIDNYLAWFQQKPGKVPELLIYAASTLQSGVPSRFSGSGSGTGFTLTISSLQPEDVATYYCQKYDSAPLTFGGGTKVDIKRT

SEQ ID NO: 4755 - protein, 109 aa, synthetic construct
  REGION 1..109: note = anti-influenza_Chain
DIQLTQSPSSLSASVGDRVTITCRASQGITDYLAWYQQKPGTIPKLLIYAASTLQSGVPSRFSGGGYGTDFTLTISSLQPEDVATYYCQKYNSAPLTFGGGTKVEIKRT

SEQ ID NO: 4756 - protein, 109 aa, synthetic construct
  REGION 1..109: note = anti-influenza_Chain
DIVMTQSPFSLSLSPGERATLSCRASQSISNYLAWYQQKPGQAPRLLIYDSSNRATGVPARFSGSGSGTDFTLTISSLEPEDFAVYYCQQRSNWMYTFGQGTKVEIKRT

SEQ ID NO: 4757 - protein, 109 aa, synthetic construct
  REGION 1..109: note = anti-influenza_Chain
DIQMTQSPSSLSASVGDRVTITCRASQGISSYLAWYQQKPGKVPTLLIYDASTLRSGVPSRFSGSGSATDFTLTISSLQPEDVATYYCQRYNSAPPITFGQGTRLEIKR

SEQ ID NO: 4758 - protein, 109 aa, synthetic construct
  REGION 1..109: note = anti-influenza_Chain
EIVMTQSPGTLSLSPGERATLSCRASQSVSSSYLAWYQQKPGQAPRLLIYDASSRATDIPDRFSGSGSGTDFTLTISRLEPEDFAVYYCQQYGSSLWTFGQGTKVEIKR

SEQ ID NO: 4759 - protein, 109 aa, synthetic construct
  REGION 1..109: note = anti-influenza_Chain
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHAVFGGGTQLTVLG

SEQ ID NO: 4760 - protein, 109 aa, synthetic construct
  REGION 1..109: note = anti-influenza_Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGGGTKVEIKR

SEQ ID NO: 4761 - protein, 109 aa, synthetic construct
  REGION 1..109: note = anti-influenza_Chain
SYVLTQPPSVSVAPGQTARITCGGNNIGSKGVHWYQQKPGQAPVLVVYDDSDRPSGIPERFSGSNSGNTATLTISRVEAGDEADYYCQVWDSSSDHVVFGGGTKLTVLG

SEQ ID NO: 4762 - protein, 109 aa, synthetic construct
  REGION 1..109: note = anti-influenza_Chain
EIVLTQSPGTLSLSPGERATLSCRASQSVSSNYLGWTQQKPGQAPRLLIYGASSRASGIPDRFSGGGSGTDFTLTISRLEPEDFAVYYCQQYGSSPLTFGGGTKVEIKR

SEQ ID NO: 4763 - protein, 109 aa, synthetic construct
  REGION 1..109: note = anti-influenza_Chain
QSVVTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLG

SEQ ID NO: 4764 - protein, 109 aa, synthetic construct
  REGION 1..109: note = anti-influenza_Chain
SYVLTQPPSESVAPGQTARITCGGNNIGRNSVHWYQQKPGQAPVLVVYDDSDRPSGIPERFSGSKSGNTATLIISRVEVGDEADYYCQVWHSSSDHYVFGTGTKVTVLG

SEQ ID NO: 4765 - protein, 109 aa, synthetic construct
  REGION 1..109: note = anti-influenza_Chain
EIVMTQSPGTLSLSPGQRATLSCRASQSVSSSYLAWYQQKPGQAPRLLMYGASSRATGIPDRFSGSGSGTDFTLTISRLEPEDFAVYYCQQYGSSSLTFGGGTKLEIKR

SEQ ID NO: 4766 - protein, 109 aa, synthetic construct
  REGION 1..109: note = anti-influenza_Chain
QAGLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLG

SEQ ID NO: 4767 - protein, 109 aa, synthetic construct
  REGION 1..109: note = anti-influenza_Chain
QSVVTQPPSESVAPGQTARITCGGHNIGSNSVHWYQQKPGQAPVLVVYDNSDRPSGIPERFSGSNSGNTATLTISRVEAGDEADYYCQVWGSSSDHYVFGTGTKVTVLG

SEQ ID NO: 4768 - protein, 109 aa, synthetic construct
  REGION 1..109: note = anti-influenza_Chain
EIVLTQSPGTLSLSPGERATLSCRASQSVSSNYLGWYQQKPGQAPRLLIYGASSRASGIPDRFSGGGSGTDFTLTISRLEPEDFAVYYCQQYGSSPLTFGGGTKVEIKR

SEQ ID NO: 4769 - protein, 109 aa, synthetic construct
  REGION 1..109: note = anti-influenza_Chain
EIVLTQSPATLSVSPGERATLSCRASQSVDSNLAWYQQKPGQAPRLLVYSASTRATGIPARFSGSGSGTEFTLAISSLQSEDFAVYYCQHYTNWPPRLTFGGGSKVEIK

SEQ ID NO: 4770 - protein, 109 aa, synthetic construct
  REGION 1..109: note = anti-influenza_Chain
EIVLTQSPATLSVSPGERATLSCRASQSVSHNLAWYQQKPGQAPRLLVYSASTRATGIPARFSGSGSGTEFTLAISSLQSEDFAVYYCQHYTNYPPRLTFGGGSKVEIK

SEQ ID NO: 4771 - protein, 109 aa, synthetic construct
  REGION 1..109: note = anti-influenza_Chain
EIVMTQSPATLSVSPGERATLSCRASQSVDSNLAWYQQKPGQAPRLLVYSASTRATGIPARFSGSGSGTEFTLAISSLQSEDFAVYYCQHYTNWPPRLTFGGGSKVEIK

SEQ ID NO: 4772 - protein, 109 aa, synthetic construct
  REGION 1..109: note = anti-influenza_Chain
EIVLTQSPATLSVSPGERATLSCRASQSVSSNLAWYQQKPGQAPRLLVYSASTRATGIPARFSGSGSGTEFTLAISSLQSEDFAVYYCQHYTNWPPRLTFGGGSKVEIK

SEQ ID NO: 4773 - protein, 109 aa, synthetic construct
  REGION 1..109: note = anti-influenza_Chain
EIVLTQSPATLSVSPGERATLSCRASQSVDHNLAWYQQKPGQAPRLLVYSASTRATGIPARFSGSGSGTEFTLAISSLQSEDFAVYYCQHYTNWPPRLTFGGGSKVEIK

SEQ ID NO: 4774 - protein, 109 aa, synthetic construct
  REGION 1..109: note = anti-influenza_Chain
EIVLTQSPATLSVSPGERATLSCRASQSVSHNLAWYQQKPGQAPRLLVYSASTRATGIPARFSGSGSGTEFTLAISSLQSEDFAVYYCQHYTNWPPRLTFGGGSKVEIK

SEQ ID NO: 4775 - protein, 109 aa, synthetic construct
  REGION 1..109: note = anti-influenza_Chain
EIVLTQSPATLSVSPGERATLSCRASQSVSHNLAWYQQKPGQAPRLLVYSASTRATGIPARFSGSGSGTEFTLAISSLQSEDFAVYYCQHYTNFPPRLTFGGGSKVEIK

SEQ ID NO: 4776 - protein, 109 aa, synthetic construct
  REGION 1..109: note = anti-influenza_Chain
EIVLTQSPATLSVSPGERATLSCRASQSVDSNLAWYQQKPGQAPRLLVYSASTRATGIPARFSGSGSGTEFTLAISSLQSEDFAVYYCQHYTNFPPRLTFGGGSKVEIK

SEQ ID NO: 4777 - protein, 109 aa, synthetic construct
  REGION 1..109: note = anti-influenza_Chain
EIVLTQSPATLSVSPGERATLSCRASQSVDSNLAWYQQKPGQAPRLLVYSASTRATGIPARFSGSGSGTEFTLAISSLQSEDFAVYYCQHYTNYPPRLTFGGGSKVEIK

SEQ ID NO: 4778 - protein, 109 aa, synthetic construct
  REGION 1..109: note = anti-influenza_Chain
ETTLTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIK

SEQ ID NO: 4779 - protein, 109 aa, synthetic construct
  REGION 1..109: note = anti-influenza_Chain
EIVLTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIK

SEQ ID NO: 4780 - protein, 109 aa, synthetic construct
  REGION 1..109: note = anti-influenza_Chain
EIVLTQSPATLSVSPGERATLSCRASQVISHNLAWYQQKPGQAPRLLIYGASTRASGIPARFSGSGSGTDYTLTITSLQPEDFAVYYCQHYSNWPPRLTFGGGTKVEIK

SEQ ID NO: 4781 - protein, 109 aa, synthetic construct
  REGION 1..109: note = anti-influenza_Chain
EIVMTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIK

SEQ ID NO: 4782 - protein, 109 aa, synthetic construct
  REGION 1..109: note = anti-influenza_Chain
EIVLTQSPATLSVSPGERATLSCRASQVISHNLAWYQQKPGQAPRLLIYGASTRASGIPARFSGSGSGTDYTLTITSLQSEDFAVYYCQHYSNFPPRLTFGGGTKVEIK

SEQ ID NO: 4783 - protein, 109 aa, synthetic construct
  REGION 1..109: note = anti-influenza_Chain
EIVLTQSPATLSVSPGERATLSCRASQVISHNLAWYQQKPGQAPRLLIYGASTRASGIPARFSGSGSGTDYTLTITSLQSEDFAVYYCQHYSNYPPRLTFGGGTKVEIK

SEQ ID NO: 4784 - protein, 109 aa, synthetic construct
  REGION 1..109: note = anti-influenza_Chain
EIVLTQSPATLSVSPGERVTLSCRASQSVANNLAWYQQKPGQSPRLLIYGASTRDTGIPARFSGSGSGTEFTLTISSLQSEDFAVYYCQQYNNWPPMYTFGQGTKLEIK

SEQ ID NO: 4785 - protein, 109 aa, synthetic construct
  REGION 1..109: note = anti-influenza_Chain
DIVMTQSPSTLSASVGDRVTITCRASQSIGNWLAWYQQKPGKAPKLLIYKVSTLESGVPSRFSGSGSGTEFTLTINSLQPDDFATYYCQRYTSNSQGFTFGQGTKLEIK

SEQ ID NO: 4786 - protein, 109 aa, synthetic construct
  REGION 1..109: note = anti-influenza_Chain
DIVMTQSPATLSVSPGERATLSCRASQVVGTNLAWYQQKPGQAPRLLIYAASTRATGIPARFSGSGFGTDFTLTISSLQSEDFAVYYCQQYNNWPLSFGGGTKVEIRRT

SEQ ID NO: 4787 - protein, 109 aa, synthetic construct
  REGION 1..109: note = anti-influenza_Chain
DIQMTQSPSSLSASVGDRVTIVCRASQGINTHLHWYQQKPGKAPKLLIYSASTLHTGVPSRLSGSGSGTDFTLSISSLQPEDFATYYCQQSYNYPRTFGQGTNVDIKRT

SEQ ID NO: 4788 - protein, 109 aa, synthetic construct
  REGION 1..109: note = anti-influenza_Chain
DILMTQSPSSLSASVGDRVTITCRASQDIRNRLAWYQQKPGKAPKRLIYAASSLQSGVPSRFSGSGSGTEFTLTINSLQPEDFATYYCLQHNSYPWTFGPGTKVEIKRT

SEQ ID NO: 4789 - protein, 109 aa, synthetic construct
  REGION 1..109: note = anti-influenza_Chain
DIVMTQSPATLSVSPGEGATLSCRASQGIGSNLAWYQHKPGQAPRLLIYAASTRATGVPARFSGSGSGTEFTLTISSLQSEDLAVYFCQQYNTWPLTFGGGTKVEIIRT

SEQ ID NO: 4790 - protein, 109 aa, synthetic construct
  REGION 1..109: note = anti-influenza_Chain
DIVMTQSPSTLSASVGDRVTITCRASQTIYRWLAWYQQKPGKAPKVLIYKASTLESGVPSRFSGSGSGTEFTLAISSLQPDDFATYYCQQYNSFPYRFGQGTKVEIKRT

SEQ ID NO: 4791 - protein, 109 aa, synthetic construct
  REGION 1..109: note = anti-influenza_Chain
DIVMTQSPSSLSASVGDRVSITCRASQTITRFLNWYQQKPGKGPKLLIYAASTVHRGVPSRFSGSGSGTDFTLTISSLQPEDFATYYCQQSYSAPFTFGPGTTVDIRRT

SEQ ID NO: 4792 - protein, 109 aa, synthetic construct
  REGION 1..109: note = anti-influenza_Chain
DIVMTQPPATLSVSPGERATLSCGASQGLGSNLAWYQQKPGQAPRLLIYAASTRATGITARFSGSGSGTEFTLTINSLQSEDFALYYCQQYTYWPLTFGGGTKVEIKRT

SEQ ID NO: 4793 - protein, 109 aa, synthetic construct
  REGION 1..109: note = anti-influenza_Chain
DIVLTQSPATLSVSPGERATLSCRASQSVNRNLAWFQQIPGQAPRLLIFDASTRAADIPARFSGGGSGAEFTLTVSSLQPEDFAVYYCQQYDKWPPGFGQGTKVEIKRT

SEQ ID NO: 4794 - protein, 110 aa, synthetic construct
  REGION 1..110: note = anti-influenza_Chain
QSVLTQPPSASGAPGQRVTLSCSGSGSNIGSNTVSWYQQLPGTAPKLLVFTNNQRPSGVPDRFSGSKSGTSASLAISGLQSEDEADYYCAAWDDSLNGQLFGGGTKLTVL

SEQ ID NO: 4795 - protein, 110 aa, synthetic construct
  REGION 1..110: note = anti-influenza_Chain
QSVLTQPPSVSAAPGQRVTISCSGTSSNIGKNYVSWYQQLPGAAPKLLIYDNDKRPSGIPDRFSGSKSGTSATLGITGLQTGDEADYYCGTWDSSLSVGMFGGGTRLTVL

SEQ ID NO: 4796 - protein, 110 aa, synthetic construct
  REGION 1..110: note = anti-influenza_Chain
ETTLTQSPATLSVSPGERATLSCRASQSVSRNLAWYQQKPGQAPRLLIYGASSRATGIPDRFSGSGSGTDFTLTISRLEPEDFAVYYCQQYGSSSITFGQGTRLEIKRTV

SEQ ID NO: 4797 - protein, 110 aa, synthetic construct
  REGION 1..110: note = anti-influenza_Chain
QSVLTQPPSASGTPGQRVTISCSGSSSNIGSNTVNWYKQLPGTAPRLLIYSNDQRPSGVPDRFSGSKSGTSASLAISGLQSEDEANYYCAAWDDSLSGWVFGGGTKLTVL

SEQ ID NO: 4798 - protein, 110 aa, synthetic construct
  REGION 1..110: note = anti-influenza_Chain
QSALTQPRSVSGSPGQSVTISCTGSSSDVGASNSVSWYQQHPGKAPKLVIYDVTERPSGVPHRFSGSKSGNTASLTVSGLQPEDEADYFCCAYGGKYLVVFGGGTKVTVL

SEQ ID NO: 4799 - protein, 110 aa, synthetic construct
  REGION 1..110: note = anti-influenza_Chain
QSALTQPASVSGSPGQSITISCTGTSSDVGGYNYVSWYQQHPGKAPKLLIYEVTNWPSGVSNRFSGSKSGNTASLTISGLQAEDEADYYCSSYAGSSTWVFGGGTRVTVL

SEQ ID NO: 4800 - protein, 110 aa, synthetic construct
  REGION 1..110: note = anti-influenza_Chain
QTVVTQEPSLTVSPGGTVTLTCASSTGAVTSSYFPNWFQQKPGQAPRPLIYSTTIRHSWTPARFSGSLLGGKAALTLSGVQPEDEADYYCLLYSGGDPVAFGGGTKLTVL

SEQ ID NO: 4801 - protein, 110 aa, synthetic construct
  REGION 1..110: note = anti-influenza_Chain
QSVLTQSPSVSAAPGQKVTISCSGSDSNIGDYFVCWYQHLPGKPPQLLIYENNKRPSGIPDRFSGSKSGTSATLGITGIQTGDEADYYCATWDGSLSAWVFGGGTKLTVL

SEQ ID NO: 4802 - protein, 110 aa, synthetic construct
  REGION 1..110: note = anti-influenza_Chain
QSALTQPRSVSGSPGQSITISCTGGSSDIGASNSVSWYQQHPGKAPKLVIFDVTERPSGVPHRFSGSKSGNTASLTVSGLQPDDEADYFCCAYGGKYLVVFGGGTKVTVL

SEQ ID NO: 4803 - protein, 110 aa, synthetic construct
  REGION 1..110: note = anti-influenza_Chain
QAVVTQEPSLAVSPGGTVTLTCGSSTGAVTRGHYPYWFQQKPGQAPRALIYDSAGNRHSWTPARFSGSLLGGKAALTLSGAQPEDEAEYYCLLSYSGVWVFGGGTKLTVL

SEQ ID NO: 4804 - protein, 110 aa, synthetic construct
  REGION 1..110: note = anti-influenza_Chain
EIVMTQSPATLSVSPGERVTLSCRASQSITDGLAWYQQKSGQAPRLLIYGASTRATGIPARFSGSGSGTEFTLTISSLQSEDFAVYYCQQYNNWPPVTFGQGTKVEIKRT

SEQ ID NO: 4805 - protein, 110 aa, synthetic construct
  REGION 1..110: note = anti-influenza_Chain
SSELTQPPSASGTPGQRVTISCSGSTSNIGYNPVSWYQQVPGTAPKLLIYSNTERPSGVPDRFSGSKSGTSASLAISGLQSEDEADYYCAAWDDTLNGPVFGGGTKVTVL

SEQ ID NO: 4806 - protein, 110 aa, synthetic construct
  REGION 1..110: note = anti-influenza_Chain
QSALTQPASVSGSPGQSITISCTGTSSDVGGYNYVSWYQQHPGEAPKLMISDVSNRPSGVSNRFSGSKSGNTASLTISGLQAEDEADYYCTSYTSSNTLVFGGGTKLTVL

SEQ ID NO: 4807 - protein, 110 aa, synthetic construct
  REGION 1..110: note = anti-influenza_Chain
QSVLTQPPSVSAAPGQKVTISCSGSSSNIGHNFVSWYQQLPATAPKLLIYDTDKRPSGIPDRFSGSKSGTSATLGITGLQTGDEADYYCGTWDSSLSSVIFGGGTKLTVL

SEQ ID NO: 4808 - protein, 110 aa, synthetic construct
  REGION 1..110: note = anti-influenza_Chain
DIQMTQSPSTLSASVGDRVTITCRASQTINNYLAWYQQKPGKAPKLLIYKASSLESGVPSRFSGSGSGTEFTLTISSLQPDDFATYYCQEYNNDSPLTFGGGTKVEIKRT

SEQ ID NO: 4809 - protein, 110 aa, synthetic construct
  REGION 1..110: note = anti-influenza_Chain
DIELTQDPSVSVAPGQTARIPCVRFNMGPTSVHWYQQKPGQAPVLVVYDDSDRPSGIPERFSGSNSGDSATLTISRVEAGDEADYYCQVWDMSSDRRVFGGGTTLTVLGQ

SEQ ID NO: 4810 - protein, 110 aa, synthetic construct
  REGION 1..110: note = anti-influenza_Chain
DIVMTQSPGTLSLSPGERATLYCRASQSVRSGYLAWYQHKPGQAPLLLFYDASGRATGIPDRFSGSGSGTDFTLTISRLEPEDFAVYYCLQYGSSPRTFGQGTKVEIKRT

SEQ ID NO: 4811 - protein, 110 aa, synthetic construct
  REGION 1..110: note = anti-influenza_Chain
DIVLTQSPSFLSASVGDRVTITCRASQLISSYFAWYQQKPGKPPKLLIYAASTLQSGVPSRFSGSGSGTQFSLTISSLQPEDFATYYCQQLNSYPPITFGQGTRLEIKRT

SEQ ID NO: 4812 - protein, 110 aa, synthetic construct
  REGION 1..110: note = anti-influenza_Chain
DITLTQSPATLSVSPGERATLSCRASQSVSSNLAWYQQKPGQAPRLLIYGASNRATDIPARFSGSGSGTEFTLTISSLQSEDFAVYYCQQFNDWPFLTFGGGTKVEIKRT

SEQ ID NO: 4813 - protein, 110 aa, synthetic construct
  REGION 1..110: note = anti-influenza_Chain
DIVMTQSPSFLSASVGDRVTITCRTSQVISSYLAWYQQRPGKAPKLLIYAASTLQSGVPSRFSGSGSGTRFSLTISNLQPEDFATYFCQQLTTYPPITFGQGTRLEIKRT

SEQ ID NO: 4814 - protein, 110 aa, synthetic construct
  REGION 1..110: note = anti-influenza_Chain
DIVLTQSPSVSVAPGQTARITCGGNDIGSKSVHWYQQKPGQAPVLVVFDDRDRPSGIPERFSGSNSGNTATLTISRVEAGDEADYYCQVWDITSDLVVFGGGTKLTVVGQ

SEQ ID NO: 4815 - protein, 110 aa, synthetic construct
  REGION 1..110: note = anti-influenza_Chain
DIVMTQPPGTLSVSPGERATLSCRASQSVSTNLAWYQQKPGQAPRLLIHGASTRATGIPARFSGSGSGAEFTLTISSLQSEDVAVYYCQQYDNWLPITFGPGTKVDIQRT

SEQ ID NO: 4816 - protein, 110 aa, synthetic construct
  REGION 1..110: note = anti-influenza_Chain
DPMLTQTASPVSAAVGGTVTINCQASQSVYNKNNLAWYQQKLGQPPKLLIYAASTLTSGVPSRFKGSGSGTQFTLTISDLECDDAATYYCAGDYSGGIYAFGGGTKVEIK

SEQ ID NO: 4817 - protein, 110 aa, synthetic construct
  REGION 1..110: note = anti-influenza_Chain
ELVMTQTPASVSAAVGGTVTISCQSSESVYKNNNLAWFQQKLGQPPKLLIYDASKLASGVPSRFSGSGSGTQFTLTISDLECDDAATYYCAGDYSGSNYAFGGGTKLEIK

SEQ ID NO: 4818 - protein, 110 aa, synthetic construct
  REGION 1..110: note = anti-influenza_Chain
EPMLTQTASSVSAAVGGSVTISCQSSQSVDSNNQLSWYQQKPGQPPKLLIYAASTLTSGVPSRFKGSGSGTQFTLTISDLECDDAATYYCAGDYSGGIYAFGGGTEVVVK

SEQ ID NO: 4819 - protein, 110 aa, synthetic construct
  REGION 1..110: note = anti-influenza_Chain
DPMLTQTAASVSAAVGGTVTISCQSSESVYKNNNLAWFQQKLGQPPTLLIWDASKLASGVPSRFSGSGSGTQFTLTISDLECDDAATYYCAGDYSGVNYAFGGGTEVVVK

SEQ ID NO: 4820 - protein, 110 aa, synthetic construct
  REGION 1..110: note = anti-influenza_Chain
ELVMTQTPASVSAAVGGTVTISCQSSESVYKNNNLAWFQQKLGQPPKLLIYDASKLASGVPSRFSGSGSGTQFTLTISDLECDDAATYYCAGDYSGSNYAFGGGTEVVVK

SEQ ID NO: 4821 - protein, 110 aa, synthetic construct
  REGION 1..110: note = anti-influenza_Chain
DPMLTQTASSVSATVGGTVTISCQSSQSVDNNKDLAWFQQKPGHSPKLLIYFASRLASGVPSRFKGSGSGTHFTLTISDLECDDAATYYCAGDYSGANYAFGGGTKLEIK

SEQ ID NO: 4822 - protein, 110 aa, synthetic construct
  REGION 1..110: note = anti-influenza_Chain
DPMLTQTASPVSAAVGGTVTINCQSSQSVYNNNRLSWFQQKPGQPPKLLIYSASTLASGVSSRFKGSGSGTQFTLTISDLECDDAATYYCAGDYSGGIYAFGGGTELEIL

SEQ ID NO: 4823 - protein, 110 aa, synthetic construct
  REGION 1..110: note = anti-influenza_Chain
ELVLTQTPASVSAAVGGTVSISCQSSQSVYKNNNLAWFQQKLGQPPTLLIWDASKLASGVPSRFSGSGSGTQFTLTISDLECDDAATYYCAGDYSGVNYAFGGGTKLEIK

SEQ ID NO: 4824 - protein, 110 aa, synthetic construct
  REGION 1..110: note = anti-influenza_Chain
ELDLTQTPASVSAAVGGTVTISCQSSESVYKNNNLAWFQQKLGQPPTLLIWDASKLASGVPSRFSGSGSGTQFTLTISDLECDDAATYYCAGDYSGVNYAFGGGTEVVVK

SEQ ID NO: 4825 - protein, 110 aa, synthetic construct
  REGION 1..110: note = anti-influenza_Chain
DIQMTQSPSSLSASVGDRVTITCQSSESVYKNNNLAWYQQKPGKPPKLLIWDASKLASGVPSRFSGSGSGTDFTLTISSLQPEDVATYYCAGDYSGVNYAFGGGTEVVVK

SEQ ID NO: 4826 - protein, 111 aa, synthetic construct
  REGION 1..111: note = anti-influenza_Chain
DIVMTQSPDSLAVSLGERATINCKSSQSVTFNNKNYLAWYQQKPGQPPKLLIYWASTRESGVPDRFSGSGSGTDFTLTISSLQAEDVAVYYCQQHYRTPPTFGQGTKVEIK

SEQ ID NO: 4827 - protein, 111 aa, synthetic construct
  REGION 1..111: note = anti-influenza_Chain
QSALTQPASVSGSPGQSITISCTGTGSDVGSSNLVSWYQQHPAKAPKLIIYEVTKRPSGVSNRFSGSKSGNTASLTISGLQAEDEADYYCCSYAGSSSSRVFGTGTKVTVL

SEQ ID NO: 4828 - protein, 111 aa, synthetic construct
  REGION 1..111: note = anti-influenza_Chain
QSVLTQPPSASGTPGQRVTISCSGSTSNIGSNAVNWYQQLPGTAPKLLIYSNNQRPSGVPDRFSGSKSGTSASLAISGLQSEDEADYYCAAWDDSLSGSWVFGGGTKLTVL

SEQ ID NO: 4829 - protein, 111 aa, synthetic construct
  REGION 1..111: note = anti-influenza_Chain
ETTLTQSPGTLSLSPGERATLSCRVSQSVSSNYLAWYQQKPGQAPRLLIYGASSRATGIPDRFSGSGSGTDFTLTISRLEPEDFAVYYCQQYGTSPRAFGHGTKVEIKRTV

SEQ ID NO: 4830 - protein, 111 aa, synthetic construct
  REGION 1..111: note = anti-influenza_Chain
QSVLTQPPSVSGAPGQRVTISCGGSRSNIGAGYDVHWYQQFPGTAPKVVIYGNNNRPSGVPDRFSGSKSGTSASLAITGLQAEDEANYYCQSYDTNLGGSIFGGGTQVTVL

SEQ ID NO: 4831 - protein, 111 aa, synthetic construct
  REGION 1..111: note = anti-influenza_Chain
NFMLTQPHSVSESPGKTVTISCTGSSGSIASNYVQWYQQRPGSAPTTVIYEDYQRPSGVPDRFSGSIDSSSNSASLTISGLKTEDEADYYCQSYDDSDHLIFGGGTKLTVL

SEQ ID NO: 4832 - protein, 111 aa, synthetic construct
  REGION 1..111: note = anti-influenza_Chain
QSMLTQPPSASGTPGQRVTISCSGSSSNIGSNTVNWFKHLPGTAPKLLIYRNDLRPSGVPDRFSGSKSGTSASLAISGLQSEDEADYYCATWDDSLNGFYVFGTGTKVTVL

SEQ ID NO: 4833 - protein, 111 aa, synthetic construct
  REGION 1..111: note = anti-influenza_Chain
DIQLTQSPSSLSASAGDRVSMTCRASQIISSSLNWYQQKPGKAPKLLIYAASNLQSGVPSRFSGSGSGTDFTLTISSLQPEDFATYYCQQSYSTPPELTFGGGTKVDIKRT

SEQ ID NO: 4834 - protein, 111 aa, synthetic construct
  REGION 1..111: note = anti-influenza_Chain
SYVLTQPPSASGTPGQRVTISCSGSTFNIGSNAVDWYRQLPGTAPKLLIYSNNQRPSGVPDRFSGSRSGTSASLAISGLQSEDEADYYCAAWDDILNVPVFGGGTKLTVLG

SEQ ID NO: 4835 - protein, 111 aa, synthetic construct
  REGION 1..111: note = anti-influenza_Chain
QSALTQPAAVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVLG

SEQ ID NO: 4836 - protein, 111 aa, synthetic construct
  REGION 1..111: note = anti-influenza_Chain
SYVLTQPPSVSGTPGQRVTISCSGSRSNVGDNSVYWYQHVPEMAPKLLVYKNTQRPSGVPARFSGSKSGTSASLAIIGLQSGDEADYYCVAWDDSVDGYVFGSGTKVTVLG

SEQ ID NO: 4837 - protein, 111 aa, synthetic construct
  REGION 1..111: note = anti-influenza_Chain
SVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLG

SEQ ID NO: 4838 - protein, 111 aa, synthetic construct
  REGION 1..111: note = anti-influenza_Chain
QSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLG

SEQ ID NO: 4839 - protein, 111 aa, synthetic construct
  REGION 1..111: note = anti-influenza_Chain
SYVLTQPPSASGTPGQRVTISCSGSSSNIGSNYVYWYQQLPGTAPKLLIYRDGQRPSGVPDRFSGSKSGTSASLAISGLRSDDEADYYCATWDDNLSGPVFGGGTKLTVLG

SEQ ID NO: 4840 - protein, 111 aa, synthetic construct
  REGION 1..111: note = anti-influenza_Chain
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVLG

SEQ ID NO: 4841 - protein, 111 aa, synthetic construct
  REGION 1..111: note = anti-influenza_Chain
TVLTQPPSVSGAPGQRVTISCTGSSSNIGAGYDVHWYQQLPGTAPKLLIYGNSNRPSGVPDRFSGSKSGTSATLGITGLQTGDEADYYCGTWDSSLSAYVFGTGTKVTVLG

SEQ ID NO: 4842 - protein, 111 aa, synthetic construct
  REGION 1..111: note = anti-influenza_Chain
GSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLG

SEQ ID NO: 4843 - protein, 111 aa, synthetic construct
  REGION 1..111: note = anti-influenza_Chain
EIVLTQSPGTLSLSPGERATLSCRASQSVSSSYLAWYQQKPGQAPRLLIFGASTRATGIPDRFSGSGSGTDFTLTISRLEPEDFAVFYCQQYGSLPLTFGGGTKVEIKGTV

SEQ ID NO: 4844 - protein, 111 aa, synthetic construct
  REGION 1..111: note = anti-influenza_Chain
EIVLTQSPGTLSLSPGERATLSCRASQSVRSNNLAWYQHKPGQAPRLLIFGASSRATGIPDRFSGSGSGTDFTLTISRLEPEDFAVYYCQQYGSSPALTFGGGTKVEIKRT

SEQ ID NO: 4845 - protein, 111 aa, synthetic construct
  REGION 1..111: note = anti-influenza_Chain
QSLEESGGGLVKPGGSLTLTCTVSGLSLYSNEINWVRQAPGNGLEWIGAIAGSGSADYASWAKGRSTITRNTDLNTVTLKMTSLTAADTATYFCASFWDLWGPGTLVTVSS

SEQ ID NO: 4846 - protein, 111 aa, synthetic construct
  REGION 1..111: note = anti-influenza_Chain
QSVEESGGGLVKPGGSLTLTCTVSGLSLYSNEINWVRQAPGNGLEWIGAIAGSGSADYASWAKSRSTITRNTNLNTVTLKMTSLTAADTATYFCASFWDLWGPGTLVTVSS

SEQ ID NO: 4847 - protein, 111 aa, synthetic construct
  REGION 1..111: note = anti-influenza_Chain
QSLEESGGGLVKPGGSLTLTCTVSGLSLYSNEINWVRQAPGNGLEWIGAIAGSGSADYASWAKSRSTITRNTNLNTVTLKMTSLTAADTATYFCASFWDLWGPGTLVTVSS

SEQ ID NO: 4848 - protein, 111 aa, synthetic construct
  REGION 1..111: note = anti-influenza_Chain
NIVLTQSPASLAVSLGQRATISCRASESVDIYGNSFMHWYQQKPGQPPKLLIYLASKLECGVCARFNGSGCRTDFTLAIDPVEGDDGATYYCQQNYEDPWTFGGGTKLEIK

SEQ ID NO: 4849 - protein, 111 aa, synthetic construct
  REGION 1..111: note = anti-influenza_Chain
NIVLTQSPASLAVSPGQRATISCRASESIDIYGNSFMHWYQKKPGQPPKLLIYRASNLESGVPARFNGSGSRTDFTLTIDPVEGDDGATYYCQQNYEDPWTFGGGTKLEIK

SEQ ID NO: 4850 - protein, 111 aa, synthetic construct
  REGION 1..111: note = anti-influenza_Chain
EIVLTQSPATLSLYPGERATLSCRASQSVSRYLAWYQQKPGQAPRLLIYDASNRATGIPARFSGSGSGTDFTLTISSLEPEDFAVYYCQQRSNWLKITFGQGTRLEIKGTV

SEQ ID NO: 4851 - protein, 112 aa, synthetic construct
  REGION 1..112: note = anti-influenza_Chain
DIVMTQSPDSLAVSLGERATINCKSSQSVLYSSNNKNYLAWYQQKPGQPPKLLIDWASTRESGVPDRFSGSGSGTDFTLTISNLQVEDVAVYYCQQYYRSPSFGQGTKLEIK

SEQ ID NO: 4852 - protein, 112 aa, synthetic construct
  REGION 1..112: note = anti-influenza_Chain
DIVMTQTPLSLSVTPGQPASISCKSSQSLLHSDGKTYLYWYLQKPGQSPQLLIYEVSNRFSGVPDRFSGSGSGTDFTLKISRVEAEDVGVYYCMQNILLPLTFGGGTKVEIK

SEQ ID NO: 4853 - protein, 112 aa, synthetic construct
  REGION 1..112: note = anti-influenza_Chain
EIVMTQTPLSLSVTPGQPASISCRSSQSLLHSDGKTYLYWYLQKPGQPPQLLISEVFNRFSGVPDRFSGSGSGTDFTLKISRVEAEDVGVYYCMQSLQLPLTFGGGTKVEIK

SEQ ID NO: 4854 - protein, 112 aa, synthetic construct
  REGION 1..112: note = anti-influenza_Chain
DIVMTQSPLSLPVTPGEPASISCRASQSLLHSNGYNYLDWYLQKPGQSPQLLIQLGSTRASGVPDRFSGSGSGTDFTLEISRVEAEDVGVYYCMQALQLPLAFGQGTRLEIK

SEQ ID NO: 4855 - protein, 112 aa, synthetic construct
  REGION 1..112: note = anti-influenza_Chain
DIVMTQSPLSLPVSPGEPASISCRSSQSLLHGNGYNYLDWYLQKPGQSPRLLIYLGSNRASGVPDRFSGSGSGTDFTLKISRVEAEDVGVYYCMQALQTPLTFGGGTKVEIK

SEQ ID NO: 4856 - protein, 112 aa, synthetic construct
  REGION 1..112: note = anti-influenza_Chain
QSVLTQPPSVSGAPGQRVTISCTGSSSNIGAGYDVHWYQQLPGTAPKLLIYDNNNRPSGVPDRFSGSKSGASASLAITGLQAEDEAHYYCQSYDNSLSGSVFGGGTQLTVLS

SEQ ID NO: 4857 - protein, 112 aa, synthetic construct
  REGION 1..112: note = anti-influenza_Chain
QSVLTQPPSVSGAPGQRVTISCTGSSSNIGSDYDVHWYKQLPGTAPKLLIFGNSNRPSGVPDRFSGSKSGTSASLAITGLQAEDEADYYCQSYDSSLSGFHVFGSGTKVTVL

SEQ ID NO: 4858 - protein, 112 aa, synthetic construct
  REGION 1..112: note = anti-influenza_Chain
QSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLG

SEQ ID NO: 4859 - protein, 112 aa, synthetic construct
  REGION 1..112: note = anti-influenza_Chain
EIVLTQSPGTLSLSPGERATLSCRASQSVSSSYLAWYQQKPGQAPRLLIYGASTRATGIPDRFSGRGSGTDFTLTISSLEPEDFAVYYCQNYGSPFLFTFGPGTKVDIKRTV

SEQ ID NO: 4860 - protein, 112 aa, synthetic construct
  REGION 1..112: note = anti-influenza_Chain
DIQLTQSPLSPPVTLGQPASISCRSSQSLLYTDGFTYLSWYHQRPGQSPRRLIYKISNRDSGVPDRFSGSGSGTDFTLKISRVEAEDVGVYYCMQATHWPLTFGEGTKVEIK

SEQ ID NO: 4861 - protein, 112 aa, synthetic construct
  REGION 1..112: note = anti-influenza_Chain
DIELTQEPSASGTPGQRVTISCSGDTSNIGSNTVSWFQLLPGTAPKLLIFTDNQRPSGVPGRFSGSKSGTSASLAISGLQSEDETDYYCAAWDDSLNGWVFGGGTKLTVLGQ

SEQ ID NO: 4862 - protein, 112 aa, synthetic construct
  REGION 1..112: note = anti-influenza_Chain
DIVLTQSPSASGSPGQSVTISCTGTSSDVGGYDYVSWYQQHPGKAPKLMIYEVRKRPSGVPDRFSGSKSGNTASLTVSGLQAEDEAYYYCASYAGTYIHLFGGGTKLTVLGQ

SEQ ID NO: 4863 - protein, 112 aa, synthetic construct
  REGION 1..112: note = anti-influenza_Chain
QEQLMESGGGLVKPGGSLTLTCTVSGLSLYSNEINWVRQAPGNGLEWIGAIAGSGSADYASWAKSRSTITRNTNLNTVTLKMTSLTAADTATYFCASFWDLWGPGTLVTVSS

SEQ ID NO: 4864 - protein, 112 aa, synthetic construct
  REGION 1..112: note = anti-influenza_Chain
QQQLMESGGGLVKPGGSLTLTCTVSGLSLYSNEINWVRQAPGNGLEWIGAIAGSGSADYASWAKSRSTITRNTDLNTVTLKMTSLTAADTATYFCASFWDLWGPGTLVTVSS

SEQ ID NO: 4865 - protein, 112 aa, synthetic construct
  REGION 1..112: note = anti-influenza_Chain
QQQLVESGGGLVKPGGSLTLTCRVSGLSLFSNEINWVRQAPGNGLEWIGAIGGGGSADYASWAKSRSTITRNTNLNTVTLRMTSLTAADTAAYFCASFWDLWGPGTLVTVSS

SEQ ID NO: 4866 - protein, 112 aa, synthetic construct
  REGION 1..112: note = anti-influenza_Chain
EVQLVESGGGLVKPGGSLRLSCAASGLSLFSNEINWVRQAPGKGLEWIGAIGGGGSADYASWAKSRFTISRDNAKNSLYLQMNSLRAEDTAVYFCASFWDLWGPGTLVTVSS

SEQ ID NO: 4867 - protein, 112 aa, synthetic construct
  REGION 1..112: note = anti-influenza_Chain
DIVMTQSPLSLPVTPGEPASISCRSSQSLLRSNGYNYLDWYLQKPGQSPQLLIYLGSNRASGVPDRFSGSGSGTDFTLKISRVEAEDVGVYYCMQALQTPYTFGQGTKLEIK

SEQ ID NO: 4868 - protein, 113 aa, synthetic construct
  REGION 1..113: note = anti-influenza_Chain
DIVMTQSPDFLPVSLGERATINCKSSQRVLYSSNNKNYLAWYQLKPGQPPKLIIYWASTRESGVPDRFSGSGSGTEFTLTISSLQAEDVAVYYCQQYYSRPYTFGQGTKLEIK

SEQ ID NO: 4869 - protein, 113 aa, synthetic construct
  REGION 1..113: note = anti-influenza_Chain
DIVMTQSPDSLAVSLGERATINCKSSQSVLYSSNNKNYLAWYQQKPGQPPKLLIYWASTRESGVPDRISGSGSGADFTLTISSLQAEDVAVYYCQQYFATPRTFGQGTKVEIK

SEQ ID NO: 4870 - protein, 113 aa, synthetic construct
  REGION 1..113: note = anti-influenza_Chain
DIVMTQSPDSLAVSLGERATINCKSSQSVLYSSNNKSHLAWYQQKPGQPPKLLIYWASTRESGVPDRFSGSGSGTDFTLIISSLQAEDVAVYYCQQYYFSPLTFGGGTKVEIK

SEQ ID NO: 4871 - protein, 113 aa, synthetic construct
  REGION 1..113: note = anti-influenza_Chain
DIVMTQSPDSLAVSLGERATINCRSSQSIFHNSNNENYLAWYQQKPGQPPKLLIYWASTRESGVPDRFSGSGSGTDFTLTISSLQAEDVAVYFCQQYYNAPLTFGGGTKVEIK

SEQ ID NO: 4872 - protein, 113 aa, synthetic construct
  REGION 1..113: note = anti-influenza_Chain
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKR

SEQ ID NO: 4873 - protein, 113 aa, synthetic construct
  REGION 1..113: note = anti-influenza_Chain
DIVLTQPPSVSVAPGQTATITCGGNYIGSKSVNWYQQRPGHAPVLVVYDDSDRPSGIPDRFSGSNSRSTATTATLTISRVEAGDEADYYCQVWETSEDLWVFGGGTKLTVLGQ

SEQ ID NO: 4874 - protein, 114 aa, synthetic construct
  REGION 1..114: note = anti-influenza_Chain
DVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVDIKR

SEQ ID NO: 4875 - protein, 114 aa, synthetic construct
  REGION 1..114: note = anti-influenza_Chain
DIQMTQSPDSLAVSLGEKATINCKSSQSILNSSNNKNYLAWYQQKPGQPPKLLIYWASTRESGVPDRFSGSGSGTDFTLTISSLQAEDVAVYYCQQYYSSPPTFGQGTKVEIKR

SEQ ID NO: 4876 - protein, 114 aa, synthetic construct
  REGION 1..114: note = anti-influenza_Chain
EIVLTQSPATLSLYPGERATLSCRASQSVSRYLAWYQQKPGQAPRLLIYDASNRATGIPARFSGSGSGTDFTLTISSLEPEDFAVYYCCDRQQRSNWLKITFGQGTRLEIKGTV

SEQ ID NO: 4877 - protein, 114 aa, synthetic construct
  REGION 1..114: note = anti-influenza_Chain
DIVMTQSQKFVSTSVGDRVSVTCKASQNVGSNVAWYQHKPGHSPTALIYSASHRYSGVPDRFTGSESGTDFTLTISNVQSEDLAEYFCQQYYSYPYTFGGGTKLEIKRADAAPT

SEQ ID NO: 4878 - protein, 114 aa, synthetic construct
  REGION 1..114: note = anti-influenza_Chain
DIEMTQSPLSLPVTPGESASISCRSSQSLLHSNGYNYLDWYLQKPGQSPQLLIYLGSSRASGVPDRFSGSGSGTDFTLKISRVEAEDVGVYYCMQGLQTPYTFGQGTKLEIKRT

SEQ ID NO: 4879 - protein, 114 aa, synthetic construct
  REGION 1..114: note = anti-influenza_Chain
DIEMTQSPLSLPVTPGEPASISCRSSQSLLHSNGYNHLAWYLQKPGRSPHLLIYLASTRASGVPDRFSGSGSGTDFTLKISRVEAEDVGIYYCMQSLQTSITFGQGTRLEIKRT

SEQ ID NO: 4880 - protein, 115 aa, synthetic construct
  REGION 1..115: note = anti-influenza_Chain
QVQLVQSGAEVKKPGSSVRVSCKTSGGTFSSYAVTWVRQAPGQGLEWMGGIIGMFGTTNYAQKFQGRLTITADEMTSTAYMELSSLRSEDTAVYYCARGSYYYETTLDYWGRGTL

SEQ ID NO: 4881 - protein, 115 aa, synthetic construct
  REGION 1..115: note = anti-influenza_Chain
EVQLVQSGAEVKKPGSSVKVSCKTSGGTFSSYAVTWVRQAPGQGLEWMGAIIGMFGTTNYAQKFQGRVTITADELTSTAYMELSSLRSDDTAVYYCARGSYYYESSLDYWGKGTL

SEQ ID NO: 4882 - protein, 115 aa, synthetic construct
  REGION 1..115: note = anti-influenza_Chain
QVQLVQSGAEVKKPGSSVKVSCKTSGGTFSSYAVTWVRQAPGQGLEWMGGIIGMFGTTNYAQKFQGRVTITADELTSTAYMELSSLRSEDTAVYYCARGSYYYESSLDYWGRGTL

SEQ ID NO: 4883 - protein, 115 aa, synthetic construct
  REGION 1..115: note = anti-influenza_Chain
EVQLVQSGAEVKKPGASVKVSCKASGYTFTGYYVYWVRQAPGQGLEWMGWISAYNGNTNYAQKFQGRVTITADKSTSTAYMELSSLRSEDTAVYYCARSRSLDVWGQGTTVTVSS

SEQ ID NO: 4884 - protein, 115 aa, synthetic construct
  REGION 1..115: note = anti-influenza_Chain
DIVMTQSPLSLPVTPGEPASISCRSSQSLLHSNGHIYFDWYLQKPGQSPQLLIYLVSKRASGVPDRFSGSGSGTDFTLKISRVEAEDVGVYYCMQALETPFTFGPGTKVHIKRTV

SEQ ID NO: 4885 - protein, 115 aa, synthetic construct
  REGION 1..115: note = anti-influenza_Chain
QSALTQPASVSGSPGQSITISCTGTSSDVGAYNYVSWYQHHPGKAPKLMIYDVTYRPSGVSTRFSGSKSGNTASLTISGLQAEDEADYYCSSQSRSSTLVIFGGGTKLTVLGQPK

SEQ ID NO: 4886 - protein, 115 aa, synthetic construct
  REGION 1..115: note = anti-influenza_Chain
DIVLTQSPVSLAVSLGESATVNCKSSQSVLSNSKNLNYLAWYQHKPGQPPKLLIYWASTRESGVPDRFSGSGSGTDFTLTISSLQAEDVAVYYCQQHYSIPLTFGPGTKVDIKRT

SEQ ID NO: 4887 - protein, 116 aa, synthetic construct
  REGION 1..116: note = anti-influenza_Chain
DIVLTQSPLSLPVTPGEPASISCRSSQSLLDSNGYNYLDWYLQKPGQSPQLLIYLASYRAPGVPDRFSGSGSGTDFTLKISRVEAEDVGLYYCMQALQTPPMYTFGQGTKLEIKRT

SEQ ID NO: 4888 - protein, 117 aa, synthetic construct
  REGION 1..117: note = anti-influenza_Chain
LESGGGLVQPGGSLRLSCAASGITFSSYAMSWVRQAPGKGLEWVSTVNSGGGSTYYGDSVRGRFTISRDNSKSTLYLQLNSLRAEDTAIYYCAKDKGRPIFGLVTPSYYMDVWGNGT

SEQ ID NO: 4889 - protein, 117 aa, synthetic construct
  REGION 1..117: note = anti-influenza_Chain
QEQLVQSGAEVKKPGASVKVSCKASRKSFIGYYVHWVRQAPGQGLEWMGWISPDSDATKYAQKFQGSVIMTRDTSVSTVYMELSRLTSDDTALYYCLLFRGGNSLSWGQGTLVTVSS

SEQ ID NO: 4890 - protein, 117 aa, synthetic construct
  REGION 1..117: note = anti-influenza_Chain
QVQLQESGPGLVKPSETLSLTCTVSGSSISNYYWSWIRQSPGKGLEWIGFIYYGGNTKYNPSLKSRVTISQDTSKSQVSLTMSSVTAAESAVYFCARASCSGGYCILDYWGQGTLVT

SEQ ID NO: 4891 - protein, 117 aa, synthetic construct
  REGION 1..117: note = anti-influenza_Chain
EVQLVESGGGLVQPGGSLRLSCAASGFTFSIYAMSWVRQAPGKGLEWVSAISSSGDSTYYADSVKGRFTISRDNARNTLYLQMNSLRAEDTAVYYCARAYGYTFDPWGQGTLVTVSS

SEQ ID NO: 4892 - protein, 118 aa, synthetic construct
  REGION 1..118: note = anti-influenza_Chain
QVQLQESGPGLVKPSETLSLTCTVSGYSFDSGYYWGWLRQPPGKGLEWIGSIYHSRNTYYNPSLKSRVTISVDTSKNQFSLQLSSVTAADTAVYYCARGTWYSSNLRYWFDPWGKGTL

SEQ ID NO: 4893 - protein, 118 aa, synthetic construct
  REGION 1..118: note = anti-influenza_Chain
QPVLTQPPSASASLGASVTLTCTLSSAYSNYKVDWYQQRPGKGPRFVMRVGTGGIVGSKGDGIPDRFSVLGSGLNRYLTIKNIQEEDESDYHCGADHGSGSNFVSPYVFGGGTKLTVL

SEQ ID NO: 4894 - protein, 118 aa, synthetic construct
  REGION 1..118: note = anti-influenza_Chain
QVQLVQSGADVKKPGSSVTVSCKASGGSFSNYGINWVRQAPGQGLEWMGGIIPLINAPNYAPKFQGRVTITADMFSNIVSLQLTSLRTDDTAVYYCARRKMTTAIDYWGQGTLVTVSS

SEQ ID NO: 4895 - protein, 118 aa, synthetic construct
  REGION 1..118: note = anti-influenza_Chain
QVQLVQSGAEVKKPGSSVKVSCRESGGTFNGYTITWVRQAPGQGLEWMGGIIPMMGTVNYAQKLQGRVTITTDYFTKTAYMDLNNLRSEDTAMYYCVKIRYTGQQLLWGQGTLVTVSS

SEQ ID NO: 4896 - protein, 118 aa, synthetic construct
  REGION 1..118: note = anti-influenza_Chain
QVQLVQSGAEVKKPGASVKVSCKASGHTFTGYYIHWVRQAPGQGLEWMGWINPDSGATSSAQNFQGRVTMTGDTSSSTAYMELSRLSFDDTAVYYCARVLFTSPFDFWGEGTLVTVSS

SEQ ID NO: 4897 - protein, 118 aa, synthetic construct
  REGION 1..118: note = anti-influenza_Chain
QPVLSQPPSASASLGASVTLTCTLSSGFDNYQVAWYQQRPGKGPRFVMRVGNGGNVASKGDGIPDRFSVSGSGLNRYLTIKNIQEDDESDYYCGADHGSGNNFVSPYVFGGGTKLTVL

SEQ ID NO: 4898 - protein, 118 aa, synthetic construct
  REGION 1..118: note = anti-influenza_Chain
EVQLVESGAEVKKPGASVKVSCKASGYTFSRYYIHWVRQAPGQELEWMGWINPDSGDTNYAQKFRGRVTMARDTSISTVYMELNSLRYDDTAVYFCARIIWSSSGMDVWGQGTTVTVS

SEQ ID NO: 4899 - protein, 118 aa, synthetic construct
  REGION 1..118: note = anti-influenza_Chain
EVQLLESGGGVVQPGRSLRLSCAASGFTFRTYGMHWVRQAPGKGLEWVAVISHDGNLKYYGGSVKGRFTISRDNSKNALYLQMNSLRVDDTALYYCARGIGITDAFDIRGQGTMVVVS

SEQ ID NO: 4900 - protein, 118 aa, synthetic construct
  REGION 1..118: note = anti-influenza_Chain
EVQLVESGGGLVQPGGSLRLSCTASGLSVSSTYMNWVRQAPGKGLEWVSVFYSETRTYYADSVKGRFTVSRHNSNNTLYLQMNSLRVEDTAVYYCARVQRLSYGMDVWGQGTTVTVSS

SEQ ID NO: 4901 - protein, 118 aa, synthetic construct
  REGION 1..118: note = anti-influenza_Chain
EVQLVESGGGLVQPGGSLRLSCTASGLSVSSTYMNWVRQAPGKGLEWVSVFYSETRTYYADSVKGRFTVSRHNSNNTLYLQMNSLRAEDTAVYYCARVQRLSYGMDVWGQGTTVTVSS

SEQ ID NO: 4902 - protein, 118 aa, synthetic construct
  REGION 1..118: note = anti-influenza_Chain
DMQLVESGGGLVPPGGSLRLSCAASGFSVSDNYINWVRQAPGKGLDWVSVFYSADRTSYADSVKGRFTVSSHDSKNTVYLQMNSLRAEDTAVYYCARVQKSYYGMDVWGQGTTVTVSS

SEQ ID NO: 4903 - protein, 119 aa, synthetic construct
  REGION 1..119: note = anti-influenza_Chain
EVQLVESGPVLVKPTETLTVTCTVSGFSVDNDRMGVSWIRQPPGKALEWLAHIFSNDEKSYSTSLRSRLTISKDTSKRQVVLSMTDMDPVDTATYYCARAPSEYAAMDVWGQGTMVTVS

SEQ ID NO: 4904 - protein, 119 aa, synthetic construct
  REGION 1..119: note = anti-influenza_Chain
QVQVVQSGTEVKKPGSSVKVSCQTSGGRFMSYAITWVRQAPGQGLEWMGGIVPVFGTANYAQKFQGRVTITTDDSTRTAYMELSSLRSEDTAVYYCGFRYGSGYGFDSWGQGTLVTVSS

SEQ ID NO: 4905 - protein, 119 aa, synthetic construct
  REGION 1..119: note = anti-influenza_Chain
EVQLVESGAGVKKPGSSVKVSCKASGNTFSSNAISWVRQAPGQGLEWMGGILGMLRTTNYAQKFQGRVTITADEFMNTAYMELSSLTSEDTAVYYCARSSGYYPDYFHLWGQGTLVTVS

SEQ ID NO: 4906 - protein, 119 aa, synthetic construct
  REGION 1..119: note = anti-influenza_Chain
QVQLQESGPGLVKPSETLSLTCTVSGSSISNYYWSWIRQSPGKGLEWIGFIYYGGNTKYNPSLKSRVTISQDTSKSQVSLTMSSVTAAESAVYFCARASCSGGYCILDYWGQGTLVTVS

SEQ ID NO: 4907 - protein, 119 aa, synthetic construct
  REGION 1..119: note = anti-influenza_Chain
EVQLVESGGGLVQPGGSLRISCAASGFTVSSNYMSWVRQAPGKGLEWVSVIYSGGSTYYADSVKGRFSFSRDNSKNTVFLQMNSLRAEDTAVYYCARCLSRMRGYGLDVWGQGTTVTVS

SEQ ID NO: 4908 - protein, 119 aa, synthetic construct
  REGION 1..119: note = anti-influenza_Chain
QVQLQESGPGLVKPSETLSLTCTVSGASISSDYWSWIRLPPGKGLEWIGYIYNRGSTKYTPSLKSRVTISLDTAENQFSLRLRSVTAADTAIYYCARHVGGHTYGIDYWGQGTLVTVSS

SEQ ID NO: 4909 - protein, 119 aa, synthetic construct
  REGION 1..119: note = anti-influenza_Chain
QVQLQESGPGLVKPSETLSLTCTVSGASISSDYWSWIRLPPGKGLEWIGYIYNRGSTKYTPSLKSRVTISLDTAENQFSLRLRSVTAADTAVYYCARHVGGHTYGIDYWGQGTLVTVSS

SEQ ID NO: 4910 - protein, 119 aa, synthetic construct
  REGION 1..119: note = anti-influenza_Chain
QVQLQESGPRLVKPSESLSLTCTVSGGSISNSFWGWIRQPPGEGLEWIGYVYNSGNTKYNPSLKSRVTISRDTSKSQLYMKLRSVTAADTAVYYCARHDDASHGYSISWGHGTLVTVSS

SEQ ID NO: 4911 - protein, 119 aa, synthetic construct
  REGION 1..119: note = anti-influenza_Chain
EVHLQQSGPELVKPGASVKMSCEASGYTFTDYYVAWVKQSPGESFEWIGRVNPYSGGTSYNQKFKGKATLIVDKSSSTAYMELSSLTSEDSAVYYCARWDYGVYEGYIDYWGQGSALTV

SEQ ID NO: 4912 - protein, 120 aa, synthetic construct
  REGION 1..120: note = anti-influenza_Chain
QVQLVQPGAEVKKPGSSVKVSCKASGGIFSPYAISWVRQAPGQGLEWMGGIIAIFGTTNYAQKFQGRVTITADKSTTTAYLELNSLRFEDTAVYYCARGGRYYVDYFDYWGQGTLVSVSS

SEQ ID NO: 4913 - protein, 120 aa, synthetic construct
  REGION 1..120: note = anti-influenza_Chain
QVQLQESGPDLVKPGASVKMSCKASGYSFTYYHMHWVKQTHGKSLEWIGRIPYNGGTNYSQRFKGKAVFTVDMSSSTAYMELRSLTSEDSAVYYCARDANYEGDWYFDVWGQGTTVTVSS

SEQ ID NO: 4914 - protein, 120 aa, synthetic construct
  REGION 1..120: note = anti-influenza_Chain
QVQLVQSGAEVKEPGSAMKVSCKASGGTFSSDAFCWVRQAPGRGLEWMGGIIPVFQTANYGPNFQGRVTISADVYTTTLYLELSGLTSEDTAVYFCARSGDGYNYYFPLWGQGTLVTVSS

SEQ ID NO: 4915 - protein, 120 aa, synthetic construct
  REGION 1..120: note = anti-influenza_Chain
QITLRESGPTLVKPTQTLTLTCTFSGFSLSTNGVNVGWIRQPPGKALEWLALIYWDDDKRYSPSLKRRLTITKDTSKNQVVLTLTNMDPVDTATYYCAHRPDFYGDFEYWGPGTLVTVSS

SEQ ID NO: 4916 - protein, 120 aa, synthetic construct
  REGION 1..120: note = anti-influenza_Chain
QVQLVQSGSEVKKPGTSVKVSCTASGSVFTNYGISWVRQAPGQGLEWMGGIIPLFGAAKYAQKFQGRVTITADESTKTVYMELSRLTSKDTAIYFCAKAPRVYEYYFDQWGQGTPVTVSS

SEQ ID NO: 4917 - protein, 120 aa, synthetic construct
  REGION 1..120: note = anti-influenza_Chain
QVQLVQSGADLKKPGASVKVSCKASGYTFTDYYIHWVRQAPGQGLEWMGWINPESGDTKYAQKFQGRVTMTRDTSITTAYMELGRLRSDDTAVYYCARDVSTTWSWFAPWGQGTLVTVSS

SEQ ID NO: 4918 - protein, 120 aa, synthetic construct
  REGION 1..120: note = anti-influenza_Chain
QVQLQESGPGLVKPSETLSLTCSVSGGSINYYYWSWIRQPPGKGLECIGYISDTGRTYYNPSLRSRVTISVDTSKNQFSLNLTSMTAADTAVYYCARDPTGSRQKNAFDMWGQGTMVTVS

SEQ ID NO: 4919 - protein, 120 aa, synthetic construct
  REGION 1..120: note = anti-influenza_Chain
QVQLQESGPRVVRPSETLSLTCTVSGGSISSYNWIWIRQPPGKGLEWIGHIYDYGRTFYNSSLQSRPTISVDASKNQLSLRLTSVTASDTAVYYCARPLGILHYYAMDLWGQGTTVTVSS

SEQ ID NO: 4920 - protein, 120 aa, synthetic construct
  REGION 1..120: note = anti-influenza_Chain
QVQLQESGPGLVKPSETLSLTCSVSGGSISSDFWSWIRQPPGKGLEWIGYVYNRGSTKYSPSLKSRVTISADMSKNQFSLNMSSVTAADTAVYYCAKNGRSSTSWGIDVWGKGTTVTVSS

SEQ ID NO: 4921 - protein, 120 aa, synthetic construct
  REGION 1..120: note = anti-influenza_Chain
QVQLQESGPGLVKPSETLSLTCTVSGGSISAYHWSWIRQPPGKGLEWIGHIFDSGSTYYNPSLKSRVTISLDASKNQLSLRLTSVTASDTAIYYCARPLGSRYYYGMDVWGQGTTVTVSS

SEQ ID NO: 4922 - protein, 120 aa, synthetic construct
  REGION 1..120: note = anti-influenza_Chain
EVQLVESGGGLVQPGGSLRISCAASGFTVSSNYMSWVRQAPGKGLEWVSVIYSGGSTYYADSVKGRFSFSRDNSKNTVFLQMNSLRAEDTAVYYCARCLSRMRGYGLDVWGQGTTVTVSS

SEQ ID NO: 4923 - protein, 120 aa, synthetic construct
  REGION 1..120: note = anti-influenza_Chain
QVQLQESGPGLVKPSETLSLTCTVSGSSISNYYWSWIRQSPGKGLEWIGFIYYGGNTKYNPSLKSRVTISQDTSKSQVSLTMSSVTAAESAVYFCARASCSGGYCILDYWGQGTLVTVSS

SEQ ID NO: 4924 - protein, 120 aa, synthetic construct
  REGION 1..120: note = anti-influenza_Chain
QVQLQQSGAEVKKPGSSVKVSCKVSGVIFSGSAISWVRQAPGQGLEWMGGISPLFGTTNYAQKFQGRVTITADQSTNTTYMEVNSLRYEDTAVYFCARGPKYYSEYMDVWGKGTTVTVSS

SEQ ID NO: 4925 - protein, 120 aa, synthetic construct
  REGION 1..120: note = anti-influenza_Chain
QVQLVQSGAEVKKPGSSVKVSCKASGGTFSSYAISWVRQAPGQGLEWMGGIMGMFGTTNYAQKFQGRVTITADEFTSAAYMELRSLRSEDTAVYYCARSSGYYPEYFQDWGQGTLVTVSS

SEQ ID NO: 4926 - protein, 120 aa, synthetic construct
  REGION 1..120: note = anti-influenza_Chain
QMQLVQSGAEVKKPGSSVKVSCKASGGTFSSYAITWVRQAPGQGLEWMGGIIGMFGSTNYAQNFQGRVTITADESTSTAYMELSSLRSEDTAVYYCARSTGYYPAYLHHWGQGTLVTVSS

SEQ ID NO: 4927 - protein, 120 aa, synthetic construct
  REGION 1..120: note = anti-influenza_Chain
EVQLVESGAEVKKPGSSVKVSCKASGGTFSSYGISWVRQAPGQGLEWMGDIIGMFGSTNYAQNFQGRLTITADESTSTAYMELSSLRSEDTAVYYCARSSGYYPAYLPHWGQGTLVTVSS

SEQ ID NO: 4928 - protein, 120 aa, synthetic construct
  REGION 1..120: note = anti-influenza_Chain
EVQLVESGAEVKKPGSSVKVSCKASGGTFSSYAISWVRQAPGQGLEWMGGIIGMFGTANYAQKFQGRVTITADEFTSTAYMELSSLRSEDTAVYYCARGNYYYESSLDYWGQGTLVTVSS

SEQ ID NO: 4929 - protein, 120 aa, synthetic construct
  REGION 1..120: note = anti-influenza_Chain
QVQLVQSGAEVKKPGSSVKVSCKASGGPFRNFAINWVRQAPGQGLEWMGGIIAVFGTTKYAHKFQGRVTITADDSTNTAYMELGSLKSEDTAVYYCARGPHYYSSYMDVWGEGTTVTVSS

SEQ ID NO: 4930 - protein, 120 aa, synthetic construct
  REGION 1..120: note = anti-influenza_Chain
EVALVETGAEVKKPGSSVKVPCKSSGSPFRSNAVSWVRQAPGQGLEWVGGILGVFGSPSYAQKFQGRVTITADESTNTVHMELRGLRSEDTAVYYCARGPTYYYSYMDVWGKGTTVTVSS

SEQ ID NO: 4931 - protein, 120 aa, synthetic construct
  REGION 1..120: note = anti-influenza_Chain
QMQLVQSGAEVKKPGSSVKVSCKASGGTFSSYAISWVRQAPGQGLEWMGGIFGMFGTANYAQKFQGRVTITADEFTSAAYMELSSLGSEDTAMYYCARSSGYYPQYFQDWGQGTLVTVSS

SEQ ID NO: 4932 - protein, 120 aa, synthetic construct
  REGION 1..120: note = anti-influenza_Chain
QVQLVQSGAEVKKPGSSVKVSCKASGVTFSYYAMSWVRQAPGQGLEWMGGISPMFGTTTYAQKFQGRVTITADDSTSTAYMEVRSLRSEDTAVYYCARSSNYYDSVYDYWGQGTLVTVSS

SEQ ID NO: 4933 - protein, 120 aa, synthetic construct
  REGION 1..120: note = anti-influenza_Chain
EVQLVETGAEVKKPGSSVKVPCKSSGSPFRSNAVSWVRQAPGQGLEWVGGILGVFGSPSYAQKFQGRVTITADESTNTVHMELRGLRSEDTAVYYCARGPTYYYSYMDVWGKGTTVTVSS

SEQ ID NO: 4934 - protein, 120 aa, synthetic construct
  REGION 1..120: note = anti-influenza_Chain
QVHLVQSGAEVRKPGASVKVSCKVSGYTLNELSIHWLRQAPGRGLEWMGSFDPEDGETIYAQKFQGRVTMTGDTSTDTAYLELTSLRSEDTALYYCARGWGAVTSPFDFWGQGTLVTVSS

SEQ ID NO: 4935 - protein, 120 aa, synthetic construct
  REGION 1..120: note = anti-influenza_Chain
EVQLVQSGAEVKKPGSSMKVSCKASGSIFSNYGISWVRQAPGQGLEWMGGIIPIFGAANYAQKFQGRVTITADESTSTVYMEVRSLRSEDTAVYYCARRQQLYKGYYHHWGQGTLVTVSS

SEQ ID NO: 4936 - protein, 120 aa, synthetic construct
  REGION 1..120: note = anti-influenza_Chain
QVQLVQSGAGVKKPGSSMKVSCKASGSIFSNYGISWVRQAPGQGLEWMGGIIPIFGAANYAQKFQGRVTITADESTSTVYMEVRSLRSEDTAVYYCARRQQLYKGYYHHWGQGTLVTVSS

SEQ ID NO: 4937 - protein, 120 aa, synthetic construct
  REGION 1..120: note = anti-influenza_Chain
QVQLQESGPGLVKPSETLSLTCTVSGGLIGTGSYYWGWIRQTPGKGMEWIGSISYSGSTYYHPSLKSRVTISDDTSKNQLFLKLRSVTAADTAQYYCARYNWGIRYFDFWGRGTLVTVSS

SEQ ID NO: 4938 - protein, 120 aa, synthetic construct
  REGION 1..120: note = anti-influenza_Chain
QVQLVQSGAEVRKPGSSVKVSCKVSGGIIRKYAINWVRQAPGQGLEWMGGIIAIFNTANYAQKFQGRVTITADESTSTVYMELSSLRSEDTALYYCARGMNYYSDYFDYWGQGSLVTVSP

SEQ ID NO: 4939 - protein, 120 aa, synthetic construct
  REGION 1..120: note = anti-influenza_Chain
QVQLVQSGGGVVQPGRSLRLSCAASGFTFRSHAMHWVRQAPGKGPEWVALISYDEVNKFYADSVKGRFTISRDVSKNTVFLQMNSLSADDTAVYYCARGHSGSYRLFDFWGQGTLVTVSS

SEQ ID NO: 4940 - protein, 120 aa, synthetic construct
  REGION 1..120: note = anti-influenza_Chain
QVQLVESGGGLVQPGGSLRLSCAASGFIFGDFAIHWVRQASGKGLEWVARIRSGLNRFETAYAASVEGRLTISRDDSKSMAYLQMNNVKAEDTAVYLCTYLVGAVGFQHWGQGTLVTVSS

SEQ ID NO: 4941 - protein, 120 aa, synthetic construct
  REGION 1..120: note = anti-influenza_Chain
QVQLVESGGGVVQPGRSLRLSCAASGFTFSSYGIYWVRQAPGKGLEWVAFISYDEINKFYADSVKGRFTISRDNSKNTVFLQMNSLRDEDTAVYYCAKPLRGSYRYFDLWGRGTVVTVSS

SEQ ID NO: 4942 - protein, 121 aa, synthetic construct
  REGION 1..121: note = anti-influenza_Chain
QVQLQESGPDLVKPGASVMISCKASGYSFTYYYMHWVKQSHGKTLEWIGRIYPYNGDTNYNRRFKDKAILTVDESSSTAYMELRSLTSEDSAVYFCARDANYEGDWYFDVWGQGTTVTVSS

SEQ ID NO: 4943 - protein, 121 aa, synthetic construct
  REGION 1..121: note = anti-influenza_Chain
QVQLVQSGGGVVQPGRSLRLSCAASGFTFSSYAMHWVRQAPGKGLEWVAIISYDGNDQYYTDSVKGRFTISRDSSKVYLQMHRLRPEDTAVYYCAKEFETSGYFHGSFDYWGQGILVTVSS

SEQ ID NO: 4944 - protein, 121 aa, synthetic construct
  REGION 1..121: note = anti-influenza_Chain
QVQVVQSGAEVKKPGSSVRVSCQASGGTFMNYAIIWVRRAPGQGLEWMGGIIPVFPTPNYAQMFQGRVTISTDESRSTSFLELTNLRYEDTAVYYCARRIYHGGNSGFDFWGQGTLVTVSS

SEQ ID NO: 4945 - protein, 121 aa, synthetic construct
  REGION 1..121: note = anti-influenza_Chain
QVQLQESGPGLLKPSDTLALTCTVSGGSITSDYWSWIRQPPGRGLDWIGFFYNGGSTKYNPSLKSRVTISADTSKNQLSLKLTSVTAADTGVYYCARHDAKFSGSYYVASWGQGTRVTVSS

SEQ ID NO: 4946 - protein, 121 aa, synthetic construct
  REGION 1..121: note = anti-influenza_Chain
QVQLQESGPGLLKPSDTLALTCTVSGGSITSDYWSWIRQPPGRGLDWIGFFYNGGSTKYNPSLKSRVTISADTSKNQLSLKLTSVTAADTGVYYCARHDVKFSGSYYVASWGQGTRVTVSS

SEQ ID NO: 4947 - protein, 121 aa, synthetic construct
  REGION 1..121: note = anti-influenza_Chain
QVQLQESGPGLVKPSETLSVTCKVSGDSISSYSWSWIRQPPGKGLEWVGYLYYSGSTKYNPSLKSRTTISVDTSTNQLSLKLSFVTAADTAVYFCARTGSESTTGYGMDVWGQGTTVTVSS

SEQ ID NO: 4948 - protein, 121 aa, synthetic construct [sequence omitted]

SEQ ID NO: 4949 - protein, 121 aa, synthetic construct
  REGION 1..121: note = anti-influenza_Chain
QVQLVQSGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSS

SEQ ID NO: 4950 - protein, 121 aa, synthetic construct
  REGION 1..121: note = anti-influenza_Chain
EVQLVETGAEVKKPGASVKVSCKASGYTFTSYYMHWVRQAPGQGLEWMGWINPNSGGTNYAQKFQGRVTMTRDTSISTAYMELSRLRSDDTAVYYCAREGKWGPQAAFDIWGQGTMVTVSS

SEQ ID NO: 4951 - protein, 121 aa, synthetic construct
  REGION 1..121: note = anti-influenza_Chain
EVQLVESGAEVKKPGSSVKVSCKASGGTFSFYSMSWVRQAPGQGLEWMGGIIPMFGTTNYAQKFQGRVTITAVESTSTAYMEVSSLRSEDTAVYYCARGDKGIYYYYMDVWGKGTTVTVSS

SEQ ID NO: 4952 - protein, 121 aa, synthetic construct
  REGION 1..121: note = anti-influenza_Chain
EVQLVETGAEVKKPGSSVKVSCKASGGTFRTHAISWVRQAPGQGLEWMGGIIAIFGTANYAQKFQGRITITADESTSTAYMELSSLRSEDTAVYFCARGSGYHISTPFDNWGQGTLVTVSS

SEQ ID NO: 4953 - protein, 121 aa, synthetic construct
  REGION 1..121: note = anti-influenza_Chain
EVQLVQSGAEVKKPGSSVKVSCKASGGIFRSNSISWVRQAPGQGLEWMGGIFALFGTTDYAQKFQGRVTITADESSTTVYLELSSLTSEDTAVYYCARGSGYTTRNYFDYWGQGTLVTVSS

SEQ ID NO: 4954 - protein, 121 aa, synthetic construct
  REGION 1..121: note = anti-influenza_Chain
EVQLVESGAEVKKPGSSVKVSCKASGGIFNSYAISWVRQAPGQGLEWMGGIIAIFHTPKYAQKFQGRVTITADESTNTAYMELRSLKSEDTALYYCARGSTYDFSSGLDYWGQGTLVTVSS

SEQ ID NO: 4955 - protein, 121 aa, synthetic construct
  REGION 1..121: note = anti-influenza_Chain
QVQLVQSGAEVKKPGSSVKVSCKSSGGNFNNYAVSWVRQAPGQGLEWMGGISPIFGSTNHAQKFQGRVTISADIFTNTAYMELSSLRSDDTAIYYCARGRGYYFYHAMDVWGQGSTVTVSS

SEQ ID NO: 4956 - protein, 121 aa, synthetic construct
  REGION 1..121: note = anti-influenza_Chain
QVQLVQSGAEVKKPGSSVKVSCKASGGTFNNYAINWVRQAPGQGLEWMGGISPIFGSVNYAQKLQGRVTITADVFTSTAYMELSSLRSEDTAVYYCAKGSGYYYYYGLDVWGLGTTVTVSS

SEQ ID NO: 4957 - protein, 121 aa, synthetic construct
  REGION 1..121: note = anti-influenza_Chain
QVQLVESGGGVVQPGRSLRLSCAASGFTFTNYAMHWVRQAPGKGLEWVAVISFDEDNKSYADYVKGRFTISRDNSNNRLYLQMNSLRAEDTAVYYCARGPEGVWGRSIDSWGQGTLVTVSS

SEQ ID NO: 4958 - protein, 121 aa, synthetic construct
  REGION 1..121: note = anti-influenza_Chain
QVQLVQSGGDLVQPGGSLRLSCAASGFTFSRYSMNWVRQAPGMGLEWVAYISDTSRTIYYADSVKGRFTISRDNAKNSLYLQMKSLRDEDTAVYYCARDPDTPFVRAFDSWGQGTLVTVSS

SEQ ID NO: 4959 - protein, 121 aa, synthetic construct
  REGION 1..121: note = anti-influenza_Chain
QVQLVESGGGLVQPGGSLRLSCVASGFTFSRFSMNWVRQAPGMGLEWVSYISDTGRTIYYADSVKGRFTISRDNDKNTLYLQMKSLRDEDSAFYYCARDPDTPFVRAFDSWGQGVLVTVSS

SEQ ID NO: 4960 - protein, 121 aa, synthetic construct
  REGION 1..121: note = anti-influenza_Chain
QVQLQESGPDLVKPGASVKMSCKASGYSFTYYHMHWVKQTHGKSLEWIGRIYPYNGGTNYSQRFKGKAVFTVDMSSSTAYMELRSLTSEDSAVYYCARDANYEGDWYFDVWGQGTTVTVSS

SEQ ID NO: 4961 - protein, 122 aa, synthetic construct
  REGION 1..122: note = anti-influenza_Chain
QGQLVQSGAEVKKSGSSVKVSCKTSGGTFNSHAISWVRQAPGQGLEWIGGIIPMFGTTNYAQKLKGRIAITADQLPTTAYLELSSLRSEDTAVYYCARGQRYYYDRDGMDVWGQGTMVTVSS

SEQ ID NO: 4962 - protein, 122 aa, synthetic construct
  REGION 1..122: note = anti-influenza_Chain
QVHLVQSGAEVKKPGSSVRLSCSASGGPFSGFAISWLRQAPGQGLEWLGGISAVFGTATYAQKFQGRVTITADQFTSTSHMDLSRLTYDDTAVYYCARSGGYLPQNNWIDPWGQGTLVIVSS

SEQ ID NO: 4963 - protein, 122 aa, synthetic construct
  REGION 1..122: note = anti-influenza_Chain
QVQLVQSGAEVKKAGSSVKVSCQSSGVTFSMYAVSWVRQAPGQGLEWMGGIIPLFGTTTYAQKFEGRLTITADTSTNMAYLELRSLRSEDTAVYFCARAGTTVTRFNWFDPWGQGTLVTVSS

SEQ ID NO: 4964 - protein, 122 aa, synthetic construct
  REGION 1..122: note = anti-influenza_Chain
QVQLVQSGAEVKKPGSSLKVSCKASGVTFSMYTISWVRQAPGQGLEWMGGIIPLFGTANYEQKFQGRVTITADTSTNTAYMELSSLRSEDTAVYYCARAGTTLTRFNWFDPWGQGTLVTVSS

SEQ ID NO: 4965 - protein, 122 aa, synthetic construct
  REGION 1..122: note = anti-influenza_Chain
MADNMTTTQIEWRMKKMAIGSSTHSSSVLMKDIQSQFEQLKLRWESYPNLVKSTDYHQKRETIRLATEELYLLSKRIDDSILFHKTVIANSSIIADMIVSLSLLETLYEMKDVVEVYSRQCL

SEQ ID NO: 4966 - protein, 122 aa, synthetic construct
  REGION 1..122: note = anti-influenza_Chain
EVQLVQSGGGLVQPGGSLRLACVVSGFTVTSNYITWVRQAPGKGLEWVSVIYSHGRAYYSASVNGRFTISRHTSKNTVYLEMNSLRPEDTAVYYCAGGGLVGGYDEYFFDYWGQGTLATVSS

SEQ ID NO: 4967 - protein, 122 aa, synthetic construct
  REGION 1..122: note = anti-influenza_Chain
QVQLVQSGAEVKKPGASVKVSCKASGYTFTGYYMHWVRQAPGQGLEWMGWINPNSGDTNYAQKFQGRVTMTRDTSITTAYMELSSLRSDDTAVYYCARDSPYSSSWSFFDYWGQGPLVTVSS

SEQ ID NO: 4968 - protein, 122 aa, synthetic construct
  REGION 1..122: note = anti-influenza_Chain
EVQLVESGGGLVQPGGSLRLSCAASGFIFRNYWMSWVRQAPGKGLEWVANIKQDGREKYYVDSLRGRVNISRDNAENSLYLHMNSLRVEDTAVYFCARARMVVVTGDGFDVWGHGTMVTVSS

SEQ ID NO: 4969 - protein, 122 aa, synthetic construct
  REGION 1..122: note = anti-influenza_Chain
EVQLLESGGGLVQPGGSLRLSCAASGFAFSSYGMSWVRQAPGKGLEWVSAFSGSGTSTYYADSVKGRFTISRDKSKNTLYLQMNSLRAEDTAIYYCAKPPGPYIVVAGLFENWGRGTLVTVS

SEQ ID NO: 4970 - protein, 122 aa, synthetic construct
  REGION 1..122: note = anti-influenza_Chain
EVQLVESGGGVVQPGRSLRLSCAASGFSFSNYAMHWVRQAPGKGLEWVALISFDGSDKYYADSVKGRFTMSRDNSKNTLYLQMNSLRAEDTAVYYCARDEPYCGGDCFAFDVWGQGTMVTVS

SEQ ID NO: 4971 - protein, 122 aa, synthetic construct
  REGION 1..122: note = anti-influenza_Chain
QVQLQQSGPGLVKPSQTLSLTCTVSGGPVSGGGYSWNWIRQRPGQGLEWVGFMFHSGSPRYNPTLKSRITISVDTSKNLVSLKLSSVTAADTAVYFCARVGQMDKYYAMDVWGQGTTVTVSS

SEQ ID NO: 4972 - protein, 122 aa, synthetic construct
  REGION 1..122: note = anti-influenza_Chain
QVQLVQSGGGLVKPGGSLRLSCAASGFTFSSYSMNWVRQAPGKGLEWVSSISSSSSYIYYVDSVKGRFTISRDNAKNSLYLQMNSLRAEDTAVYYCARGGGSYGAYEGFDYWGQGTLVTVSS

SEQ ID NO: 4973 - protein, 122 aa, synthetic construct
  REGION 1..122: note = anti-influenza_Chain
QVQLVQSGGGVVQPGRSLRLSCAASGFNFSSYGMHWVRQAPGKGLEWLSVIWSGGSNKYYADSVKGRFTISRDDSKNTVYLQMNSLRDEDTAVYYCARAHTALTRFRWLDPWGQGILVTVSS

SEQ ID NO: 4974 - protein, 122 aa, synthetic construct
  REGION 1..122: note = anti-influenza_Chain
QVQLVQSGGGVVQRGRSLRLSCAASGFTFRTYGMHWVRQAPGKGLECVALISYDGTNKYYADSVKGRFTISRDNSKDTLYLQMNSLRAEDTGVYYCASLDYDFSYYYHRDVWGPGTTVTVSS

SEQ ID NO: 4975 - protein, 122 aa, synthetic construct
  REGION 1..122: note = anti-influenza_Chain
QVQLVESGGGLVQPGGSLRLSCAASGFTFSDYWMVWVRQAPGKGLVWVSRISSDGSTTSYADSVKGPFTISRDNAKNTLYLQMNSLRAEDTAVYYCARVATPYYYESGFDYWGQGALVTVSS

SEQ ID NO: 4976 - protein, 123 aa, synthetic construct
  REGION 1..123: note = anti-influenza_Chain
QFQLVQSGPEVKKPGTSVKVSCKASGYTSTTYGISWVRQVPGQGLEWMGWINPYNGNPHYGQKFQGRVTLTRDTSTNTAYLEILSLRSDDTAVYYCARDGWGQQLVPYYFDYWGQGTLVTVSS

SEQ ID NO: 4977 - protein, 123 aa, synthetic construct
  REGION 1..123: note = anti-influenza_Chain
QVQLAQSGAEVKRPGSSVKVSCTASGGIFRKNAISWVRQAPGQGLEWMGGIIAVFNTANYAQKFQGRVKITADESGNTAYMELSSLRSDDTAVYYCASHPKYFYGSGSYPDFWGQGTLVTVSS

SEQ ID NO: 4978 - protein, 123 aa, synthetic construct
  REGION 1..123: note = anti-influenza_Chain
QVQLQESGPGLVKPSETLSLTCTVSRGSIGHYFWSWIRQPPGKGLEWIGYISYSGSTKYNPSLRSRVTISVDTSKNQFSLNLNSVTATDTALYYCAREDYDILTGAGPGMEVWGQGTTVTVSS

SEQ ID NO: 4979 - protein, 123 aa, synthetic construct
  REGION 1..123: note = anti-influenza_Chain
QVQLQESGPGLVKPSETLSLTCTVSGASINSHYWSWIRQPPGKGLEWIGYVYYSGSTTYNPSLKSRVTLSVDTSKNQFSLNLSSVTAADTAFYYCARHPYDVLTGSGDWFDPWGQGTLVTVSS

SEQ ID NO: 4980 - protein, 123 aa, synthetic construct
  REGION 1..123: note = anti-influenza_Chain
QVQLVQSGAEVKRPGSSVKVSCTASGGIFRKNAISWVRQAPGQGLEWMGGIIAVFNTANYAQKFQNRVKITADESGNTAYMELSSLTSDDTAVYYCASHPKYFYGSGSYPDFWGQGTLVTVSS

SEQ ID NO: 4981 - protein, 123 aa, synthetic construct
  REGION 1..123: note = anti-influenza_Chain
EVQLVESGAEVKKPGSSVKVSCKASGGTFRSYAVSWVRQAPGQGLEWMGGIIAIFGTTNYAQKFQDRVTITADDLPSTAYMELTSLRSEDTAVYFCVRGRGYYLGGDYGSLDSWGQGTLVTVS

SEQ ID NO: 4982 - protein, 123 aa, synthetic construct
  REGION 1..123: note = anti-influenza_Chain
EVQLVESGGGLVQPGRSLRLSCVGSGFNFDGYAMQWVRQVPGKGLEWVSGISWHSDSTGYADSVRGRFTISRDNAKNSLYLQMDSLRPEDTAFYYCGKSIGHVGGSYRHPIDYWGQGTLVTVS

SEQ ID NO: 4983 - protein, 123 aa, synthetic construct
  REGION 1..123: note = anti-influenza_Chain
QVQLQASGPGLVKPSETLSLTCTVSGDSITSGAYYWTWIRQHPGKGLEWIGYIYYSGNTYYNPSLKSRVTISLDTSKNQFSLKVNSVTAADTAVYYCARAASTSVLGYGMDVWGQGTTVTVSS

SEQ ID NO: 4984 - protein, 123 aa, synthetic construct
  REGION 1..123: note = anti-influenza_Chain
QVQLVQSGAEVKKPGSSVRVSCKASGSIFRNYAMSWVRQAPGQGLEWMGGIIAIFGTPKYAQKFQGRVTITADESTSTVYMELSGLRSEDTAMYYCARIPHYNFGSGSYFDYWGQGTLVTVSS

SEQ ID NO: 4985 - protein, 123 aa, synthetic construct
  REGION 1..123: note = anti-influenza_Chain
QLQLQESGPRLVKPSETLSLTCSVSGVSISSSNYYWGWIRQPPGKGLEWIGTIYHSGSTYYNPSLKSRLIISVDTSKNQFYLQLTSLTAADSAVYYCATGGGFGWSQTYFGYWGQGTLVTASS

SEQ ID NO: 4986 - protein, 123 aa, synthetic construct
  REGION 1..123: note = anti-influenza_Chain
EVQLQQSGPELVKPGASVKMSCKASGYTFTSFIMYWVKQKPGQGLEWLGYIDPYNDGTKYNEKFEGKATLTSDKSSSTAYMELSSLTSEDSAVYYCAKRGNYGNGFAYWGQGTLVTVSAAKTS

SEQ ID NO: 4987 - protein, 123 aa, synthetic construct
  REGION 1..123: note = anti-influenza_Chain
QVQLLESGGDVVQPGTSLRLSCAASGFSLWTSGMHWVRQAPGKGLEWVAVMSYDETKKYYADSVRGRFSISRDNSRNTLYLQMNSLRVEDTAVYFCAKPRLDYLDYFHAADSWGQGTLVSVSS

SEQ ID NO: 4988 - protein, 123 aa, synthetic construct
  REGION 1..123: note = anti-influenza_Chain
QVQLVESGAEVRKPGESLRISCKAHGDSFTSYWIGWVRQLPGKGLEWMAVIYPRDSETKFSPAFHGQVSISVDKSTSTVHLQWNSLKASDTAVYYCARSPGYSGYLYGWFDPWGQGTPVTVSS

SEQ ID NO: 4989 - protein, 123 aa, synthetic construct
  REGION 1..123: note = anti-influenza_Chain
QVQLVESGPGLVKPSETLSLTCTVSGDSVINSAYYWDWIRQPPGKGLEWVGSVYYSGITYYNPSLKSRVTISVDTSKNQFSLRLSYVTAADTALYYCARRGGGWQYYYGMDVWGQGTTVTVSS

SEQ ID NO: 4990 - protein, 123 aa, synthetic construct
  REGION 1..123: note = anti-influenza_Chain
QVQLVQSGAEVKKPGASVKVSCKASGYIFTGYYIHWVRQAPGQGLEWMGRIDPNGSGTTYAQKFQGRVTLTMDTSITTAYMELSRLRFDDTAIYYCARWDWNFDLYLGWFDPWGQGTPVTVAS

SEQ ID NO: 4991 - protein, 123 aa, synthetic construct
  REGION 1..123: note = anti-influenza_Chain
EVQLVQSGAEVKKPGASVKVSCKASGYIFTGYYIHWVRQAPGQGLEWMGRIDPNGAGTTYAQKFQGRVTLTMDTSITTAYMELSRLRFDDTAIYYCARWDWNFDLYLGWFDPWGQGTPVTVAS

SEQ ID NO: 4992 - protein, 123 aa, synthetic construct
  REGION 1..123: note = anti-influenza_Chain
QVQLVQSGAEVKKPGASVKVSCKASGYTFNAHHMHWVRQAPGQGLGWMGWIDPNNDGTIYAQKFQGRVTLTMDTSIHTAYMELSGLRYDDTAIYYCVRWAWNFDFFLGWFDPWGQGTLVTVAS

SEQ ID NO: 4993 - protein, 123 aa, synthetic construct
  REGION 1..123: note = anti-influenza_Chain
EVQLVQSGAEVKKPGESLKISCKVSGYSFTSQWIGWVRQMPGKGLEWIGMMYPGDSDTIYSPSFQGQVTISADNSISTAYLQWSSLKASDTAIYYCASGPGYSGYHYGWFDTWGQGTLVTVSS

SEQ ID NO: 4994 - protein, 123 aa, synthetic construct
  REGION 1..123: note = anti-influenza_Chain
EVQLVQSGAEVKKPGESLKISCKVSGYSFTSQWIGWVRQMPGKGLEWIGMMYPGDADAIYSPSFQGQVTISADNSISTAYLQWSSLKASDTAIYYCASGPGYSGYHYGWFDTWGQGTLVTVSS

SEQ ID NO: 4995 - protein, 123 aa, synthetic construct
  REGION 1..123: note = anti-influenza_Chain
EVQLVQSGAEVKKPGESLKISCKVSGYSFTSQWIGWVRQMPGKGLEWIGMMYPGESETIYSPSFQGQVTISADNSISTAYLQWSSLKASDTAIYYCASGPGYSGYHYGWFDTWGQGTLVTVSS

SEQ ID NO: 4996 - protein, 123 aa, synthetic construct
  REGION 1..123: note = anti-influenza_Chain
EVQLVQSGAEVKKPGESLKISCKVSGYSFTSQWIGWVRQMPGKGLEWIGMMYPGDADTIYSPSFQGQVTISADNSISTAYLQWSSLKASDTAIYYCASGPGYSGYHYGWFDTWGQGTLVTVSS

SEQ ID NO: 4997 - protein, 123 aa, synthetic construct
  REGION 1..123: note = anti-influenza_Chain
EVQLVQSGAEVKKPGESLKISCKVSGYSFTSQWIGWVRQMPGKGLEWIGMMYPGSSDTIYSPSFQGQVTISADNSISTAYLQWSSLKASDTAIYYCASGPGYSGYHYGWFDTWGQGTLVTVSS

SEQ ID NO: 4998 - protein, 123 aa, synthetic construct
  REGION 1..123: note = anti-influenza_Chain
EVQLVQSGAEVKKPGESLKISCKVSGYSFTSQWIGWVRQMPGKGLEWIGMMYPGDSDAIYSPSFQGQVTISADNSISTAYLQWSSLKASDTAIYYCASGPGYSGYHYGWFDTWGQGTLVTVSS

SEQ ID NO: 4999 - protein, 123 aa, synthetic construct
  REGION 1..123: note = anti-influenza_Chain
EVQLVQSGAEVKKPGESLKISCKVSGYSFTSQWIGWVRQMPGKGLEWIGMMYPGDTDTIYSPSFQGQVTISADNSISTAYLQWSSLKASDTAIYYCASGPGYSGYHYGWFDTWGQGTLVTVSS

SEQ ID NO: 5000 - protein, 123 aa, synthetic construct
  REGION 1..123: note = anti-influenza_Chain
EVQLVQSGAEVKKPGESLKISCKVSGYSFTSQWIGWVRQMPGKGLEWIGMMYPGESDTIYSPSFQGQVTISADNSISTAYLQWSSLKASDTAIYYCASGPGYSGYHYGWFDTWGQGTLVTVSS

SEQ ID NO: 5001 - protein, 124 aa, synthetic construct
  REGION 1..124: note = anti-influenza_Chain
QVQLVQSGAEVKKPGSSVKVSCKASGGIFISQAISWVRQAPGQGLEWMGGIIPMFGATNYAQKFQGRVTITADKSTNTVYMELSSLTSEDTAVYYCARLGSGSYHNGPNWFDPWGQGTLVTVSS

SEQ ID NO: 5002 - protein, 124 aa, synthetic construct
  REGION 1..124: note = anti-influenza_Chain
QVQLQESGPGLVKPSETLSLNCAVSGGSISNYYWSWIRQPPGKGLEWIGYISYNGRPKYNPSLTSRVTISVDTSKDQFSLELRSVTAADTALYYCARETRFGELLSPYDAFEIWGQGTMVTVSS

SEQ ID NO: 5003 - protein, 124 aa, synthetic construct
  REGION 1..124: note = anti-influenza_Chain
QVQLQESGPGLVKPSETLSLTCTVSGGSVSSETYYWSWIRQPPGKGLEWIGYIYYIGNTDYRPSLKSRVTISLDTSKNQFSLKLSSVTAADTAVYYCARGAYYDSSGYPAFYIWGQGTMVTVSS

SEQ ID NO: 5004 - protein, 124 aa, synthetic construct
  REGION 1..124: note = anti-influenza_Chain
QVQLQESGPGLVKPSETLSLTCAVSGVSISNIDFYWGWIRQPPGKGLEWIGNIYYTGITFYNPSLSSRVAISIDTSKNQFSLTLTSVTAADTAMYYCARHYGDSEAINDAFDIWGQGTMLTVSS

SEQ ID NO: 5005 - protein, 124 aa, synthetic construct
  REGION 1..124: note = anti-influenza_Chain
QVQLVESGAEVKKFGASVKVSCKASGYTLIDYYMHWVRVAPGQGLEWMGWINPINGGTNYAQKFQGRVTMTRDTSINTAYMDLSSLRSDDTAMYYCTRGRPIGRNWEPRDKDYWGQGTPVTVSS

SEQ ID NO: 5006 - protein, 124 aa, synthetic construct
  REGION 1..124: note = anti-influenza_Chain
QVQLVQSGAEVKKPGSSVTVSCKTSGHTFISYAISWLRQAPGQGLEWMGGIVPIFGTVNYTQKFQGRLTITADESTSTAYMDLSRLTFEDTAIYFCAREAGYHSSFSGVYFDYWGQGTLLTVSS

SEQ ID NO: 5007 - protein, 124 aa, synthetic construct
  REGION 1..124: note = anti-influenza_Chain
EVQLQQSGPELVKPGASVKISCKASGYTFTDYNMHWVKQSLGKSLEWIGYIYPNNGGTGYNQKFESKATLTVDNSSSTAYMELRTLTSEDSAVYYCVRSGAYYFNYLVPYFDYWGQGTTLTVSS

SEQ ID NO: 5008 - protein, 124 aa, synthetic construct
  REGION 1..124: note = anti-influenza_Chain
EVQLQQSGPELVKPGASVKISCKASGYTFTGYNMHWVKQSHGKSLEWIGKIYPNNGVTGYNQEFRSKATLTVDNSSSTAYMELRSLTSEDSAIYFCVRSGAYYVNYLVPYFDYWGQGTTLTVSS

SEQ ID NO: 5009 - protein, 125 aa, synthetic construct
  REGION 1..125: note = anti-influenza_Chain
QVQLVQSGAEVKKPGSSVKVSCKASGVTSSNYPITWVRQAPGQGLEWMGGVLPLFGVTNYAQKFQGRVTISADKSTNTAYMELSSLRSEDTAVYYCARGKRPGYCSGGVCSSDYWGQGTLVTVSS

SEQ ID NO: 5010 - protein, 125 aa, synthetic construct
  REGION 1..125: note = anti-influenza_Chain
QVQLQESGPGLVKPSQTLSLTCTVSGGSISSGTYYWSWIRHHPGKGLEWIGYIYHSGSAYYNPSLESRVTMSVDTSKNQFSLKLSSVTAADTAIYYCARAENLLSPYLAEGFDPWGQGTLVTVSS

SEQ ID NO: 5011 - protein, 125 aa, synthetic construct
  REGION 1..125: note = anti-influenza_Chain
EVQLVQSGAEVKKPGESLKISCQASGYSFTSRWIGWVRQMPGKGLEWVGFIYPSDSDVRYSPSFRGQVTISADKSISTAYLQWSSLKASDTAMYFCARLGGNKDYGDYLWYFDLWGRGALVTVSS

SEQ ID NO: 5012 - protein, 125 aa, synthetic construct
  REGION 1..125: note = anti-influenza_Chain
QVQLVESGGGVVQPGRSLRLSCAASGFTFSSYGMHWVRQAPGKGLEWVAVIWYDGDNKYYGDSVKGRFTISRDNSKNTLFLQMNSLRAEDTAVYYCAKDTADHGDYVDLGFFDAWGQGTLVTVSS

SEQ ID NO: 5013 - protein, 125 aa, synthetic construct
  REGION 1..125: note = anti-influenza_Chain
EVQLVQSGAELKMPGESLKISCKASGYTFTNYWIGWVRQTPGKGLEWMGIIFPPDSQTSYSPSFQGQVTFSVDNSISVAYIQWSSLKASDTAIYYCARSGIFDWSAPLVEAFDIWGQGTVVTVSS

SEQ ID NO: 5014 - protein, 125 aa, synthetic construct
  REGION 1..125: note = anti-influenza_Chain
EVQLVQSGAEVKKPGESLKISCKGSGYSFSDYWIGWVRQMPGEGLEWMGIIYPASSEIRYSPSFQGLVTISADKSINTASLQWSSLKASDTAIYYCARHASCSARSCYWGPVDYWGQGTLVTVSS

SEQ ID NO: 5015 - protein, 125 aa, synthetic construct
  REGION 1..125: note = anti-influenza_Chain
QVQLVESGGGVVQPGRSLRLSCAASEITFITYAMHWVRQAPGKGLEWVALISDDGSNKFYADSVKGRFTISRDNSKNTLYLQMNSLRAEDTAAYYCAREGVYFDSGTYRGYFDYWGQETLVTVSS

SEQ ID NO: 5016 - protein, 125 aa, synthetic construct
  REGION 1..125: note = anti-influenza_Chain
QVQLQESGPGLVKPSQTLSLTCTVSGGSISSGNYYWNWVRQHPGKGLEWIGYIYYRGSTFYNPSLKSRVTISIDTSKNQFSLRLSSVTAADTAVYYCAKDTRSSLDNYQYGMDVWGQGTTVTVSS

SEQ ID NO: 5017 - protein, 125 aa, synthetic construct
  REGION 1..125: note = anti-influenza_Chain
EVQLLESGGGLVQPGGSLRLSCAASGFSFSTYAMSWVRQAPGKGLEWVSGISGSGESTYYADSVKGRFTVSRDNSKNTLYLQMNSLRAEDTAVYYCAKQGDHIAWLLRGINFDYWGQGVLVTVSS

SEQ ID NO: 5018 - protein, 125 aa, synthetic construct
  REGION 1..125: note = anti-influenza_Chain
QVQLVESGGGVVQPGRSLRLSCAASGFAFHNRAMHWVRQAPGKGLEWVALIYFDGSKQYYADSVKGRFTISRDNSKNTVFLQMNSLRPEDTAVYYCAVPGPIFGIFPPWSYFDHWGQGILVTVSS

SEQ ID NO: 5019 - protein, 125 aa, synthetic construct
  REGION 1..125: note = anti-influenza_Chain
EVQLVESGGGVVQPGRSLRLSCAASGFAFHNRAMHWVRQAPGKGLEWVALIYFDGSKQYYADSVKGRFTISRDNSKNTVFLQMNSLRPEDTAVYYCAVPGPIFGIFPPWSYFDHWGQGILVTVSS

SEQ ID NO: 5020 - protein, 125 aa, synthetic construct
  REGION 1..125: note = anti-influenza_Chain
EVQLVQSGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSS

SEQ ID NO: 5021 - protein, 125 aa, synthetic construct
  REGION 1..125: note = anti-influenza_Chain
QVQLVESGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSS

SEQ ID NO: 5022 - protein, 125 aa, synthetic construct
  REGION 1..125: note = anti-influenza_Chain
QVQLVESGGGVVQPGKSPRLSCAASGPTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSS

SEQ ID NO: 5023 - protein, 125 aa, synthetic construct
  REGION 1..125: note = anti-influenza_Chain
EVQLVESGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSS

SEQ ID NO: 5024 - protein, 125 aa, synthetic construct
  REGION 1..125: note = anti-influenza_Chain
QVQLVQSGAELKRPGASVKVSCKTSGYSFNNYGINWVRQAPGQGLEWMGWISAYTGNTHYAKNFEGRVTLTTDTSTSTAYMEVRSLRSDDSAVYFCARAMIQGVVTLYLRPGDYWGQGTLVTVSS

SEQ ID NO: 5025 - protein, 125 aa, synthetic construct
  REGION 1..125: note = anti-influenza_Chain
QVQLVQSGAEVKQPGASVKVSCKASGYTFNAYYIHWVRQAPGQGLEWMGWINPNFGGTHYARKFQGRVTMTRDASINTAYMELDRLISDDTAVYYCVRWRAAAVIMDQFYKMDVWGQGTLVTVSS

SEQ ID NO: 5026 - protein, 125 aa, synthetic construct
  REGION 1..125: note = anti-influenza_Chain
QVQLVQSGPELKKPGSSVKLSCMATGGTFINYAFSWVRQAPGQGLEWLGGIIPVYGTSNHVEKLQGRVTITADASTNTAYMELSGLRFDDTAVYFCAASTATSGTYYAMRPFDFWGQGTLVSVSS

SEQ ID NO: 5027 - protein, 126 aa, synthetic construct
  REGION 1..126: note = anti-influenza_Chain
EVQLVESGGGVVQPGGSLRLSCIASAFNLGIFGMHWVRQAPGKGLEWVAFIRYDGGKTFYADSVKGRFTISRDNSKNTLYLQMNSLRTEDTALYYCARDATADYYGPGSYPNWLDPWGQGTLVTVS

SEQ ID NO: 5028 - protein, 126 aa, synthetic construct
  REGION 1..126: note = anti-influenza_Chain
EVQLVESGPALVKPTQTLTLTCSFSGFSLSTSGMSVSWIRQPPGKALEWLALIDWDDDTYYITYSSSLKTRLTISKDTSKSQVVLTMTNMDPVDTATYYCARTLRVSGDYVRDFDLWGRGTLVTVS

SEQ ID NO: 5029 - protein, 126 aa, synthetic construct
  REGION 1..126: note = anti-influenza_Chain
QVQLQESGPGLVKPSETLSLTCTVSGGSINSYYWNWIRQPPGKGLEWIGYIYHSGSTNYNPSLKSRVTISVDTSKNQFSLQLSSVTAADTAVYYCARLRTDYGDPDSVYYYGMDVWGQGTTVTVSS

SEQ ID NO: 5030 - protein, 126 aa, synthetic construct
  REGION 1..126: note = anti-influenza_Chain
QVHLVQSGAEVRKPGDSVKVSCKTSGYTFSTYPVAWVRQVPGQGLEWMGWISTYNGNTNFAQNFQGRVTLTTDTTTNTAYMEVRSLKFDDTAVYYCARVEGSYRDFWNNQNRFDPWGQGTLVTVSS

SEQ ID NO: 5031 - protein, 126 aa, synthetic construct
  REGION 1..126: note = anti-influenza_Chain
EVQLVESGAEVKKPGASVKVSCKASGYTFTSFDINWVRQAPGQGLEWMGWMTPTSGKTGYAQKFQGRITMTRNTSINTAYMELSSLRSEDTAVYFCARGPERRTTIFDVILDWFDPWGQGTLVTVS

SEQ ID NO: 5032 - protein, 126 aa, synthetic construct
  REGION 1..126: note = anti-influenza_Chain
QVQLVQSGAEVKKPGSSVKVSCKASGGFFSSYAISWVRQAPGQGLEWMGGVIPIFRTANYAQNFQGRVTITADEFTSYMELSSLRSDDTAVYYCARLNYHDSGTYYNAPRGWFDPWGQGTLVTVSS

SEQ ID NO: 5033 - protein, 126 aa, synthetic construct
  REGION 1..126: note = anti-influenza_Chain
QVQLVQSGAEVKKPGSSVKVSCKASGGAFSNYAISWVRQAPGQGLEWMGGIIPIFGTTNYAQKFQGRVTITADKFTTIAYMELRSLRSEDTAVYYCARHGGVYYYGSASSGWFDPWGQGTLVTVSS

SEQ ID NO: 5034 - protein, 126 aa, synthetic construct
  REGION 1..126: note = anti-influenza_Chain
QVQLLESGGGVVRPGRSLRLACAGSGFTFSAYAMHWVRQAPGKGLEWVAHTSYDGRDSYYVDSVKGRFTISRDDSKNTLYLQMNSLRPEDTAVYYCAKVGPYTGYDDYNYYGMDVWGHGTTVTVSS

SEQ ID NO: 5035 - protein, 126 aa, synthetic construct
  REGION 1..126: note = anti-influenza_Chain
QVQLVESGGGVVQPGGSLRLSCAASGFNFDEYVMYWVRQSPGKGLEWVSLIGADGRGTYNSDSVKGRFTISRDNRKNSLYLQMNSLRSDDTALYYCAKVERSFYDGSGYGDALEIWGQGTMVTVSS

SEQ ID NO: 5036 - protein, 127 aa, synthetic construct
  REGION 1..127: note = anti-influenza_Chain
EVQLLESGGGLVHPGGSLRLSCAASGFTFSNYAMSWVRQAPGKGLEWVSSINSGGGATYYADSVKGRFTISRDNSKNTLSLQMNSLRAEDTAVYYCAKEGGNTIFGLVTMAYYFDSWGQGTLVTVSS

SEQ ID NO: 5037 - protein, 127 aa, synthetic construct
  REGION 1..127: note = anti-influenza_Chain
QPQLQESGPGLVRPSETLSLTCTVSGDSVTRGGFYWGWIRQPPGKGLEWIGSIYYNYNIYHSPSLKSRVSLSVDTSKNQVSLKLASVTAADTAVYYCARHYPYYDLPTGFYSQFDFWGQGTPVTVSS

SEQ ID NO: 5038 - protein, 127 aa, synthetic construct
  REGION 1..127: note = anti-influenza_Chain
WWQLVQSGAEVKKPGSSVKVSCKASGGTFSSYDISWVRQAPGQGLEWMGGIIPIYGTANYAQKFQGRVTITADESTSTAYMELSSLRSEDTAVYYCARAGGDSSGYYGALGRFFQHWGQGTLVTVSS

SEQ ID NO: 5039 - protein, 127 aa, synthetic construct
  REGION 1..127: note = anti-influenza_Chain
EVQLVQSGGAVVQPGRSLRLSCAASGFTFSIYAMHWVRQTPGKGLEWVALISYDGNNKYYADSVKGRFTISRDNYKNTLYLQMKGLRAEDTALYYCARRITEKGYYNDSGRPNWFDPWGQGTLVTVS

SEQ ID NO: 5040 - protein, 127 aa, synthetic construct
  REGION 1..127: note = anti-influenza_Chain
QVQLQQSGPRLVKPSQTLSLTCAISGDSVSGDSGTWNWIRQSPSRGLEWLGRTYYRSKWYNDYAESVKSRIVIKADTSKNEFSLQLNSVTPEDTAIYYCARAGVKIFGLIVGALDNWGRGTLVTVSS

SEQ ID NO: 5041 - protein, 127 aa, synthetic construct
  REGION 1..127: note = anti-influenza_Chain
QVQLQQWGAGLLKPSETLSLTCTVSGGSLTDYSWNWIRQPPGKGLEWIGDTLHNGYTNYNPSLRGRVSISIDTSKNQVSLRLTSVTAADTALYYCARGSGGYGGFDYFGKLRTWDFWGQGTLVTVSS

SEQ ID NO: 5042 - protein, 127 aa, synthetic construct
  REGION 1..127: note = anti-influenza_Chain
QVQLVQSGAEVRKPGESLRISCRGSGYNFPKYWIGWVRQMPGKGLEWMGMIYPGDSDVRYNPSFQGQVTISADESINTAYLQWSSLRTSDTARYYCARHLGQQLVSNTYYYYGMDVWGQGTTVTVSS

SEQ ID NO: 5043 - protein, 128 aa, synthetic construct
  REGION 1..128: note = anti-influenza_Chain
QIQLQESGPGLVKPSQTLSLTCAISGDSVSSNNAVWNWIRQSPSRGLEWLGRTYYRSKWYNDYAESVKSRITVNPDTSKNQFSLHLKSVTPEDTAVFYCVRSGHITVFGVNVDAFDMWGQGTMVTVSS

SEQ ID NO: 5044 - protein, 128 aa, synthetic construct
  REGION 1..128: note = anti-influenza_Chain
QVQLQESGPGLVKPSQTLSLTCAISGDSVSSNNAVWNWIRQSPSRGLEWLGRTYYRSKWYNDYAESVKSRITVNPDTSKNQFSLHLKSVTPEDTAVFYCVRSGHITVFGVNVDAFDMWGQGTMVTVSS

SEQ ID NO: 5045 - protein, 128 aa, synthetic construct
  REGION 1..128: note = anti-influenza_Chain
QVQLQQSGPGLVKPSQTLSLTCAISGDRVSSNSAVWNWIRQSPSRGLEWLGRTYYRSKWYYDYAESVKSRIVIDPDTSKNQVSLQLNSVTPEDSAIYYCARGGHITVFGLNIDAYDIWGQGAKVTVSS

SEQ ID NO: 5046 - protein, 128 aa, synthetic construct
  REGION 1..128: note = anti-influenza_Chain
QVQLQQSGPGLVKPSQTLSLTCAISGDRVSSNSAVWNWIRQSPSRGLEWLGRTYYRSKWYYDYAESVKSRIVIDPDTSKNQVSLQLNSVTPEDSAIYYCARGGHITVFGLNIDAYDIWGQGAMVTVSS

SEQ ID NO: 5047 - protein, 128 aa, synthetic construct
  REGION 1..128: note = anti-influenza_Chain
QVQLQQSGPGLVKPSQTLSLTCAISGDRVSSNSAVWNWIRQSPSRGLEWLGRTYYRSKWYYDYAESVKSRIVIDPDTSKNQVSLQLNSVTPEDSAIYYCARGGHITEFGLNIDAYDIWGQGAMVTVSS

SEQ ID NO: 5048 - protein, 128 aa, synthetic construct
  REGION 1..128: note = anti-influenza_Chain
QVQLQQSGPGLVKPSQTLSLTCVISGDTVSSNRATWNWMRQSPLRGLEWLGRTYYRSKWYNDYAVSVKSRVVINPDTSKNQVSLQLNTVTPDDSGVYFCARGGHITVFGVNIDAFDIWGLGTKVTVSS

SEQ ID NO: 5049 - protein, 128 aa, synthetic construct
  REGION 1..128: note = anti-influenza_Chain
QVELQQSGPGLVKPSQTLSLTCAISGDSVSSNSATWNWIRQSPSRGLEWLGRTYYRSKWYNDYADFLKRRITINPDTSNNEVSLRLTSVTPDDTALYYCARGGHITVFGVNIDAFDVWGQGTMATVSS

SEQ ID NO: 5050 - protein, 128 aa, synthetic construct
  REGION 1..128: note = anti-influenza_Chain
QVQLQQSGPGLVKPSQTLSLTCAISGDSVSSNSATWNWIRQSPSRGLEWLGRTYYRSKWYNDYADFLKRRITINPDTSNNEVSLRLTSVTPDDTALYYCARGGHITVFGVNIDAFDVWGQGTMVTVSS

SEQ ID NO: 5051 - protein, 128 aa, synthetic construct
  REGION 1..128: note = anti-influenza_Chain
QVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSS

SEQ ID NO: 5052 - protein, 128 aa, synthetic construct
  REGION 1..128: note = anti-influenza_Chain
QVQLQQSGPGLVKPSQTLSLTCAISGDSVSSNNAVWNWIRQSPSRGLEWLGRTYYRSKWYNDYAESVKSRITINPDTSKNQFSLQLNSVTPEDTAVYYCARSGHITVFGVNVDAFDMWGQGTTVTVSS

SEQ ID NO: 5053 - protein, 128 aa, synthetic construct
  REGION 1..128: note = anti-influenza_Chain
RGQLVQSGGGVVQPGRSLRLSCAASGFVFNVFGIHWVRQAPGKGLEWLATISYDGLNKYYADSVKGRITISRDNSKNTLYLQMNSLRAEDTAVYYCVRDSEESTYYGDYMWVYNWFDLWGQGTLVTVS

SEQ ID NO: 5054 - protein, 128 aa, synthetic construct
  REGION 1..128: note = anti-influenza_Chain
QVQLQQWGSGLLKPSETLSLTCAVYGGSFRDDYWTWIRQPPGKGLEWIGEINHSGRTNYNPSLKSRVTISVDTSLKQFSLKVISVTAADTAVYYCARGTSHVSRYFDWLPPTNWFDPWGQGTQVTVSS

SEQ ID NO: 5055 - protein, 128 aa, synthetic construct
  REGION 1..128: note = anti-influenza_Chain
QVQLQQWGAGLLKPSETLSLSCAVFGGSFSDYYWTWIRQPPGKGLEWIGEIKHSGRTNYNPSLESRVTISVDTSKNQFSLKLSSVTAADTAIYYCARGTDPDTEGYCRSGSCSAFDFWGQGTLVTVSS

SEQ ID NO: 5056 - protein, 128 aa, synthetic construct
  REGION 1..128: note = anti-influenza_Chain
QVQLQQWGAGLLKPSETLSLTCGVYGGSLSDYYWSWIRQPPGKGLEWIGEINHSGGTNYNPSLKRRVTISVDTSKKQFSLKMNSVTAADTAVYYCARGTDPDTEVYCRAGNCAAFDFWGQGTLVTVSS

SEQ ID NO: 5057 - protein, 128 aa, synthetic construct
  REGION 1..128: note = anti-influenza_Chain
QVQLQESGPGLVKPSQTLSLTCTVSGDSISSVDHYWSWIRQHPVKGLEWIGFMYYSASTYYNPSLKSRVTISTDTSKNQFSLRLSSVTAADTAVYYCARGTCAGDCSLHYYYYGLDVWGQGRTVTVSS

SEQ ID NO: 5058 - protein, 128 aa, synthetic construct
  REGION 1..128: note = anti-influenza_Chain
EVALVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSS

SEQ ID NO: 5059 - protein, 128 aa, synthetic construct
  REGION 1..128: note = anti-influenza_Chain
EVQLVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSS

SEQ ID NO: 5060 - protein, 128 aa, synthetic construct
  REGION 1..128: note = anti-influenza_Chain
QVQLVQSGAEVRKPGASVKVSCKASGYTFTRHGISWVRQAPGQGLEWMGWISAYTGDTDYAQKFQGRVTMTTDTSTNTAYMELRSLRSDDAAVYYCARLRLQGEVVVPPSQSNWFDPWGQGTLVTVSS

SEQ ID NO: 5061 - protein, 128 aa, synthetic construct
  REGION 1..128: note = anti-influenza_Chain
QVQLVESGPGLMKPSETLSLTCTVSGGSVSNYYWSWIRQPPGKGLEWIGYVFYSGSSNYNPSLNNPSLKSRVTISIDTSNNQFSLKLSSVTAADTAVYYCARGRVNSGYDWGPNFDSWGQGALVTVSS

SEQ ID NO: 5062 - protein, 128 aa, synthetic construct
  REGION 1..128: note = anti-influenza_Chain
QVQLVQSGAEVKKPGSSVKVSCKASGGTFSYYAISWVRQAPGQGLEWMGGIIPIVGTAHYTQKFQGRVTITADESTSTAYMELSSLRSEDTAVYFCARAADESVESLTIKAFRTNYHWGQGTLVTVSS

SEQ ID NO: 5063 - protein, 129 aa, synthetic construct
  REGION 1..129: note = anti-influenza_Chain
EVQLVESGGGAVQPGESLKLPCAASGFTFSNYGMHWVRQAPGKGLEWVAVISYDGSNKYYADSVKGRFTISRDNSKDTLYLQMNSLRAEDTALFYCAKERPLRLLRYFDWLSGGANDYWGQGTLVTVSS

SEQ ID NO: 5064 - protein, 129 aa, synthetic construct
  REGION 1..129: note = anti-influenza_Chain
EVQLVESGGGAVQPGESLKLSCAASGFTFSNYGMHWVRQAPGKGLEWVAVISYDGSNKYYADSVKGRFTISRDNSKDTLYLQMNSLRAEDTALFYCAKERPLRLLRYFDWLSGGANDYWGQGTLVTVSS

SEQ ID NO: 5065 - protein, 129 aa, synthetic construct
  REGION 1..129: note = anti-influenza_Chain
QVQLVESGGGVVQPGRSLRLSCAVSGFTFSSYAMHWVRQAPGKGLEWVAVISYDGSNQYYADSVKGRFTISRDNSKNTLYLQMNSLRAEDTALYYCAKDPRLRHLLYFPFTSMIYFDYWGQGTLVTVSS

SEQ ID NO: 5066 - protein, 129 aa, synthetic construct
  REGION 1..129: note = anti-influenza_Chain
QVQLVQSGGGVVQPGRSLRLSCVASGFTFSTYAMHWVRQAPGRGLEWVAVISYDANYKYYADSVKGRFSISRDNSQNTLHLEMNTLRTEDTALYYCAKDSQLRSLLYFEWLSQGYFEPWGQGTLVTVTS

SEQ ID NO: 5067 - protein, 129 aa, synthetic construct
  REGION 1..129: note = anti-influenza_Chain
QVQLVQSGGGVVQPGRSLRLSCVASGFTFSTYAMHWVRQAPGRGLEWVAVISYDGNYKYYADSVKGRFSISRDNSNSTLHLEMNTLRTEDTALYYCAKDSQLRSLLYFEWLSQGYFDPWGQGTLVTVTS

SEQ ID NO: 5068 - protein, 129 aa, synthetic construct
  REGION 1..129: note = anti-influenza_Chain
QVQLVQSGAEVKKPGSSVTVSCKASGGTFSNYGISWVRQAPGQGLDWMGGIIPLFGTANYAQKFQGRVTITADESTSSSNMELSSLRSEDTAVYYCARDVHNYDFLTGYPLHLYGMDVWGQGTTVTVSS

SEQ ID NO: 5069 - protein, 129 aa, synthetic construct
  REGION 1..129: note = anti-influenza_Chain
QVQLQESGPGLVKPSETLSLICAVSGASISSSYWSWIRQPPGKGLEWIGYIYYSGVTKYNPSLKSRVTLSVDTSKNHFSLKLSYVTAADTAVYYCARNLPDIAVVTAVQDATPVWFDPWGPGTLVSVSS

SEQ ID NO: 5070 - protein, 129 aa, synthetic construct
  REGION 1..129: note = anti-influenza_Chain
EVQLVESGGGLVQPGRSLRLSCAASGFTFSDFWMSWVRQAPGKGLEWVANIDQDGNERFYADSVKGRFTISRDNAKNSLYLQMTSLRADDTAVYYCARDGREGYFYGSGSFYNLKGLNWGQGTLLTVSS

SEQ ID NO: 5071 - protein, 129 aa, synthetic construct
  REGION 1..129: note = anti-influenza_Chain
EVLMVESGGGLVQPGGSVRLSCVASGFSFSSHWMTWVRQAPGKGLEWVANIEDDGGDKYYVDSVKGRFIISRDNAKNSVYLQMNSLRAEDTAVYFCARGSGSSDRSDYDPHYYYYLDVWGKGATVTVSS

SEQ ID NO: 5072 - protein, 129 aa, synthetic construct
  REGION 1..129: note = anti-influenza_Chain
EVQLVESGGDLVQPGRSLKLSCTGSGFTFGDYGVTWVRQAPGKGLEWVGFIRTRPWGGTADTAASVKGRFTISRDDSKSLAYLQMNSLKTEDTAVYYCCRDAPPNVEVASMTNWYFDLWGRGTLVTVSS

SEQ ID NO: 5073 - protein, 129 aa, synthetic construct
  REGION 1..129: note = anti-influenza_Chain
EVQLVQSGSEVKKPGESLKISCKGSGYSFSNYWIGWVRHMPGKGLEWMGIIYPGDSDTRYSPSFQGQVTMSADKSSSTVYLQWSSLKASDTAIYYCARRGGHSFGYGSGGDTHSEFDSWGQGTLVTVSS

SEQ ID NO: 5074 - protein, 129 aa, synthetic construct
  REGION 1..129: note = anti-influenza_Chain
QVQLLETGGGLVKPGQSLKLSCAASGFTFTSYAMHWVRQPPGKGLEWVAVVSYDGNYKYYADSVQGRFTISRDNSKNTLYLQMNSLRAEDTAVYYCAKDSRLRSLLYFEWLSQGYFNPWGQGTTLTVSS

SEQ ID NO: 5075 - protein, 129 aa, synthetic construct
  REGION 1..129: note = anti-influenza_Chain
QVQLVESGAEVKKPGASVKLSCTASGYNFAAYYIHWVRQAPGQGLEWMGWSNPNTGGANYAQDFQGRVTMTAVTSTSTAYMELSRLTSDDTALYFCARVPRDRLLTLYYESSTYGFDYWGQGTLVTVSS

SEQ ID NO: 5076 - protein, 129 aa, synthetic construct
  REGION 1..129: note = anti-influenza_Chain
QVQLVESGGGLVQPGGSLRLSCTVSGFTFNSYAMNWVRQAPGKGLEWVSGIRGSGENTYYAETVKGRFTISRDNSKNTLYLEMNSLRAEDTAVYYCARKWGRMTVFGVATDQLYYFDYWGQGTLVTVSS

SEQ ID NO: 5077 - protein, 129 aa, synthetic construct
  REGION 1..129: note = anti-influenza_Chain
QVQLVESGPGLVKPSQTLSLTCTVSGGSISNGGYHWSWIRQHPGKGLEWIGNIYYRGSTFYDPSLKSRVTISVDTSKSQFSLKLTSVTAADTAVYYCARMPLANYDLLTGLYIGAFDLWGQGTMVTVSS

SEQ ID NO: 5078 - protein, 129 aa, synthetic construct
  REGION 1..129: note = anti-influenza_Chain
QVQLVESGAEVKKPGASVRVSCKGSGYTFTAYHMHWVRQAPGQGFEWVGWINPNSGATYYTSTFEGRVTMTRDTSITTAYMELSSLRSDDTAVYYCATDIVVERDASLGGFNSYGMDVWGQGTTVTVSS

SEQ ID NO: 5079 - protein, 130 aa, synthetic construct
  REGION 1..130: note = anti-influenza_Chain
QVQLQQWGAGLLKPSETLSLTCAVYGGSFSVSGYYWSWIRQPPGRGLEWIGEISHGGSTNYNPSLKSRVTISVDTTKNQFSLRLSSVTAADTAVYYCARGTDPDTEVYCRVGNCAAFDYWGQGSLVTVSS

SEQ ID NO: 5080 - protein, 130 aa, synthetic construct
  REGION 1..130: note = anti-influenza_Chain
QVQLLESGPGLVKPSQTLLLTCTVSGASISTGGNYWSWIRQHPGKDLEWIGYIFYSGTTKYNPSVDNPSLKSRVTMSVDTSENQFSLKLSSVTAADTAVYFCARGSPNSGYDWGPHFDYWGQGTLVTVSS

SEQ ID NO: 5081 - protein, 130 aa, synthetic construct
  REGION 1..130: note = anti-influenza_Chain
EVQLVESGGHLVQPGRSLRLSCAASGFTFEDYAMNWVRQAPGKGLEWVSVISWDSGRIGYADSVKGRFTISRDNAKNSSYLQMNSLRPEDTALYYCVRDMLAYYSDNSGKKYNVYGMDVWGQGTTVTVSS

SEQ ID NO: 5082 - protein, 130 aa, synthetic construct
  REGION 1..130: note = anti-influenza_Chain
EVQLVESGGGLVQPGRSLRLSCAVSGFIFEDYAINWVRQAPGKGLEWVSIISWDSGRIGYADSVRGRFTISRDNAKNSSFLQMNSLRPEDTAVYYCVKDMLAYYYDGSGIRYNLYGMDVWGQGTTVTVSS

SEQ ID NO: 5083 - protein, 130 aa, synthetic construct
  REGION 1..130: note = anti-influenza_Chain
EVQLVESGGGLVQPGRSLRLSCAVSGFIFEDYAINWVRQAPGKCLEWVSIISWDSGRIGYADSVRGRFTISRDNAKNSSFLQMNSLRPEDTAVYYCVKDMLAYYYDGSGIRYNLYGMDVWGQGTTVTVSS

SEQ ID NO: 5084 - protein, 132 aa, synthetic construct
  REGION 1..132: note = anti-influenza_Chain
QITLKESGPTLVKPTQTLTLTCVFSGFSLSITGVRVGWIRQPPGKALEWLALISWDDEKHYSPSLQSRLTITKDTSKNQVVLTMTNLDPVDTATYYCARSTDRGHVLRYFGWMLPGDAFDVWGQGTMVTVSS

SEQ ID NO: 5085 - protein, 132 aa, synthetic construct
  REGION 1..132: note = anti-influenza_Chain
QVQLQESGPGLVKPSETLSLTCTVSSGPMSDYYWSWIRQPPGKGLEWIGHVSVSHGGRTKSNPSVMSRVTISVETSKNQFSLKLTSVTAADTAVYYCARLNYYDRSGYHSPDGPSNNWFDPWGQGTLVTVSS

SEQ ID NO: 5086 - protein, 132 aa, synthetic construct
  REGION 1..132: note = anti-influenza_Chain
QVQLVQSGAEVKKPGASVKVSCKTSGYTFTAYTIHWVRQAPGQRLEWMGWINAGNGHTKYSQRFKGRVTITRDTSARTTYMELRSLTSEDTALYFCARGPETYYYDKTNWLNSHPDEYFQHWGHGTQVTVSS

SEQ ID NO: 5087 - protein, 133 aa, synthetic construct
  REGION 1..133: note = anti-influenza_Chain
QVQLVQSGSEVKKPGASVKVSCKASGYTFTNYDINWIRQAPGQGLEWMGWINPNSGTTGSAQRFQGRVTITVDTSITTVYMELSSLRSDDTAIYYCARGRELLRLQHFLTDSQSERRDCFDPWGQGTLVTVSS

SEQ ID NO: 5088 - protein, 134 aa, synthetic construct
  REGION 1..134: note = anti-influenza_Chain
EVQLVESGGGLVKPGGSLRLSCAASGLSFLNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5089 - protein, 134 aa, synthetic construct
  REGION 1..134: note = anti-influenza_Chain
EVQLVESGGGLVKPGGSLRLSCAASGFSFLNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5090 - protein, 134 aa, synthetic construct
  REGION 1..134: note = anti-influenza_Chain
EVQLVESGGGLVKPGGSLRLSCAASGLTFLNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5091 - protein, 134 aa, synthetic construct
  REGION 1..134: note = anti-influenza_Chain
EVQLVESGGGLVKPGGSLRLSCAASGFSFSNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5092 - protein, 134 aa, synthetic construct
  REGION 1..134: note = anti-influenza_Chain
EVQLVESGGGLVKPGGSLRLSCAASGLTFSNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5093 - protein, 134 aa, synthetic construct
  REGION 1..134: note = anti-influenza_Chain
EVQLVESGGGLVKPGGSLRLSCAASGFTFSNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5094 - protein, 134 aa, synthetic construct
  REGION 1..134: note = anti-influenza_Chain
EVQLVVSGGGLVKPGGSLRLSCAASGLSFLNAWMSWVRQAPGKGLEWVGRIKSNTDGGTTDYAAPVKGRFSISRDDSKNMLFLHMSSLRTEDTAVYYCATDGPYSDDFRSGYAARYRYFGMDVWGQGTTVTVSS

SEQ ID NO: 5095 - protein, 134 aa, synthetic construct
  REGION 1..134: note = anti-influenza_Chain
EVQLVVSGGGLVKPGGSLRLSCAASGLSFLNAWMSWVRQAPGKCLEWVGRIKSNTDGGTTDYAAPVKGRFSISRDDSKNMLFLHMSSLRTEDTAVYYCATDGPYSDDFRSGYAARYRYFGMDVWGQGTTVTVSS

SEQ ID NO: 5096 - protein, 134 aa, synthetic construct
  REGION 1..134: note = anti-influenza_Chain
EVQLVVSGGGLVKPGGSLRLSCAASGLSFLNAWMSWVRQAPGKGLEWVGRIKSNTDGGTTDYAAPVKGRFSISRDDSKNMLFLHMSSLRTEDTAVYYCATDGPYSDDFRSGYAARYRYFGMDVWGCGTTVTVSS

SEQ ID NO: 5097 - protein, 134 aa, synthetic construct
  REGION 1..134: note = anti-influenza_Chain
EVQLVESGGGLVKPGGSLRLSCAASGFTFLNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5098 - protein, 134 aa, synthetic construct
  REGION 1..134: note = anti-influenza_Chain
EVQLVESGGGLVKPGGSLRLSCAASGFTFLNAWMSWVRQAPGKCLEWVGRIKSNTDGGTTDYAAPVKGRFTISRDDSKNTLYLQMSSLKTEDTAVYYCTTDGPYSDDFRSGYAARYRYFGMDVWGQGTTVTVSS

SEQ ID NO: 5099 - protein, 134 aa, synthetic construct
  REGION 1..134: note = anti-influenza_Chain
EVQLVESGGGLVKPGGSLRLSCAASGFTFLNAWMSWVRQAPGKGLEWVGRIKSNTDGGTTDYAAPVKGRFTISRDDSKNTLYLQMSSLKTEDTAVYYCTTDGPYSDDFRSGYAARYRYFGMDVWGCGTTVTVSS

SEQ ID NO: 5100 - protein, 138 aa, synthetic construct
  REGION 1..138: note = anti-influenza_Chain
QVQLQESGGGLVQPGESLRLSCVGSGSSFGESTLSYYAVSWVRQAPGKGLEWLSIINAGGGDIDYADSVEGRFTISRDNSKETLYLQMTNLRVEDTGVYYCAKHMSMQQVVSAGWERADLVGDAFDVWGQGTMVTVSS

SEQ ID NO: 5101 - protein, 155 aa, synthetic construct
  REGION 1..155: note = anti-influenza_Chain
LSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKK

SEQ ID NO: 5102 - protein, 188 aa, synthetic construct
  REGION 1..188: note = anti-influenza_Chain
NVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKK

SEQ ID NO: 5103 - protein, 203 aa, synthetic construct
  REGION 1..203: note = anti-influenza_Chain
MLRSLVLNEKLRARVLERAEEFLLNNKADEEVWFRELVLCILTSNSSFISAYKSMNYILDKILYMDEKEISILLQESGYRFYNLKAKYLYRAKNLYGKVKKTIKEIADKDQMQAREFIATHIYGIGYKEASHFLRNVGYLDLAIIDRHILRFINNLGIPIKLKSKREYLLAESLLRSIANNLNVQVGLLDLFIFFKQTNTIVK

SEQ ID NO: 5104 - protein, 205 aa, synthetic construct
  REGION 1..205: note = anti-influenza_Chain
GLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGA

SEQ ID NO: 5105 - protein, 213 aa, synthetic construct
  REGION 1..213: note = anti-influenza_Chain
EIVLTQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5106 - protein, 213 aa, synthetic construct
  REGION 1..213: note = anti-influenza_Chain
DIQMTQSPSSLSASLGGNVTITCKASQDINKYIAWYQHKPGKGPRLVIHYTSTLQPGIPSRFSGSGSGTDYSFSISNLEPEDIATYYCLQYDILYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 5107 - protein, 214 aa, synthetic construct
  REGION 1..214: note = anti-influenza_Chain
DIQMTQSPSSLSASVGDRVTITCRASQGISSYLAWYQQKPGKVPTLLIYDASTLRSGVPSRFSGSGSATDFTLTISSLQPEDVATYYCQRYNSAPPITFGQGTRLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5108 - protein, 214 aa, synthetic construct
  REGION 1..214: note = anti-influenza_Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5109 - protein, 214 aa, synthetic construct
  REGION 1..214: note = anti-influenza_Chain
SYVLTQPPSVSVAPGETATVTCGGNNIGSKSVHWYQQKPGQAPVVVIYYDGDRPSGIPERFSGSNSGDTATLTISRVEAGDEADYYCLVWDYTSVHYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 5110 - protein, 214 aa, synthetic construct
  REGION 1..214: note = anti-influenza_Chain
DIQMTQTSSSLSASLGDRVTISCRASQDIRNYLNWYQQKPDGTVKLLIYYTSRLHSGVPSRFSDSGSGTDYSLTISNLEQEDLATYFCQQTYTLPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 5111 - protein, 215 aa, synthetic construct
  REGION 1..215: note = anti-influenza_Chain
DGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKK

SEQ ID NO: 5112 - protein, 215 aa, synthetic construct
  REGION 1..215: note = anti-influenza_Chain
DIQMTQSPSTLSASVGDRVTITCRASQTINNYLAWYQQKPGKAPKLLIYKASSLESGVPSRFSGSGSGTEFTLTISSLQPDDFATYYCQEYNNDSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5113 - protein, 215 aa, synthetic construct
  REGION 1..215: note = anti-influenza_Chain
SVLTQPPSASGSRGQSITISCTGSTSDIGSYNYVSWYQQHPGTAPKVILYEVSQRPSGVPDRFSGSKSGNTAFLTVSGLQAEDEADYYCASYAGNNIYVFGSGTKVTVLGQPKANPTVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 5114 - protein, 215 aa, synthetic construct
  REGION 1..215: note = anti-influenza_Chain
SALTQPPSASGSRGQSITISCTGSTSDIGSYNYVSWYQQHPGTAPKVILYEVSQRPSGVPDRFSGSKSGNTAFLTVSGLQAEDEADYYCASYAGNNIYVFGSGTKVTVLGQPKANPTVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 5115 - protein, 216 aa, synthetic construct
  REGION 1..216: note = anti-influenza_Chain
QSVLTQPPSESVSPGQTASVTCSGHKLGDKYVSWYQQKPGQSPVLLIYQDNRRPSGIPERFIGSNSGNTATLTISGTQALDEADYYCQAWDSSTAVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5116 - protein, 216 aa, synthetic construct
  REGION 1..216: note = anti-influenza_Chain
QSALTQPASVSGSPGQSITISCTGTSSDVGSYNLVSWYQQHPGKAPKLMIYEVSKRPSGVSNRFSGSKSGNTASLTISGLQAEDEADYYCHLYVGSSNWVFGGGTKLAVLGQPKAAPSVTLFPPSSKELQANKATLVCPISDFYPGAVTVAWKADSSPVKAGVETTTPSKQSNNKYAASSYLSLTPEQWKSHKSYSCQVTHEGSTVEKTVAPTECS

SEQ ID NO: 5117 - protein, 216 aa, synthetic construct
  REGION 1..216: note = anti-influenza_Chain
EIVLTQSPATLSVSPGERATLSCRASQSVDSNLAWYQQKPGQAPRLLVYSASTRATGIPARFSGSGSGTEFTLAISSLQSEDFAVYYCQHYTNWPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5118 - protein, 216 aa, synthetic construct
  REGION 1..216: note = anti-influenza_Chain
EIVLTQSPATLSVSPGERATLSCRASQSVSHNLAWYQQKPGQAPRLLVYSASTRATGIPARFSGSGSGTEFTLAISSLQSEDFAVYYCQHYTNYPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5119 - protein, 216 aa, synthetic construct
  REGION 1..216: note = anti-influenza_Chain
EIVMTQSPATLSVSPGERATLSCRASQSVDSNLAWYQQKPGQAPRLLVYSASTRATGIPARFSGSGSGTEFTLAISSLQSEDFAVYYCQHYTNWPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5120 - protein, 216 aa, synthetic construct
  REGION 1..216: note = anti-influenza_Chain
EIVLTQSPATLSVSPGERATLSCRASQSVSSNLAWYQQKPGQAPRLLVYSASTRATGIPARFSGSGSGTEFTLAISSLQSEDFAVYYCQHYTNWPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5121 - protein, 216 aa, synthetic construct
  REGION 1..216: note = anti-influenza_Chain
EIVLTQSPATLSVSPGERATLSCRASQSVDHNLAWYQQKPGQAPRLLVYSASTRATGIPARFSGSGSGTEFTLAISSLQSEDFAVYYCQHYTNWPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5122 - protein, 216 aa, synthetic construct
  REGION 1..216: note = anti-influenza_Chain
EIVLTQSPATLSVSPGERATLSCRASQSVSHNLAWYQQKPGQAPRLLVYSASTRATGIPARFSGSGSGTEFTLAISSLQSEDFAVYYCQHYTNWPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5123 - protein, 216 aa, synthetic construct
  REGION 1..216: note = anti-influenza_Chain
EIVLTQSPATLSVSPGERATLSCRASQSVSHNLAWYQQKPGQAPRLLVYSASTRATGIPARFSGSGSGTEFTLAISSLQSEDFAVYYCQHYTNFPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5124 - protein, 216 aa, synthetic construct
  REGION 1..216: note = anti-influenza_Chain
EIVLTQSPATLSVSPGERATLSCRASQSVDSNLAWYQQKPGQAPRLLVYSASTRATGIPARFSGSGSGTEFTLAISSLQSEDFAVYYCQHYTNFPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5125 - protein, 216 aa, synthetic construct
  REGION 1..216: note = anti-influenza_Chain
EIVLTQSPATLSVSPGERATLSCRASQSVDSNLAWYQQKPGQAPRLLVYSASTRATGIPARFSGSGSGTEFTLAISSLQSEDFAVYYCQHYTNYPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5126 - protein, 216 aa, synthetic construct
  REGION 1..216: note = anti-influenza_Chain
ETTLTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5127 - protein, 216 aa, synthetic construct; identical to SEQ ID NO: 1008
  REGION 1..216: note = anti-influenza_Chain

SEQ ID NO: 5128 - protein, 216 aa, synthetic construct
  REGION 1..216: note = anti-influenza_Chain
EIVLTQSPATLSVSPGERATLSCRASQVISHNLAWYQQKPGQAPRLLIYGASTRASGIPARFSGSGSGTDYTLTITSLQPEDFAVYYCQHYSNWPPRLTFGGGTKVEIKRTVAAPSVSIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5129 - protein, 216 aa, synthetic construct
  REGION 1..216: note = anti-influenza_Chain
EIVMTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5130 - protein, 216 aa, synthetic construct
  REGION 1..216: note = anti-influenza_Chain
EIVLTQSPATLSVSPGERATLSCRASQVISHNLAWYQQKPGQAPRLLIYGASTRASGIPARFSGSGSGTDYTLTITSLQSEDFAVYYCQHYSNFPPRLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5131 - protein, 216 aa, synthetic construct
  REGION 1..216: note = anti-influenza_Chain
EIVLTQSPATLSVSPGERATLSCRASQVISHNLAWYQQKPGQAPRLLIYGASTRASGIPARFSGSGSGTDYTLTITSLQSEDFAVYYCQHYSNYPPRLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5132 - protein, 216 aa, synthetic construct
  REGION 1..216: note = anti-influenza_Chain
EIVLTQSPATLSVSPGERVTLSCRASQSVANNLAWYQQKPGQSPRLLIYGASTRDTGIPARFSGSGSGTEFTLTISSLQSEDFAVYYCQQYNNWPPMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5133 - protein, 216 aa, synthetic construct
  REGION 1..216: note = anti-influenza_Chain
DIVMTQSPSTLSASVGDRVTITCRASQSIGNWLAWYQQKPGKAPKLLIYKVSTLESGVPSRFSGSGSGTEFTLTINSLQPDDFATYYCQRYTSNSQGFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5134 - protein, 216 aa, synthetic construct
  REGION 1..216: note = anti-influenza_Chain
DIQLTQSPLSPPVTLGQPASISCRSSQSLLYTDGFTYLSWYHQRPGQSPRRLIYKISNRDSGVPDRFSGSGSGTDFTLKISRVEAEDVGVYYCMQATHWPLTFGEGTKVEIKPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 5135 - protein, 216 aa, synthetic construct
  REGION 1..216: note = anti-influenza_Chain
EIVLTQSPGTLSLSPGERATLSCRASQSVRSNNLAWYQHKPGQAPRLLIFGASSRATGIPDRFSGSGSGTDFTLTISRLEPEDFAVYYCQQYGSSPALTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5136 - protein, 216 aa, synthetic construct
  REGION 1..216: note = anti-influenza_Chain
QSVLTQPPSASGSRGQSITISCTGSTSDIGSYNYVSWYQQHPGTAPKVILYEVSQRPSGVPDRFSGSKSGNTAFLTVSGLQTDDEADYYCASYAGNNIYVFGSGTKVTVLGQPKANPTVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 5137 - protein, 217 aa, synthetic construct
  REGION 1..217: note = anti-influenza_Chain
QPVLTQPPSASGSPGQRVTISCSGSSSNIGSYTVNWYQQLPGTAPKLLIYSLNQRPSGVPDRFSGSKSGTSASLAISGLQSEDEAVYYCAAWDDSLSAHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5138 - protein, 217 aa, synthetic construct
  REGION 1..217: note = anti-influenza_Chain
QPVLTQPPSASGTPGQRVTISCSGSSSNIGSNTVSWYQQVPGTAPKLLIYGNNERPSGVPDRFSGSKSATSASLAISGLQSEDEADYYCAAWDDSLNGFWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 5139 - protein, 217 aa, synthetic construct
  REGION 1..217: note = anti-influenza_Chain
SYVLTQPPSVSGTPGQRVIISCSGYSSNIGSNTVNWYQQFPGTAPRLLIYANNQRPPGVPDRFSGSKSGTSASLAISGLQSDDESDYYCAAWDDSLNGHWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5140 - protein, 218 aa, synthetic construct
  REGION 1..218: note = anti-influenza_Chain
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHAVFGGGTQLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5141 - protein, 218 aa, synthetic construct
  REGION 1..218: note = anti-influenza_Chain
QSVVTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5142 - protein, 218 aa, synthetic construct
  REGION 1..218: note = anti-influenza_Chain
LSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPL

SEQ ID NO: 5143 - protein, 219 aa, synthetic construct
  REGION 1..219: note = anti-influenza_Chain
SSELTQPPSASGTPGQRVTISCSGSTSNIGYNPVSWYQQVPGTAPKLLIYSNTERPSGVPDRFSGSKSGTSASLAISGLQSEDEADYYCAAWDDTLNGPVFGGGTKVTVLGQRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5144 - protein, 219 aa, synthetic construct; identical to SEQ ID NO: 1024
  REGION 1..219: note = anti-influenza_Chain

SEQ ID NO: 5145 - protein, 220 aa, synthetic construct
  REGION 1..220: note = anti-influenza_Chain
SYVLTQPPSASGTPGQRVTISCSGSTFNIGSNAVDWYRQLPGTAPKLLIYSNNQRPSGVPDRFSGSRSGTSASLAISGLQSEDEADYYCAAWDDILNVPVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5146 - protein, 220 aa, synthetic construct
  REGION 1..220: note = anti-influenza_Chain
QSALTQPAAVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5147 - protein, 220 aa, synthetic construct
  REGION 1..220: note = anti-influenza_Chain
SYVLTQPPSVSGTPGQRVTISCSGSRSNVGDNSVYWYQHVPEMAPKLLVYKNTQRPSGVPARFSGSKSGTSASLAIIGLQSGDEADYYCVAWDDSVDGYVFGSGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5148 - protein, 220 aa, synthetic construct
  REGION 1..220: note = anti-influenza_Chain
SYVLTQPPSASGTPGQRVTISCSGSSSNIGSNYVYWYQQLPGTAPKLLIYRDGQRPSGVPDRFSGSKSGTSASLAISGLRSDDEADYYCATWDDNLSGPVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5149 - protein, 220 aa, synthetic construct
  REGION 1..220: note = anti-influenza_Chain
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5150 - protein, 220 aa, synthetic construct
  REGION 1..220: note = anti-influenza_Chain
TVLTQPPSVSGAPGQRVTISCTGSSSNIGAGYDVHWYQQLPGTAPKLLIYGNSNRPSGVPDRFSGSKSGTSATLGITGLQTGDEADYYCGTWDSSLSAYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5151 - protein, 221 aa, synthetic construct
  REGION 1..221: note = anti-influenza_Chain
QSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5152 - protein, 225 aa, synthetic construct
  REGION 1..225: note = anti-influenza_Chain
MVGFTPVALAALAATGALAFPAGNATELEKRQTTPNSEGWHDGYYYSWWSDGGAQATYTNLEGGTYEISWGDGGNLVGGKGWNPGLNARAIHFEGVYQPNGNSYLAVYGWTRNPLVEYYIVENFGTYDPSSGATDLGTVECDGSIYRLGKTTRVNAPSIDGTQTFDQYWSVRQDKRTSGTVQTGCHFDAWARAGLNVNGDHYYQIVATEGYFSSGYARITVADVG

SEQ ID NO: 5153 - protein, 229 aa, synthetic construct
  REGION 1..229: note = anti-influenza_Chain
RSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5154 - protein, 232 aa, synthetic construct
  REGION 1..232: note = anti-influenza_Chain
HAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKK

SEQ ID NO: 5155 - protein, 233 aa, synthetic construct
  REGION 1..233: note = anti-influenza_Chain
MRPSIQFLGLLLFWLHGGQCDIQMTQSPSSLSASLGGNVTITCKASQDINKYIAWYQHKPGKGPRLVIHYTSTLQPGIPSRFSGSGSGTDYSFSISNLEPEDIATYYCLQYDILYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 5156 - protein, 234 aa, synthetic construct
  REGION 1..234: note = anti-influenza_Chain
MMSSAQFLGLLLLCFQGTRCDIQMTQTSSSLSASLGDRVTISCRASQDIRNYLNWYQQKPDGTVKLLIYYTSRLHSGVPSRFSDSGSGTDYSLTISNLEQEDLATYFCQQTYTLPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 5157 - protein, 234 aa, synthetic construct
  REGION 1..234: note = anti-influenza_Chain
MEAPAQLLFLLLLWLPDTTGEIVLTQSPATLSLSPGERATLSCRASENIWNNLAWYQQKPGQAPRLLISGASTGATGVPSRFRGSGSRTEFTLTISSLQSEDFAIYFCQQYNSWPRTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5158 - protein, 235 aa, synthetic construct
  REGION 1..235: note = anti-influenza_Chain
METPAQLLFLLLLWLPDTTGEIVLTQSPGTLSLSPGERATLSCRASQSLSSSSLVWYQQKPGQAPRLLIYGASSRATGIPDRFSGSGSGTDFTLTISRLEPEDFAVYYCQQYGNSPYTFGQGTQVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5159 - protein, 235 aa, synthetic construct
  REGION 1..235: note = anti-influenza_Chain
METPAQLLFLLLLWLPDTTGETVLTQSPGTLSLSPGERATLSCRASQSVSISYLAWYQRKPGQAPRLLIYGASRRATGIPDRFSGSGSGTDFTLTISRLEPEDFAVYYCQQYGSSPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5160 - protein, 235 aa, synthetic construct
  REGION 1..235: note = anti-influenza_Chain
MAWMMLLLTLLIHCTGSWAQSVLTQPPSVSAAPGQKVTISCSGSSSNIGKNYVSWYQQLPGTAPKLLIYDNDKRPSGIPDRFSGSKSGTSATLGITGLQTGDEADYHCGAWDSSLNGGVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5161 - protein, 238 aa, synthetic construct
  REGION 1..238: note = anti-influenza_Chain
MMKKKSWFTLMITGVISLFFSVSAFAGNVFWEPLSYFNSSTWQKADGYSNGQMFNCTWRANNVNFTNDGKLKLSLTSPANNKFDCGEYRSTNNYGYGLYEVSMKPAKNTGIVSSFFTYTGPSHGTQWDEIDIEFLGKDTTKVQFNYYTNGVGGHEKIINLGFDASTSFHTYAFDWQPGYIKWYVDGVLKHTATTNIPSTPGKIMMNLWNGTGVDSWLGSYNGANPLYAEYDWVKYTSN

SEQ ID NO: 5162 - protein, 243 aa, synthetic construct
  REGION 1..243: note = anti-influenza_Chain
QVQLVQSGAEVKKPGSSVKVSCKASGGTFSSYAISWVRQAPGQGLEWMGGIMGMFGTTNYAQKFQGRVTITADEFTSAAYMELRSLRSEDTAVYYCARSSGYYPEYFQDWGQGTLVTVSSGTGGSGGTGSGTGGSTQSVLTQPPSESVSPGQTASVTCSGHKLGDKYVSWYQQKPGQSPVLLIYQDNRRPSGIPERFIGSNSGNTATLTISGTQALDEADYYCQAWDSSTAVFGGGTKLTVLG

SEQ ID NO: 5163 - protein, 243 aa, synthetic construct
  REGION 1..243: note = anti-influenza_Chain
QVQLVQSGAEVKKPGSSVKVSCKASGGPFRNFAINWVRQAPGQGLEWMGGIIAVFGTTKYAHKFQGRVTITADDSTNTAYMELGSLKSEDTAVYYCARGPHYYSSYMDVWGEGTTVTVSSGTGGSGGTGSGTGGSTDIQLTQSPSSLSASVGDRVTITCRASQGISTYLAWYQQKPGKVPKLLIYAASTLQSGVPSRFSGSGSGTDFTLTISSLQPEDVATYYCQKYNSAPSFGPGTKVDIKR

SEQ ID NO: 5164 - protein, 243 aa, synthetic construct
  REGION 1..243: note = anti-influenza_Chain
MSYRVKRMLMLLVTGLFLSLSTFAASASAQTGGSFYEPFNNYNTGLWQKADGYSNGNMFNCTWRANNVSMTSLGEMRLSLTSPSYNKFDCGENRSVQTYGYGLYEVNMKPAKNVGIVSSFFTYTGPTDGTPWDEIDIEFLGKDTTKVQFNYYTNGVGNHEKIVNLGFDAANSYHTYAFDWQPNSIKWYVDGQLKHTATTQIPQTPGKIMMNLWNGAGVDEWLGSYNGVTPLSRSLHWVRYTKR

SEQ ID NO: 5165 - protein, 245 aa, synthetic construct
  REGION 1..245: note = anti-influenza_Chain
QVQLQQSGAEVKKPGSSVKVSCKVSGVIFSGSAISWVRQAPGQGLEWMGGISPLFGTTNYAQKFQGRVTITADQSTNTTYMEVNSLRYEDTAVYFCARGPKYYSEYMDVWGKGTTVTVSSGTGGSGGTGSGTGGSTDIQMTQSPSSLSASVGDRVTITCRASQGISSYLAWYQQKPGKVPTLLIYDASTLRSGVPSRFSGSGSATDFTLTISSLQPEDVATYYCQRYNSAPPITFGQGTRLEIKR

SEQ ID NO: 5166 - protein, 245 aa, synthetic construct
  REGION 1..245: note = anti-influenza_Chain
EVQLVESGAEVKKPGSSVKVSCKASGGTFSSYGISWVRQAPGQGLEWMGDIIGMFGSTNYAQNFQGRLTITADESTSTAYMELSSLRSEDTAVYYCARSSGYYPAYLPHWGQGTLVTVSSGTGGSGGTGSGTGGSTEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGGGTKVEIKR

SEQ ID NO: 5167 - protein, 245 aa, synthetic construct
  REGION 1..245: note = anti-influenza_Chain
EVQLVESGAEVKKPGSSVKVSCKASGGTFSSYAISWVRQAPGQGLEWMGGIIGMFGTANYAQKFQGRVTITADEFTSTAYMELSSLRSEDTAVYYCARGNYYYESSLDYWGQGTLVTVSSGTGGSGGTGSGTGGSTQSVVTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLG

SEQ ID NO: 5168 - protein, 245 aa, synthetic construct
  REGION 1..245: note = anti-influenza_Chain
EVQLVQSGAEVKKPGASVKVSCKASGYTFTGYYVYWVRQAPGQGLEWMGWISAYNGNTNYAQKFQGRVTITADKSTSTAYMELSSLRSEDTAVYYCARSRSLDVWGQGTTVTVSSGTGGSGGTGSGTGGSTDVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVDIKR

SEQ ID NO: 5169 - protein, 245 aa, synthetic construct
  REGION 1..245: note = anti-influenza_Chain
EVQLVETGAEVKKPGSSVKVPCKSSGSPFRSNAVSWVRQAPGQGLEWVGGILGVFGSPSYAQKFQGRVTITADESTNTVHMELRGLRSEDTAVYYCARGPTYYYSYMDVWGKGTTVTVSSGTGGSGGTGSGTGGSTSYVLTQPPSESVAPGQTARITCGGNNIGRNSVHWYQQKPGQAPVLVVYDDSDRPSGIPERFSGSKSGNTATLIISRVEVGDEADYYCQVWHSSSDHYVFGTGTKVTVLG

SEQ ID NO: 5170 - protein, 245 aa, synthetic construct
  REGION 1..245: note = anti-influenza_Chain
QMQLVQSGAEVKKPGSSVKVSCKASGGTFSSYAISWVRQAPGQGLEWMGGIFGMFGTANYAQKFQGRVTITADEFTSAAYMELSSLGSEDTAMYYCARSSGYYPQYFQDWGQGTLVTVSSGTGGSGGTGSGTGGSTEIVMTQSPGTLSLSPGQRATLSCRASQSVSSSYLAWYQQKPGQAPRLLMYGASSRATGIPDRFSGSGSGTDFTLTISRLEPEDFAVYYCQQYGSSSLTFGGGTKLEIKR

SEQ ID NO: 5171 - protein, 245 aa, synthetic construct
  REGION 1..245: note = anti-influenza_Chain
QVQLVQSGAEVKKPGSSVKVSCKASGVTFSYYAMSWVRQAPGQGLEWMGGISPMFGTTTYAQKFQGRVTITADDSTSTAYMEVRSLRSEDTAVYYCARSSNYYDSVYDYWGQGTLVTVSSGTGGSGGTGSGTGGSTQSVVTQPPSESVAPGQTARITCGGHNIGSNSVHWYQQKPGQAPVLVVYDNSDRPSGIPERFSGSNSGNTATLTISRVEAGDEADYYCQVWGSSSDHYVFGTGTKVTVLG

SEQ ID NO: 5172 - protein, 246 aa, synthetic construct
  REGION 1..246: note = anti-influenza_Chain
QVQLVQSGGGLVKPGGSLRLSCAASGFTFSSYSMNWVRQAPGKGLEWVSSISSSSSYIYYVDSVKGRFTISRDNAKNSLYLQMNSLRAEDTAVYYCARGGGSYGAYEGFDYWGQGTLVTVSSGTGGSGGTGSGTGGSTEIVLTQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKR

SEQ ID NO: 5173 - protein, 246 aa, synthetic construct
  REGION 1..246: note = anti-influenza_Chain
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSVSVAPGQTARITCGGNNIGSKSVHWYQQKPGQAPVLVVYDDSDRPSGIPERFSGSNSGNTATLTISRVEAGDEADYYCQVWDSSSDHAVFGGGTQLTVLG

SEQ ID NO: 5174 - protein, 246 aa, synthetic construct
  REGION 1..246: note = anti-influenza_Chain
EVQLVETGAEVKKPGASVKVSCKASGYTFTSYYMHWVRQAPGQGLEWMGWINPNSGGTNYAQKFQGRVTMTRDTSISTAYMELSRLRSDDTAVYYCAREGKWGPQAAFDIWGQGTMVTVSSGTGGSGGTGSGTGGSTEIVMTQSPGTLSLSPGERATLSCRASQSVSSSYLAWYQQKPGQAPRLLIYDASSRATDIPDRFSGSGSGTDFTLTISRLEPEDFAVYYCQQYGSSLWTFGQGTKVEIKR

SEQ ID NO: 5175 - protein, 246 aa, synthetic construct
  REGION 1..246: note = anti-influenza_Chain
EVQLVESGGGLVQPGGSLRLSCAASGFTFSIYAMSWVRQAPGKGLEWVSAISSSGDSTYYADSVKGRFTISRDNARNTLYLQMNSLRAEDTAVYYCARAYGYTFDPWGQGTLVTVSSGTGGSGGTGSGTGGSTEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKR

SEQ ID NO: 5176 - protein, 246 aa, synthetic construct
  REGION 1..246: note = anti-influenza_Chain
EVQLVETGAEVKKPGSSVKVSCKASGGTFRTHAISWVRQAPGQGLEWMGGIIAIFGTANYAQKFQGRITITADESTSTAYMELSSLRSEDTAVYFCARGSGYHISTPFDNWGQGTLVTVSSGTGGSGGTGSGTGGSTSYVLTQPPSVSVAPGQTARITCGGNNIGSKGVHWYQQKPGQAPVLVVYDDSDRPSGIPERFSGSNSGNTATLTISRVEAGDEADYYCQVWDSSSDHVVFGGGTKLTVLG

SEQ ID NO: 5177 - protein, 246 aa, synthetic construct
  REGION 1..246: note = anti-influenza_Chain
EVQLVQSGAEVKKPGSSVKVSCKASGGIFRSNSISWVRQAPGQGLEWMGGIFALFGTTDYAQKFQGRVTITADESSTTVYLELSSLTSEDTAVYYCARGSGYTTRNYFDYWGQGTLVTVSSGTGGSGGTGSGTGGSTEIVLTQSPGTLSLSPGERATLSCRASQSVSSNYLGWYQQKPGQAPRLLIYGASSRASGIPDRFSGGGSGTDFTLTISRLEPEDFAVYYCQQYGSSPLTFGGGTKVEIKR

SEQ ID NO: 5178 - protein, 246 aa, synthetic construct
  REGION 1..246: note = anti-influenza_Chain
EVQLVESGAEVKKPGSSVKVSCKASGGIFNSYAISWVRQAPGQGLEWMGGIIAIFHTPKYAQKFQGRVTITADESTNTAYMELRSLKSEDTALYYCARGSTYDFSSGLDYWGQGTLVTVSSGTGGSGGTGSGTGGSTQAGLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLG

SEQ ID NO: 5179 - protein, 247 aa, synthetic construct
  REGION 1..247: note = anti-influenza_Chain
QMQLVQSGAEVKKPGSSVKVSCKASGGTFSSYAITWVRQAPGQGLEWMGGIIGMFGSTNYAQNFQGRVTITADESTSTAYMELSSLRSEDTAVYYCARSTGYYPAYLHHWGQGTLVTVSSGTGGSGGTGSGTGGSTQSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLG

SEQ ID NO: 5180 - protein, 248 aa, synthetic construct
  REGION 1..248: note = anti-influenza_Chain
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSASGTPGQRVTISCSGSTFNIGSNAVDWYRQLPGTAPKLLIYSNNQRPSGVPDRFSGSRSGTSASLAISGLQSEDEADYYCAAWDDILNVPVFGGGTKLTVLG

SEQ ID NO: 5181 - protein, 248 aa, synthetic construct
  REGION 1..248: note = anti-influenza_Chain
QVQLVQSGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTQSALTQPAAVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVLG

SEQ ID NO: 5182 - protein, 248 aa, synthetic construct
  REGION 1..248: note = anti-influenza_Chain
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSVSGTPGQRVTISCSGSRSNVGDNSVYWYQHVPEMAPKLLVYKNTQRPSGVPARFSGSKSGTSASLAIIGLQSGDEADYYCVAWDDSVDGYVFGSGTKVTVLG

SEQ ID NO: 5183 - protein, 248 aa, synthetic construct
  REGION 1..248: note = anti-influenza_Chain
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSASGTPGQRVTISCSGSSSNIGSNYVYWYQQLPGTAPKLLIYRDGQRPSGVPDRFSGSKSGTSASLAISGLRSDDEADYYCATWDDNLSGPVFGGGTKLTVLG

SEQ ID NO: 5184 - protein, 248 aa, synthetic construct
  REGION 1..248: note = anti-influenza_Chain
EVQLVESGAEVKKPGSSVKVSCKASGGTFSFYSMSWVRQAPGQGLEWMGGIIPMFGTTNYAQKFQGRVTITAVESTSTAYMEVSSLRSEDTAVYYCARGDKGIYYYYMDVWGKGTTVTVSSGTGGSGGTGSGTGGSTQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVLG

SEQ ID NO: 5185 - protein, 248 aa, synthetic construct
  REGION 1..248: note = anti-influenza_Chain
MSLFGDTIAYLLSLIEDGEGKAELAEKLHCWFGGKEFDLDSALEWIKNKRCLTDIQKALIGASICFLKPKDQERKRRFITEPLSGMGTTATKKKGLILAERKMRRCVSFHEAFEIAEGHESSALLYCLMVMYLNPENYSMQVKLGTLCALCEKQASHSHRAHSRAARSSVPGVRREMQMVSAMNTAKTMNGMGKGEDVQKLAEELQNNIGVLRSLGASQKNGEGIAKDVMEVLKQSSMGNSALVRKYL

SEQ ID NO: 5186 - protein, 249 aa, synthetic construct
  REGION 1..249: note = anti-influenza_Chain
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTQSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLG

SEQ ID NO: 5187 - protein, 250 aa, synthetic construct
  REGION 1..250: note = anti-influenza_Chain
QVQLVQSGAEVKKPGSSVRVSCKASGSIFRNYAMSWVRQAPGQGLEWMGGIIAIFGTPKYAQKFQGRVTITADESTSTVYMELSGLRSEDTAMYYCARIPHYNFGSGSYFDYWGQGTLVTVSSGTGGSGGTGSGTGGSTTVLTQPPSVSGAPGQRVTISCTGSSSNIGAGYDVHWYQQLPGTAPKLLIYGNSNRPSGVPDRFSGSKSGTSATLGITGLQTGDEADYYCGTWDSSLSAYVFGTGTKVTVLG

SEQ ID NO: 5188 - protein, 252 aa, synthetic construct
  REGION 1..252: note = anti-influenza_Chain
EVQLVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSSGTGGSGGTGSGTGGSTEIVMTQSPGTLSLSPGERATLSCRASQSVSSSYLAWYQQKPGQAPRLLIFGASSRATGIPDRFSGSGSGTDFTLTISRLEPEDFAVYYCQQYGSSLTFGGGTKLEIKR

SEQ ID NO: 5189 - protein, 256 aa, synthetic construct
  REGION 1..256: note = anti-influenza_Chain
QVQLVQSGAEVKKPGSSVKVSCKASGGFFSSYAISWVRQAPGQGLEWMGGVIPIFRTANYAQNFQGRVTITADEFTSYMELSSLRSDDTAVYYCARLNYHDSGTYYNAPRGWFDPWGQGTLVTVSSGTGGSGGTGSGTGGSTDIQMTQSPDSLAVSLGEKATINCKSSQSILNSSNNKNYLAWYQQKPGQPPKLLIYWASTRESGVPDRFSGSGSGTDFTLTISSLQAEDVAVYYCQQYYSSPPTFGQGTKVEIKR

SEQ ID NO: 5190 - protein, 256 aa, synthetic construct; identical to SEQ ID NO: 5189
  REGION 1..256: note = anti-influenza_Chain

SEQ ID NO: 5191 - protein, 257 aa, synthetic construct
  REGION 1..257: note = anti-influenza_Chain
ICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKK

SEQ ID NO: 5192 - protein, 257 aa, synthetic construct; identical to SEQ ID NO: 5191
  REGION 1..257: note = anti-influenza_Chain

SEQ ID NO: 5193 - protein, 259 aa, synthetic construct
  REGION 1..259: note = anti-influenza_Chain
MVKSKYLVFISVFSLLFGVFVVGFSHQGVKAEEERPMGTAFYESFDAFDDERWSKAGVWTNGQMFNATWYPEQVTADGLMRLTIAKKTTSARNYKAGELRTNDFYHYGLFEVSMKPAKVEGTVSSFFTYTGEWDWDGDPWDEIDIEFLGKDTTRIQFNYFTNGVGGNEFYYDLGFDASESFNTYAFEWREDSITWYVNGEAVHTATENIPQTPQKIMMNLWPGVGVDGWTGVFDGDNTPVYSYYDWVRYTPLQNYQIHQ

SEQ ID NO: 5194 - protein, 259 aa, synthetic construct; identical to SEQ ID NO: 5193
  REGION 1..259: note = anti-influenza_Chain

SEQ ID NO: 5195 - protein, 261 aa, synthetic construct
  REGION 1..261: note = anti-influenza_Chain
DIQMTQSPSSVSASVGDRVTITCRASQDISTWLAWYQQKPGKAPKLLIYAASSLQSGVPSRFSGSGSGTDFTLTISSLQPEDFATYFCQQANSFPPTFGCGTKLEIKGGGGSGGGGSGGGGSGGGGSEVQLVVSGGGLVKPGGSLRLSCAASGLSFLNAWMSWVRQAPGKCLEWVGRIKSNTDGGTTDYAAPVKGRFSISRDDSKNMLFLHMSSLRTEDTAVYYCATDGPYSDDFRSGYAARYRYFGMDVWGQGTTVTVSS

SEQ ID NO: 5196 - protein, 261 aa, synthetic construct; identical to SEQ ID NO: 5195
  REGION 1..261: note = anti-influenza_Chain

SEQ ID NO: 5197 - protein, 263 aa, synthetic construct
  REGION 1..263: note = anti-influenza_Chain
MGFVLFSQLPSFLLVSTLLLFLVISHSCRAQNGGSYPYKSGEYRTKSFFGYGYYEVRMKAAKNVGIVSSFFTYTGPSDNNPWDEIDIEFLGKDTTKVQFNWYKNGVGGNEYLHNLGFDASQDFHTYGFEWRPDYIDFYVDGKKVYRGTRNIPVTPGKIMMNLWPGIGVDEWLGRYDGRTPLQAEYEYVKYYPNGRSKLVVNTPFVAVFSNFDSSQWEKADWANGSVFNCVWKPSQVTFSNGKMILTLDREYVDHHHHHHKDEL

SEQ ID NO: 5198 - protein, 263 aa, synthetic construct; identical to SEQ ID NO: 5197
  REGION 1..263: note = anti-influenza_Chain

SEQ ID NO: 5199 - protein, 280 aa, synthetic construct
  REGION 1..280: note = anti-influenza_Chain
MAQVGRGASPLSRARVPPLPHPLDGEHLPHDPAGGGHGKASSQDAPVGQLPGHLARPAFFHYLKNSFLVCSLTTVFALAVATFAGYALARFRFPGAELFGGSVLVTQVIPGILFLIPIYIMYIYVQNWVRSALGLEVRLVGSYGGLVFTYTAFFVPLSIWILRGFFASIPKELEEAAMVDGATPFQAFHRVILPLALPGLAATAVYIFLTAWDELLFAQVLTTEATATVPVGIRNFVGNYQNRYDLVMAAATVATLPVLVLFFFVQRQLIQGLTAGAVKG

SEQ ID NO: 5200 - protein, 280 aa, synthetic construct; identical to SEQ ID NO: 5199
  REGION 1..280: note = anti-influenza_Chain

SEQ ID NO: 5201 - protein, 281 aa, synthetic construct
  REGION 1..281: note = anti-influenza_Chain
MADNMTTTQIEVGPGATNATINFEAGILECYERFSWQRALDYPGQDRLHRLKRKLESRIKTHNKSEPENKRMSLEERKAIGVKMMKVLLFMDPSAGIEGFEPYCVKNPSTSKCPNYDWTDYPPTPGKYLDDIEEEPENVDHPIEVVLRDMNNKDARQKIKDEVNTQKEGKFRLTIKRDIRNVLSLRVLVNGTFLKHPNGDKSLSTLHRLNAYDQNGGLVAKLVATDDRTVEDEKDGHRILNSLFERFDEGHSKPIRAAETAVGVLSQFGQEHRLSPEEGDN

SEQ ID NO: 5202 - protein, 281 aa, synthetic construct; identical to SEQ ID NO: 5201
  REGION 1..281: note = anti-influenza_Chain

SEQ ID NO: 5203 - protein, 286 aa, synthetic construct
  REGION 1..286: note = anti-influenza_Chain
MCTMPLMKLKKMMRRTAFLLSVLIGCSMLGSDRSDKAPHWELVWSDEFDYSGLPDPEKWDYDVGGHGWGNQELQYYTRARIENARVGGGVLIIEARHEPYEGREYTSARLVTRGKASWTYGRFEIRARLPSGRGTWPAIWMLPDRQTYGSAYWPDNGEIDIMEHVGFNPDVVHGTVHTKAYNHLLGTQRGGSIRVPTARTDFHVYAIEWTPEEIRWFVDDSLYYRFPNERLTDPEADWRHWPFDQPFHLIMNIAVGGAWGGQQGVDPEAFPAQLVVDYVRVYRWVE

SEQ ID NO: 5204 - protein, 286 aa, synthetic construct; identical to SEQ ID NO: 5203
  REGION 1..286: note = anti-influenza_Chain

SEQ ID NO: 5205 - protein, 300 aa, synthetic construct
  REGION 1..300: note = anti-influenza_Chain
NVPEWSYIVEKANPANDLCYPGNFNDYEELKHLLSRINHFEKIQGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5206 - protein, 300 aa, synthetic construct; identical to SEQ ID NO: 5205
  REGION 1..300: note = anti-influenza_Chain

SEQ ID NO: 5207 - protein, 309 aa, synthetic construct
  REGION 1..309: note = anti-influenza_Chain
MVNRRDLIKWSAVALGAGAGLAGPAPAAHAADLEWEQYPVPAAPGGNRSWQLLPSHSDDFNYTGKPQTFRGRWLDQHKDGWSGPANSLYSARHSWVADGNLIVEGRRAPDGRVYCGYVTSRTPVEYPLYTEVLMRVSGLKLSSNFWLLSRDDVNEIDVIECYGNESLHGKHMNTAYHIFQRNPFTELARSQKGYFADGSYGYNGETGQVFGDGAGQPLLRNGFHRYGVHWISATEFDFYFNGRLVRRLNRSNDLRDPRSRFFDQPMHLILNTESHQWRVDRGIEPTDAELADPSINNIYYRWVRTYQAV

SEQ ID NO: 5208 - protein, 309 aa, synthetic construct; identical to SEQ ID NO: 5207
  REGION 1..309: note = anti-influenza_Chain

SEQ ID NO: 5209 - protein, 320 aa, synthetic construct
  REGION 1..320: note = anti-influenza_Chain
ICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPL

SEQ ID NO: 5210 - protein, 320 aa, synthetic construct; identical to SEQ ID NO: 5209
  REGION 1..320: note = anti-influenza_Chain

SEQ ID NO: 5211 - protein, 320 aa, synthetic construct; identical to SEQ ID NO: 5209
  REGION 1..320: note = anti-influenza_Chain

SEQ ID NO: 5212 - protein, 326 aa, synthetic construct
  REGION 1..326: note = anti-influenza_Chain
TLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSR

SEQ ID NO: 5213 - protein, 326 aa, synthetic construct; identical to SEQ ID NO: 5212
  REGION 1..326: note = anti-influenza_Chain

SEQ ID NO: 5214 - protein, 320 aa, synthetic construct; identical to SEQ ID NO: 5209
  REGION 1..320: note = anti-influenza_Chain

SEQ ID NO: 5215 - protein, 330 aa, synthetic construct
  REGION 1..330: note = anti-influenza_Chain
MCSSIPSLREVFANDFRIGAAVNPVTLEAQQSLLIRHVNSLTAENHMKFEHLQPEEGRFTFDIAIKSSTSPFSSHGVRGHTLVWHNQTPSWVFQDSQGHFVGRDVLLERMKSHISTVVQRYKGKVYCWDVINEAVADEGSEWLRSSTWRQIIGDDFIQQAFLYAHEADPEALLFYNDYNECFPEKREKIYTLVKSLRDKGIPIHGIGMQAHWSLNRPTLDEIRAAIERYASLGVILHITELDISMFEFDDHRKDLAAPTNEMVERQAERYEQIFSLFKEYRDVIQNVTFWGIADDHTWLDHFPVQGRKNWPLLFDEQHNPKPAFWRVVNI

SEQ ID NO: 5216 - protein, 330 aa, synthetic construct; identical to SEQ ID NO: 5215
  REGION 1..330: note = anti-influenza_Chain

SEQ ID NO: 5217 - protein, 334 aa, synthetic construct
  REGION 1..334: note = anti-influenza_Chain
MKNRVISLLMASLLLVLSVIVAPFYKAEAATVVNTPFVAVFSNFDSSQWEKADWANGSVFNCVWKPSQVTFSNGKMILTLDREYGGSYPYKSGEYRTKSFFGYGYYEVRMKAAKNVGIVSSFFTYTGPSDNNPWDEIDIEFLGKDTTKVQFNWYKNGVGGNEYLHNLGFDASQDFHTYGFEWRPDYIDFYVDGKKVYRGTRNIPVTPGKIMMNLWPGIGVDEWLGRYDGRTPLQAEYEYVKYYPNGVPQDNPTPTPTIAPSTPTNPNLPLKGDVNGDGHVNSSDYSLFKRYLLRVIDRFPVGDQSVADVNRDGRIDSTDLTMLKRYLIRAIPSL

SEQ ID NO: 5218 - protein, 334 aa, synthetic construct; identical to SEQ ID NO: 5217
  REGION 1..334: note = anti-influenza_Chain

SEQ ID NO: 5219 - protein, 347 aa, synthetic construct
  REGION 1..347: note = anti-influenza_Chain
ICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLGYIPEAPRDGQAYVRKDGEWVLLSTFL

SEQ ID NO: 5220 - protein, 347 aa, synthetic construct; identical to SEQ ID NO: 5219
  REGION 1..347: note = anti-influenza_Chain

SEQ ID NO: 5221 - protein, 349 aa, synthetic construct
  REGION 1..349: note = anti-influenza_Chain
MNIKKTAVKSALAVAAAAAALTTNVSAKDFSGAELYTLEEVQYGKFEARMKMAAASGTVSSMFLYQNGSEIADGRPWVEVDIEVLGKNPGSFQSNIITGKAGAQKTSEKHHAVSPAADQAFHTYGLEWTPNYVRWTVDGQEVRKTEGGQVSNLTGTQGLRFNLWSSESAAWVGQFDESKLPLFQFINWVKVYKYTPGQGEGGSDFTLDWTDNFDTFDGSRWGKGDWTFDGNRVDLTDKNIYSRDGMLILALTRKGQESFNGQVPRDDEPAPQSSSSAPASSSSVPASSSSVPASSSSAFVPPSSSSATNAIHGMRTTPAVAKEHRNLVNAKGAKVNPNGHKRYRVNFEH

SEQ ID NO: 5222 - protein, 349 aa, synthetic construct
  REGION 1..349: note = anti-influenza_Chain
EVQLVESGGGVVQPGRSLRLSCAASGFAFHNRAMHWVRQAPGKGLEWVALIYFDGSKQYYADSVKGRFTISRDNSKNTVFLQMNSLRPEDTAVYYCAVPGPIFGIFPPWSYFDHWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKG

SEQ ID NO: 5223 - protein, 349 aa, synthetic construct; identical to SEQ ID NO: 5222
  REGION 1..349: note = anti-influenza_Chain

SEQ ID NO: 5224 - protein, 349 aa, synthetic construct; identical to SEQ ID NO: 5221
  REGION 1..349: note = anti-influenza_Chain

SEQ ID NO: 5225 - protein, 387 aa, synthetic construct
  REGION 1..387: note = anti-influenza_Chain
MNKFLNKKWSLILTMGGIFLMATLSLIFATGKKAFNDQTSAEDIPSLAEAFRDYFPIGAAIEPGYTTGQIAELYKKHVNMLVAENAMKPASLQPTEGNFQWADADRIVQFAKENGMELRFHTLVWHNQTPTGFSLDKEGKPMVEETDPQKREENRKLLLQRLENYIRAVVLRYKDDIKSWDVVNEVIEPNDPGGMRNSPWYQITGTEYIEVAFRATREAGGSDIKLYINDYNTDDPVKRDILYELVKNLLEKGVPIDGVGHQTHIDIYNPPVERIIESIKKFAGLGLDNIITELDMSIYSWNDRSDYGDSIPDYILTLQAKRYQELFDALKENKDIVSAVVFWGISDKYSWLNGFPVKRTNAPLLFDRNFMPKPAFWAIVDPSRLRE

SEQ ID NO: 5226 - protein, 387 aa, synthetic construct; identical to SEQ ID NO: 5225
  REGION 1..387: note = anti-influenza_Chain

SEQ ID NO: 5227 - protein, 407 aa, synthetic construct
  REGION 1..407: note = anti-influenza_Chain
MRNVVRKPLTIGLALTLLLPMGMTATSAKNADSYAKKPHISALNAPQLDQRYKNEFTIGAAVEPYQLQNEKDVQMLKRHFNSIVAENVMKPISIQPEEGKFNFEQADRIVKFAKANGMDIRFHTLVWHSQVPQWFFLDKEGKPMVNETDPVKREQNKQLLLKRLETHIKTIVERYKDDIKYWDVVNEVVGDDGKLRNSPWYQIAGIDYIKVAFQAARKYGGDNIKLYMNDYNTEVEPKRTALYNLVKQLKEEGVPIDGIGHQSHIQIGWPSEAEIEKTINMFAALGLDNQITELDVSMYGWPPRAYPTYDAIPKQKFLDQAARYDRLFKLYEKLSDKISNVTFWGIADNHTWLDSRADVYYDANGNVVVDPNAPYAKVEKGKGKDAPFVFGPDYKVKPAYWAIIDHK

SEQ ID NO: 5228 - protein, 407 aa, synthetic construct; identical to SEQ ID NO: 5227
  REGION 1..407: note = anti-influenza_Chain

SEQ ID NO: 5229 - protein, 411 aa, synthetic construct
  REGION 1..411: note = anti-influenza_Chain
LSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5230 - protein, 411 aa, synthetic construct; identical to SEQ ID NO: 5229
  REGION 1..411: note = anti-influenza_Chain

SEQ ID NO: 5231 - protein, 431 aa, synthetic construct
  REGION 1..431: note = anti-influenza_Chain
MDDHAEKFLWGVATSAYQIEGATQEDGRGPSIWDAFARRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRYFLDPILGKGYPESPFRDPPPVPILSRDLELVARPLDFLGVNYYAPVRVAPGTGTLPVRYLPPEGPATAMGWEVYPEGLHHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 5232 - protein, 431 aa, synthetic construct
  REGION 1..431: note = anti-influenza_Chain
MTENAEKFLWGVATSAYQIEGATQEDGRGPSIWDAFAQRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRFFLDPILGKGYPESPFRDPPPVPILSRDLELVARPLDFLGVNYYAPVRVAPGTGTLPVRYLPPEGPATAMGWEVYPEGLYHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 5233 - protein, 431 aa, synthetic construct
  REGION 1..431: note = anti-influenza_Chain
MAENAEKFLWGVATSAYQIEGATQEDGRGPSIWDTFARRPGAIRDGSTGEPACDHYHRYEEDIALMQSLGVGVYRFSVAWPRILPEGRGRINPKGLAFYDRLVDRLLAAGITPFLTLYHWDLPQALEDRGGWRSRETAFAFAEYAEAVARALADRVPFFATLNEPWCSAFLGHWTGEHAPGLRNLEAALRAAHHLLLGHGLAVEALRAAGAKRVGIVLNFAPVYGEDPEAVDVADRYHNRYFLDPILGRGYPESPFQDPPPTPNLSRDLELVARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQL

SEQ ID NO: 5234 - protein, 431 aa, synthetic construct; identical to SEQ ID NO: 5231
  REGION 1..431: note = anti-influenza_Chain

SEQ ID NO: 5235 - protein, 431 aa, synthetic construct; identical to SEQ ID NO: 5232
  REGION 1..431: note = anti-influenza_Chain

SEQ ID NO: 5236 - protein, 431 aa, synthetic construct; identical to SEQ ID NO: 5233
  REGION 1..431: note = anti-influenza_Chain

SEQ ID NO: 5237 - protein, 432 aa, synthetic construct
  REGION 1..432: note = anti-influenza_Chain
MFKPNYHFFPITGWMNDPNGLIFWKGKYHMFYQYNPRKPEWGNICWGHAVSDDLVHWRHLPVALYPDDETHGVFSGSAVEKDGKMFLVYTYYRDPTHNKGEKETQCVAMSENGLDFVKYDGNPVISKPPEEGTHAFRDPKVNRSNGEWRMVLGSGKDEKIGRVLLYTSDDLFHWKYEGVIFEDETTKEIECPDLVRIGEKDILIYSITSTNSVLFSMGELKEGKLNVEKRGLLDHGTDFYAAQTFFGTDRVVVIGWLQSWLRTGLYPTKREGWNGVMSLPRELYVENNELKVKPVDELLALRKRKVFETAKSGTFLLDVKENSYEIVCEFSGEIELRMGNESEEVVITKSRDELIVDTTRSGVSGGEVRKSTVEDEATNRIRAFLDSCSVEFFFNDSIAFSFRIHPENVYNILSVKSNQVKLEVFELENIWL

SEQ ID NO: 5238 - protein, 432 aa, synthetic construct; identical to SEQ ID NO: 5237
  REGION 1..432: note = anti-influenza_Chain

SEQ ID NO: 5239 - protein, 441 aa, synthetic construct
  REGION 1..441: note = anti-influenza_Chain
EVKLVESGGGLVQPGGSLRLSCATSGFTFSDYYMSWVRQSPGKALEWLGFTRSRVLGYTTDYSASVKGRFTISRDNSQSILYLQMNSLRGEDSATYYCARDRPMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 5240 - protein, 441 aa, synthetic construct; identical to SEQ ID NO: 5239
  REGION 1..441: note = anti-influenza_Chain

SEQ ID NO: 5241 - protein, 443 aa, synthetic construct
  REGION 1..443: note = anti-influenza_Chain
EVQLQQSGPELVKPGASVKMSCKASGYTFTSYVMHWVKQKPGQGLEWIGYINPYNDGTRYNEKFRVKATLTSDKSSSTAYMELSSLTSEDSAVYYCARRGLITTPTLDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 5242 - protein, 443 aa, synthetic construct; identical to SEQ ID NO: 5241
  REGION 1..443: note = anti-influenza_Chain

SEQ ID NO: 5243 - protein, 444 aa, synthetic construct
  REGION 1..444: note = anti-influenza_Chain
NVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5244 - protein, 444 aa, synthetic construct; identical to SEQ ID NO: 5243
  REGION 1..444: note = anti-influenza_Chain

SEQ ID NO: 5245 - protein, 447 aa, synthetic construct
  REGION 1..447: note = anti-influenza_Chain
QVQLQESGPGLVKPSETLSLTCTVSGGLIGTGSYYWGWIRQTPGKGMEWIGSISYSGSTYYHPSLKSRVTISDDTSKNQLFLKLRSVTAADTAQYYCARYNWGIRYFDFWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKTRESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPAQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5246 - protein, 447 aa, synthetic construct; identical to SEQ ID NO: 5245
  REGION 1..447: note = anti-influenza_Chain

SEQ ID NO: 5247 - protein, 448 aa, synthetic construct
  REGION 1..448: note = anti-influenza_Chain
EVQLQESGPGLVKPSQTLSLTCNVSGGSITGDYKWSWIRQPPGKGLEWIGHIHSTGTTYYNPSLRSRITISMDTSKNNLSLRLTSVTAADTAVYYCASHTLTSGHYPRDFDFWGQGTLVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSGK

SEQ ID NO: 5248 - protein, 450 aa, synthetic construct
  REGION 1..450: note = anti-influenza_Chain
QVQLQQSGAEVKKPGSSVKVSCKVSGVIFSGSAISWVRQAPGQGLEWMGGISPLFGTTNYAQKFQGRVTITADQSTNTTYMEVNSLRYEDTAVYFCARGPKYYSEYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5249 - protein, 450 aa, synthetic construct
  REGION 1..450: note = anti-influenza_Chain
QVQLVQSGAEVKKPGSSVKVSCKASGGTFSSYAISWVRQAPGQGLEWMGGIMGMFGTTNYAQKFQGRVTITADEFTSAAYMELRSLRSEDTAVYYCARSSGYYPEYFQDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5250 - protein, 450 aa, synthetic construct
  REGION 1..450: note = anti-influenza_Chain
EVQLVESGAEVKKPGSSVKVSCKASGGTFSSYGISWVRQAPGQGLEWMGDIIGMFGSTNYAQNFQGRLTITADESTSTAYMELSSLRSEDTAVYYCARSSGYYPAYLPHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5251 - protein, 450 aa, synthetic construct
  REGION 1..450: note = anti-influenza_Chain
EVQLVESGAEVKKPGSSVKVSCKASGGTFSSYAISWVRQAPGQGLEWMGGIIGMFGTANYAQKFQGRVTITADEFTSTAYMELSSLRSEDTAVYYCARGNYYYESSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5252 - protein, 450 aa, synthetic construct
  REGION 1..450: note = anti-influenza_Chain
EVQLVQSGAEVKKPGSSMKVSCKASGSIFSNYGISWVRQAPGQGLEWMGGIIPIFGAANYAQKFQGRVTITADESTSTVYMEVRSLRSEDTAVYYCARRQQLYKGYYHHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5253 - protein, 450 aa, synthetic construct
  REGION 1..450: note = anti-influenza_Chain
QVQLVQSGAGVKKPGSSMKVSCKASGSIFSNYGISWVRQAPGQGLEWMGGIIPIFGAANYAQKFQGRVTITADESTSTVYMEVRSLRSEDTAVYYCARRQQLYKGYYHHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5254 - protein, 450 aa, synthetic construct
  REGION 1..450: note = anti-influenza_Chain
QVQLVQSGAEVRKPGSSVKVSCKVSGGIIRKYAINWVRQAPGQGLEWMGGIIAIFNTANYAQKFQGRVTITADESTSTVYMELSSLRSEDTALYYCARGMNYYSDYFDYWGQGSLVTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5255 - protein, 450 aa, synthetic construct; identical to SEQ ID NO: 5254
  REGION 1..450: note = anti-influenza_Chain

SEQ ID NO: 5256 - protein, 450 aa, synthetic construct; identical to SEQ ID NO: 5252
  REGION 1..450: note = anti-influenza_Chain

SEQ ID NO: 5257 - protein, 450 aa, synthetic construct; identical to SEQ ID NO: 5253
  REGION 1..450: note = anti-influenza_Chain

SEQ ID NO: 5258 - protein, 450 aa, synthetic construct; identical to SEQ ID NO: 5248
  REGION 1..450: note = anti-influenza_Chain

SEQ ID NO: 5259 - protein, 450 aa, synthetic construct; identical to SEQ ID NO: 5249
  REGION 1..450: note = anti-influenza_Chain

SEQ ID NO: 5260 - protein, 450 aa, synthetic construct; identical to SEQ ID NO: 5250
  REGION 1..450: note = anti-influenza_Chain

SEQ ID NO: 5261 - protein, 450 aa, synthetic construct; identical to SEQ ID NO: 5251
  REGION 1..450: note = anti-influenza_Chain

SEQ ID NO: 5262 - protein, 451 aa, synthetic construct
  REGION 1..451: note = anti-influenza_Chain
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5263 - protein, 451 aa, synthetic construct
  REGION 1..451: note = anti-influenza_Chain
QVQLVQSGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5264 - protein, 451 aa, synthetic construct
  REGION 1..451: note = anti-influenza_Chain
EVQLVESGAEVKKPGSSVKVSCKASGGTFSFYSMSWVRQAPGQGLEWMGGIIPMFGTTNYAQKFQGRVTITAVESTSTAYMEVSSLRSEDTAVYYCARGDKGIYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5265 - protein, 451 aa, synthetic construct; identical to SEQ ID NO: 5262
  REGION 1..451: note = anti-influenza_Chain

SEQ ID NO: 5266 - protein, 451 aa, synthetic construct; identical to SEQ ID NO: 5263
  REGION 1..451: note = anti-influenza_Chain

SEQ ID NO: 5267 - protein, 451 aa, synthetic construct; identical to SEQ ID NO: 5264
  REGION 1..451: note = anti-influenza_Chain

SEQ ID NO: 5268 - protein, 452 aa, synthetic construct
  REGION 1..452: note = anti-influenza_Chain
QVQLVQSGGGLVKPGGSLRLSCAASGFTFSSYSMNWVRQAPGKGLEWVSSISSSSSYIYYVDSVKGRFTISRDNAKNSLYLQMNSLRAEDTAVYYCARGGGSYGAYEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5269 - protein, 452 aa, synthetic construct
  REGION 1..452: note = anti-influenza_Chain
QVQLVQSGAEVKQPGASVKVSCKASGYTFNAYYIHWVRQAPGQGLEWMGWINPNFGGTHYARKFQGRVTMTRDASINTAYMELDRLISDDTAVYYCVRWRAAAVIMDQFYKMDVWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKTRESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPAQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5270 - protein, 452 aa, synthetic construct
  REGION 1..452: note = anti-influenza_Chain
EVQLVQSGAEVKKPGASVKVSCKASGYIFTGYYIHWVRQAPGQGLEWMGRIDPNGAGTTYAQKFQGRVTLTMDTSITTAYMELSRLRFDDTAIYYCARWDWNFDLYLGWFDPWGQGTPVTVASASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5271 - protein, 452 aa, synthetic construct; identical to SEQ ID NO: 5269
  REGION 1..452: note = anti-influenza_Chain

SEQ ID NO: 5272 - protein, 452 aa, synthetic construct; identical to SEQ ID NO: 5268
  REGION 1..452: note = anti-influenza_Chain

SEQ ID NO: 5273 - protein, 452 aa, synthetic construct; identical to SEQ ID NO: 5270
  REGION 1..452: note = anti-influenza_Chain

SEQ ID NO: 5274 - protein, 453 aa, synthetic construct
  REGION 1..453: note = anti-influenza_Chain
QVQLVQSGAEVKKPGSSVRVSCKASGSIFRNYAMSWVRQAPGQGLEWMGGIIAIFGTPKYAQKFQGRVTITADESTSTVYMELSGLRSEDTAMYYCARIPHYNFGSGSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5275 - protein, 453 aa, synthetic construct
  REGION 1..453: note = anti-influenza_Chain
QVQLVQSGAEVKKPGASVKVSCKASGYIFTGYYIHWVRQAPGQGLEWMGRIDPNGSGTTYAQKFQGRVTLTMDTSITTAYMELSRLRFDDTAIYYCARWDWNFDLYLGWFDPWGQGTPVTVASASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5276 - protein, 453 aa, synthetic construct
  REGION 1..453: note = anti-influenza_Chain
EVQLVQSGAEVKKPGASVKVSCKASGYIFTGYYIHWVRQAPGQGLEWMGRIDPNGAGTTYAQKFQGRVTLTMDTSITTAYMELSRLRFDDTAIYYCARWDWNFDLYLGWFDPWGQGTPVTVASASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5277 - protein, 453 aa, synthetic construct
  REGION 1..453: note = anti-influenza_Chain
QVQLVQSGAEVKKPGASVKVSCKASGYTFNAHHMHWVRQAPGQGLGWMGWIDPNNDGTIYAQKFQGRVTLTMDTSIHTAYMELSGLRYDDTAIYYCVRWAWNFDFFLGWFDPWGQGTLVTVASASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5278 - protein, 453 aa, synthetic construct
  REGION 1..453: note = anti-influenza_Chain
EVQLVQSGAEVKKPGESLKISCKVSGYSFTSQWIGWVRQMPGKGLEWIGMMYPGDSDTIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5279 - protein, 453 aa, synthetic construct
  REGION 1..453: note = anti-influenza_Chain
EVQLVQSGAEVKKPGESLKISCKVSGYSFTSQWIGWVRQMPGKGLEWIGMMYPGDADAIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5280 - protein, 453 aa, synthetic construct; identical to SEQ ID NO: 1023
  REGION 1..453: note = anti-influenza_Chain

SEQ ID NO: 5281 - protein, 453 aa, synthetic construct
  REGION 1..453: note = anti-influenza_Chain
EVQLVQSGAEVKKPGESLKISCKVSGYSFTSQWIGWVRQMPGKGLEWIGMMYPGDADTIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5282 - protein, 453 aa, synthetic construct
  REGION 1..453: note = anti-influenza_Chain
EVQLVQSGAEVKKPGESLKISCKVSGYSFTSQWIGWVRQMPGKGLEWIGMMYPGSSDTIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5283 - protein, 453 aa, synthetic construct
  REGION 1..453: note = anti-influenza_Chain
EVQLVQSGAEVKKPGESLKISCKVSGYSFTSQWIGWVRQMPGKGLEWIGMMYPGDSDAIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5284 - protein, 453 aa, synthetic construct
  REGION 1..453: note = anti-influenza_Chain
EVQLVQSGAEVKKPGESLKISCKVSGYSFTSQWIGWVRQMPGKGLEWIGMMYPGDTDTIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5285 - protein, 453 aa, synthetic construct
  REGION 1..453: note = anti-influenza_Chain
EVQLVQSGAEVKKPGESLKISCKVSGYSFTSQWIGWVRQMPGKGLEWIGMMYPGESDTIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5286 - protein, 453 aa, synthetic construct; identical to SEQ ID NO: 5274
  REGION 1..453: note = anti-influenza_Chain

SEQ ID NO: 5287 - protein, 453 aa, synthetic construct; identical to SEQ ID NO: 5275
  REGION 1..453: note = anti-influenza_Chain

SEQ ID NO: 5288 - protein, 453 aa, synthetic construct; identical to SEQ ID NO: 5276
  REGION 1..453: note = anti-influenza_Chain

SEQ ID NO: 5289 - protein, 453 aa, synthetic construct; identical to SEQ ID NO: 5277
  REGION 1..453: note = anti-influenza_Chain

SEQ ID NO: 5290 - protein, 453 aa, synthetic construct; identical to SEQ ID NO: 5278
  REGION 1..453: note = anti-influenza_Chain

SEQ ID NO: 5291 - protein, 453 aa, synthetic construct; identical to SEQ ID NO: 5279
  REGION 1..453: note = anti-influenza_Chain

SEQ ID NO: 5292 - protein, 453 aa, synthetic construct; identical to SEQ ID NO: 1023
  REGION 1..453: note = anti-influenza_Chain

SEQ ID NO: 5293 - protein, 453 aa, synthetic construct; identical to SEQ ID NO: 5281
  REGION 1..453: note = anti-influenza_Chain

SEQ ID NO: 5294 - protein, 453 aa, synthetic construct; identical to SEQ ID NO: 5282
  REGION 1..453: note = anti-influenza_Chain

SEQ ID NO: 5295 - protein, 453 aa, synthetic construct; identical to SEQ ID NO: 5283
  REGION 1..453: note = anti-influenza_Chain

SEQ ID NO: 5296 - protein, 453 aa, synthetic construct; identical to SEQ ID NO: 5284
  REGION 1..453: note = anti-influenza_Chain

SEQ ID NO: 5297 - protein, 453 aa, synthetic construct; identical to SEQ ID NO: 5285
  REGION 1..453: note = anti-influenza_Chain

SEQ ID NO: 5298 - protein, 455 aa, synthetic construct
  REGION 1..455: note = anti-influenza_Chain
QVQLVESGGGVVQPGRSLRLSCAASGFAFHNRAMHWVRQAPGKGLEWVALIYFDGSKQYYADSVKGRFTISRDNSKNTVFLQMNSLRPEDTAVYYCAVPGPIFGIFPPWSYFDHWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5299 - protein, 455 aa, synthetic construct
  REGION 1..455: note = anti-influenza_Chain
EVQLVESGGGVVQPGRSLRLSCAASGFAFHNRAMHWVRQAPGKGLEWVALIYFDGSKQYYADSVKGRFTISRDNSKNTVFLQMNSLRPEDTAVYYCAVPGPIFGIFPPWSYFDHWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5300 - protein, 455 aa, synthetic construct
  REGION 1..455: note = anti-influenza_Chain
EVQLVQSGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5301 - protein, 455 aa, synthetic construct
  REGION 1..455: note = anti-influenza_Chain
QVQLVESGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5302 - protein, 455 aa, synthetic construct
  REGION 1..455: note = anti-influenza_Chain
QVQLVESGGGVVQPGKSPRLSCAASGPTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5303 - protein, 455 aa, synthetic construct; identical to SEQ ID NO: 1007
  REGION 1..455: note = anti-influenza_Chain

SEQ ID NO: 5304 - protein, 455 aa, synthetic construct
  REGION 1..455: note = anti-influenza_Chain
QVQLVQSGAELKRPGASVKVSCKTSGYSFNNYGINWVRQAPGQGLEWMGWISAYTGNTHYAKNFEGRVTLTTDTSTSTAYMEVRSLRSDDSAVYFCARAMIQGVVTLYLRPGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5305 - protein, 455 aa, synthetic construct; identical to SEQ ID NO: 5298
  REGION 1..455: note = anti-influenza_Chain

SEQ ID NO: 5306 - protein, 455 aa, synthetic construct; identical to SEQ ID NO: 5299
  REGION 1..455: note = anti-influenza_Chain

SEQ ID NO: 5307 - protein, 455 aa, synthetic construct; identical to SEQ ID NO: 5300
  REGION 1..455: note = anti-influenza_Chain

SEQ ID NO: 5308 - protein, 455 aa, synthetic construct; identical to SEQ ID NO: 5301
  REGION 1..455: note = anti-influenza_Chain

SEQ ID NO: 5309 - protein, 455 aa, synthetic construct; identical to SEQ ID NO: 5302
  REGION 1..455: note = anti-influenza_Chain

SEQ ID NO: 5310 - protein, 455 aa, synthetic construct; identical to SEQ ID NO: 1007
  REGION 1..455: note = anti-influenza_Chain

SEQ ID NO: 5311 - protein, 455 aa, synthetic construct; identical to SEQ ID NO: 5304
  REGION 1..455: note = anti-influenza_Chain

SEQ ID NO: 5312 - protein, 456 aa, synthetic construct
  REGION 1..456: note = anti-influenza_Chain
EVQLVQSGGGVVQPRRSLRLSCAASGFTFSSYAMHWVRQAPGKGLEWVAVISYDGRNKYYADSVKGRFTVSRDNSKNTLYLQMNSLRAEDTSVYYCARELLMDYYDHIGYSPGPTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5313 - protein, 457 aa, synthetic construct
  REGION 1..457: note = anti-influenza_Chain
MVIQRNSILLLIIIFASSISTCRSNVIDDNLFKQVYDNILEQEFAHDFQAYLSYLSKNIESNNNIDKVDKNGIKVINVLSFGAKGDGKTYDNIAFEQAWNEACSSRTPVQFVVPKNKNYLLKQITFSGPCRSSISVKIFGSLEASSKISDYKDRRLWIAFDSVQNLVVGGGGTINGNGQVWWPSSCKINKSLPCRDAPTALTFWNCKNLKVNNLKSKNAQQIHIKFESCTNVVASNLMINASAKSPNTDGVHVSNTQYIQISDTIIGTGDDCISIVSGSQNVQATNITCGPGHGISIGSLGSGNSEAYVSNVTVNEAKIIGAENGVRIKTWQGGSGQASNIKFLNVEMQDVKYPIIIDQNYCDRVEPCIQQFSAVQVKNVVYENIKGTSATKVAIKFDCSTNFPCEGIIMENINLVGESGKPSEATCKNVHFNNAEHVTPHCTSLEISEDEALLYNY

SEQ ID NO: 5314 - protein, 457 aa, synthetic construct; identical to SEQ ID NO: 5313
  REGION 1..457: note = anti-influenza_Chain

SEQ ID NO: 5315 - protein, 460 aa, synthetic construct
  REGION 1..460: note = anti-influenza_Chain
MKLWLNWIFLVTLLNDIQCEVKLVESGGGLVQPGGSLRLSCATSGFTFSDYYMSWVRQSPGKALEWLGFTRSRVLGYTTDYSASVKGRFTISRDNSQSILYLQMNSLRGEDSATYYCARDRPMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 5316 - protein, 460 aa, synthetic construct; identical to SEQ ID NO: 5315
  REGION 1..460: note = anti-influenza_Chain

SEQ ID NO: 5317 - protein, 462 aa, synthetic construct
  REGION 1..462: note = anti-influenza_Chain
MEWSWIFLFLLSGTAGVHSEVQLQQSGPELVKPGASVKMSCKASGYTFTSYVMHWVKQKPGQGLEWIGYINPYNDGTRYNEKFRVKATLTSDKSSSTAYMELSSLTSEDSAVYYCARRGLITTPTLDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 5318 - protein, 462 aa, synthetic construct
  REGION 1..462: note = anti-influenza_Chain
QVQLVQSGAEVKKPGASVKVSCKTSGYTFTAYTIHWVRQAPGQRLEWMGWINAGNGHTKYSQRFKGRVTITRDTSARTTYMELRSLTSEDTALYFCARGPETYYYDKTNWLNSHPDEYFQHWGHGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5319 - protein, 462 aa, synthetic construct; identical to SEQ ID NO: 5318
  REGION 1..462: note = anti-influenza_Chain

SEQ ID NO: 5320 - protein, 462 aa, synthetic construct; identical to SEQ ID NO: 5317
  REGION 1..462: note = anti-influenza_Chain

SEQ ID NO: 5321 - protein, 466 aa, synthetic construct
  REGION 1..466: note = anti-influenza_Chain
MLPSTVQTLTLLLTSGGVLLSLYVSASLSYLLYSDVLLKFSSTKTTAPTMSLECTNASNAQTVNHSATKEMTFPPPEPEWTYPRLSCQGSTFQKALLISPHRFGEIKGNSAPLIIREPFVACGPKECRHFALTHYAAQPGGYYNGTRKDRNKLRHLVSVKLGKIPTVENSIFHMAAWSGSACHDGREWTYIGVDGPDNDALVKIKYGEAYTDTYHSYAHNILRTQESACNCIGGDCYLMITDGSASGISKCRFLKIREGRIIKEILPTGRVEHTEECTCGFASNKTIECACRDNSYTAKRPFVKLNVETDTAEIRLMCTKTYLDTPRPDDGSIAGPCESNGDKWLGGIKGGFVHQRMASKIGRWYSRTMSKTNRMGMELYVKYDGDPWTDSDALTLSGVMVSIEEPGWYSFGFEIKDKKCDVPCIGIEMVHDGGKDTWHSAATAIYCLMGSGQLLWDTVTGVDMAL

SEQ ID NO: 5322 - protein, 466 aa, synthetic construct; identical to SEQ ID NO: 5321
  REGION 1..466: note = anti-influenza_Chain

SEQ ID NO: 5323 - protein, 469 aa, synthetic construct
  REGION 1..469: note = anti-influenza_Chain
MDWTWRFLFVVAAATGVQSQVQLVQSGAEVKKPGSSVKVSCKASGGTLNNYAISWVRQAPGQGLEWMGGISPIFGTLNYAERFQGRVTITADVFTNTVYMELSSLRSEDTAVYFCARGCGYNCYYFDGWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 5324 - protein, 469 aa, synthetic construct; identical to SEQ ID NO: 5323
  REGION 1..469: note = anti-influenza_Chain

SEQ ID NO: 5325 - protein, 469 aa, synthetic construct; identical to SEQ ID NO: 5323
  REGION 1..469: note = anti-influenza_Chain

SEQ ID NO: 5326 - protein, 471 aa, synthetic construct
  REGION 1..471: note = anti-influenza_Chain
DGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5327 - protein, 471 aa, synthetic construct; identical to SEQ ID NO: 5326
  REGION 1..471: note = anti-influenza_Chain

SEQ ID NO: 5328 - protein, 472 aa, synthetic construct
  REGION 1..472: note = anti-influenza_Chain
MDWTWRFLFVVAAATGVQCQVQLVQSGAEVKMPGSSVKVSCKTSGVFFSSHAISWVRQAPGQGLEWMGGISPMFGTTHYAQKFQGRVTITADQSTTTAYMELTSLTSEDTAVYYCARDGAGSYYPLNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 5329 - protein, 472 aa, synthetic construct; identical to SEQ ID NO: 5328
  REGION 1..472: note = anti-influenza_Chain

SEQ ID NO: 5330 - protein, 472 aa, synthetic construct; identical to SEQ ID NO: 5328
  REGION 1..472: note = anti-influenza_Chain

SEQ ID NO: 5331 - protein, 473 aa, synthetic construct
  REGION 1..473: note = anti-influenza_Chain
MTESAMTSRAGRGRGADLVAAVVQGHAAASDAAGDLSFPDGFIWGAATAAYQIEGAWREDGRGLWDVFSHTPGKVASGHTGDIACDHYHRYADDVRLMAGLGDRVYRFSVAWPRIVPDGSGPVNPAGLDFYDRLVDELLGHGITPYPTLYHWDLPQTLEDRGGWAARDTAYRFAEYALAVHRRLGDRVRCWITLNEPWVAAFLATHRGAPGAADVPRFRAVHHLLLGHGLGLRLRSAGAGQLGLTLSLSPVIEARPGVRGGGRRVDALANRQFLDPALRGRYPEEVLKIMAGHARLGHPGRDLETIHQPVDLLGVNYYSHVRLAAEGEPANRLPGSEGIRFERPTAVTAWPGDRPDGLRTLLLRLSRDYPGVGLIITENGAAFDDRADGDRVHDPERIRYLTATLRAVHDAIMAGADLRGYFVWSVLDNFEWAYGYHKRGIVYVDYTTMRRIPRESALWYRDVVRRNGLRNGE

SEQ ID NO: 5332 - protein, 473 aa, synthetic construct; identical to SEQ ID NO: 5331
  REGION 1..473: note = anti-influenza_Chain

SEQ ID NO: 5333 - protein, 474 aa, synthetic construct
  REGION 1..474: note = anti-influenza_Chain
LSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5334 - protein, 474 aa, synthetic construct; identical to SEQ ID NO: 5333
  REGION 1..474: note = anti-influenza_Chain

SEQ ID NO: 5335 - protein, 476 aa, synthetic construct
  REGION 1..476: note = anti-influenza_Chain
MEFGLSWVFLVALLRGVQCQVQLVESGGGVVQPGRSLRLSCAASGFTFSRFGIHWVRQAPGKGLEWMAVIWYDGSNKFYADSVKGRFTISRDNSKNTVYLQMNSLRAEDTAVYYCAKDSRGYCSSIICFEGGLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 5336 - protein, 476 aa, synthetic construct; identical to SEQ ID NO: 5335
  REGION 1..476: note = anti-influenza_Chain

SEQ ID NO: 5337 - protein, 476 aa, synthetic construct; identical to SEQ ID NO: 5335
  REGION 1..476: note = anti-influenza_Chain

SEQ ID NO: 5338 - protein, 480 aa, synthetic construct
  REGION 1..480: note = anti-influenza_Chain
MPSVKIGIIGAGSAVFSLRLVSDLCKTPGLSGSTVTLMDIDEERLDAILTIAKKYVEEVGADLKFEKTMNLDDVIIDADFVINTAMVGGHTYLEKVRQIGEKYGYYRGIDAQEFNMVSDYYTFSNYNQLKYFVDIARKIEKLSPKAWYLQAANPIFEGTTLVTRTVPIKAVGFCHGHYGVMEIVEKLGLEEEKVDWQVAGVNHGIWLNRFRYNGGNAYPLLDKWIEEKSKDWKPENPFNDQLSPAAIDMYRFYGVMPIGDTVRNSSWRYHRDLETKKKWYGEPWGGADSEIGWKWYQDTLGKVTEITKKVAKFIKENPSVRLSDLGSVLGKDLSEKQFVLEVEKILDPERKSGEQHIPFIDALLNDNKARFVVNIPNKGIIHGIDDDVVVEVPALVDKNGIHPEKIEPPLPDRVVKYYLRPRIMRMEMALEAFLTGDIRIIKELLYRDPRTKSDEQVEKVIEEILALPENEEMRKHYLKR

SEQ ID NO: 5339 - protein, 480 aa, synthetic construct; identical to SEQ ID NO: 5338
  REGION 1..480: note = anti-influenza_Chain

SEQ ID NO: 5340 - protein, 481 aa, synthetic construct
  REGION 1..481: note = anti-influenza_Chain
MKFPKDFMIGYSSSPFQFEAGIPGSEDPNSDWWVWVHDPENTAAGLVSGDFPENGPGYWNLNQNDHDLAEKLGVNTIRVGVEWSRIFPKPTFNVKVPVERDENGSIVHVDVDDKAVERLDELANKEAVNHYVEMYKDWVERGRKLILNLYHWPLPLWLHNPIMVRRMGPDRAPSGWLNEESVVEFAKYAAYIAWKMGELPVMWSTMNEPNVVYEQGYMFVKGGFPPGYLSLEAADKARRNMIQAHARAYDNIKRFSKKPVGLIYAFQWFELLEGPAEVFDKFKSSKLYYFTDIVSKGSSIINVEYRRDLANRLDWLGVNYYSRLVYKIVDDKPIILHGYGFLCTPGGISPAENPCSDFGWEVYPEGLYLLLKELYNRYGVDLIVTENGVSDSRDALRPAYLVSHVYSVWKAANEGIPVKGYLHWSLTDNYEWAQGFRQKFGLVMVDFKTKKRYLRPSALVFREIATHNGIPDELQHLTLIQ

SEQ ID NO: 5341 - protein, 481 aa, synthetic construct; identical to SEQ ID NO: 5340
  REGION 1..481: note = anti-influenza_Chain

SEQ ID NO: 5342 - protein, 488 aa, synthetic construct
  REGION 1..488: note = anti-influenza_Chain
HAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5343 - protein, 488 aa, synthetic construct; identical to SEQ ID NO: 5342
  REGION 1..488: note = anti-influenza_Chain

SEQ ID NO: 5344 - protein, 491 aa, synthetic construct
  REGION 1..491: note = anti-influenza_Chain
MLSFPKGFKFGWSQSGFQSEMGTPGSEDPNSDWHVWVHDRENIVSQVVSGDLPENGPGYWGNYKRFHDEAEKIGLNAVRINVEWSRIFPRPLPKPEMQTGTDKENSPVISVDLNESKLREMDNYANHEALSHYRQILEDLRNRGFHIVLNMYHWTLPIWLHDPIRVRRGDFTGPTGWLNSRTVYEFARFSAYVAWKLDDLASEYATMNEPNVVWGAGYAFPRAGFPPNYLSFRLSEIAKWNIIQAHARAYDAIKSVSKKSVGIIYANTSYYPLRPQDNEAVEIAERLNRWSFFDSIIKGEITSEGQNVREDLRNRLDWIGVNYYTRTVVTKAESGYLTLPGYGDRCERNSLSLANLPTSDFGWEFFPEGLYDVLLKYWNRYGLPLYVMENGIADDADYQRPYYLVSHIYQVHRALNEGVDVRGYLHWSLADNYEWSSGFSMRFGLLKVDYLTKRLYWRPSALVYREITRSNGIPEELEHLNRVPPIKPLRH

SEQ ID NO: 5345 - protein, 491 aa, synthetic construct; identical to SEQ ID NO: 5344
  REGION 1..491: note = anti-influenza_Chain

SEQ ID NO: 5346 - protein, 498 aa, synthetic construct
  REGION 1..498: note = anti-influenza_Chain
MASQGTKRSYEQMETDGERQNATEIRASVGKMIGGIGRFYIQMCTELKLSDYEGRLIQNSLTIERMVLSAFDERRNKYLEEHPSAGKDPKKTGGPIYRRVNGKWMRELILYDKEEIRRIWRQANNGDDATAGLTHMMIWHSNLNDATYQRTRALVRTGMDPRMCSLMQGSTLPRRSGAAGAAVKGVGTMVMELVRMIKRGINDRNFWRGENGRKTRIAYERMCNILKGKFQTAAQKAMMDQVRESRDPGNAEFEDLTFLARSALILRGSVAHKSCLPACVYGPAVASGYDFEREGYSLVGIDPFRLLQNSQVYSLIRPNENPAHKSQLVWMACHSAAFEDLRVLSFIKGTKVVPRGKLSTRGVQIASNENMETMESSTLELRSRYWAIRTRSGGNTNQQRASAGQISIQPTFSVQRNLPFDRTTVMAAFTGNTEGRTSDMRTEIIRMMESARPEDVSFQGRGVFELSDEKAASPIVPSFDMSNEGSYFFGDNAEEYDN

SEQ ID NO: 5347 - protein, 498 aa, synthetic construct
  REGION 1..498: note = anti-influenza_Chain
MASQGTKRSYEQMETDGERQNATEIRASVGKMIDGIGRFYIQMCTELKLSDYEGRLIQNSLTIERMVLSAFDERRNKYLEEHPSAGKDPKKTGGPIYKRVDGKWMRELVLYDKEEIRRIWRQANNGDDATAGLTHMMIWHSNLNDTTYQRTRALVRTGMDPRMCSLMQGSTLPRRSGAAGAAVKGVGTMVMELIRMIKRGINDRNFWRGENGRKTRSAYERMCNILKGKFQTAAQRAMMDQVRESRNPGNAEIEDLIFLARSALILRGSVAHKSCLPACVYGPAIASGYNFEKEGYSLVGIDPFKLLQNSQVYSLIRPNENPAHKSQLVWMACNSAAFEDLRVLSFIRGTKVSPRGKLSTRGVQIASNENMDTMESSTLELRSRYWAIRTRSGGNTNQQRASAGQISVQPAFSVQRNLPFDKPTIMAAFTGNTEGRTSDMRAEIIRMMEGAKPEEMSFQGRGVFELSDEKATNPIVPSFDMSNEGSYFFGDNAEEYDN

SEQ ID NO: 5348 - protein, 498 aa, synthetic construct
  REGION 1..498: note = anti-influenza_Chain
MASQGTKRSYEQMETGGERQNATEIRASVGRMVGGIGRFYVQMCTELKLSDQEGRLIQNSITIERMVLSAFDERRNRYLEEHPSAGKDPKKTGGPIYRRRDGKWVRELILYDKEEIRRIWRQANNGEDATAGLTHMMIWHSNLNDATYQRTRALVRTGMDPRMCSLMQGSTLPRRSGAAGAAIKGVGTMVMELIRMIKRGINDRNFWRGDNGRRTRIAYERMCNILKGKFQTAAQRAMMDQVRESRNPGNAEIEDLIFLARSALILRGSVAHKSCLPACVYGLAVASGYDFEREGYSLVGIDPFRLLQNSQVFSLIRPNENPAHKSQLVWMACHSAAFEDLRVSSFIRGTRVIPRGQLSTRGVQIASNENVEAMDSSTLELRSRYWAIRTRSGGNTNQQRASAGQISVQPTFSVQRNLPFERPTIMAAFKGNTEGRTSDMRTEIIRMMESARPEDVSFQGRGVFELSDEKATNPIVPSFDMSNEGSYFFGDNAEEYDN

SEQ ID NO: 5349 - protein, 498 aa, synthetic construct; identical to SEQ ID NO: 5346
  REGION 1..498: note = anti-influenza_Chain

SEQ ID NO: 5350 - protein, 498 aa, synthetic construct; identical to SEQ ID NO: 5347
  REGION 1..498: note = anti-influenza_Chain

SEQ ID NO: 5351 - protein, 498 aa, synthetic construct; identical to SEQ ID NO: 5348
  REGION 1..498: note = anti-influenza_Chain

SEQ ID NO: 5352 - protein, 510 aa, synthetic construct
  REGION 1..510: note = anti-influenza_Chain
MFPEKFLWGVAQSGFQFEMGDKLRRNIDTNTDWWHWVRDKTNIEKGLVSGDLPEEGINNYELYEKDHEIARKLGLNAYRIGIEWSRIFPWPTTFIDVDYSYNESYNLIEDVKITKDTLEELDEIANKREVAYYRSVINSLRSKGFKVIVNLNHFTLPYWLHDPIEARERALTNKRNGWVNPRTVIEFAKYAAYIAYKFGDIVDMWSTFNEPMVVVELGYLAPYSGFPPGVLNPEAAKLAILHMINAHALAYRQIKKFDTEKADKDSKEPAEVGIIYNNIGVAYPKDPNDSKDVKAAENDNFFHSGLFFEAIHKGKLNIEFDGETFIDAPYLKGNDWIGVNYYTREVVTYQEPMFPSIPLITFKGVQGYGYACRPGTLSKDDRPVSDIGWELYPEGMYDSIVEAHKYGVPVYVTENGIADSKDILRPYYIASHIKMTEKAFEDGYEVKGYFHWALTDNFEWALGFRMRFGLYEVNLITKERIPREKSVSIFREIVANNGVTKKIEEELLRG

SEQ ID NO: 5353 - protein, 510 aa, synthetic construct; identical to SEQ ID NO: 5352
  REGION 1..510: note = anti-influenza_Chain

SEQ ID NO: 5354 - protein, 512 aa, synthetic construct
  REGION 1..512: note = anti-influenza_Chain
MKRKVKKMAAMATSIIMAIMIILHSIPVLAGRIIYDNETGTHGGYDYELWKDYGNTIMELNDGGTFSCQWSNIGNALFRKGRKFNSDKTYQELGDIVVEYGCDYNPNGNSYLCVYGWTRNPLVEYYIVESWGSWRPPGATPKGTITQWMAGTYEIYETTRVNQPSIDGTATFQQYWSVRTSKRTSGTISVTEHFKQWERMGMRMGKMYEVALTVEGYQSSGYANVYKNEIRIGANPTPAPSQSPIRRDAFSIIEAEEYNSTNSSTLQVIGTPNNGRGIGYIENGNTVTYSNIDFGSGATGFSATVATEVNTSIQIRSDSPTGTLLGTLYVSSTGSWNTYQTVSTNISKITGVHDIVLVFSGPVNVDNFIFSRSSPVPAPGDNTRDAYSIIQAEDYDSSYGPNLQIFSLPGGGSAIGYIENGYSTTYKNIDFGDGATSVTARVATQNATTIQVRLGSPSGTLLGTIYVGSTGSFDTYRDVSATISNTAGVKDIVLVFSGPVNVDWFVFSKSGT

SEQ ID NO: 5355 - protein, 512 aa, synthetic construct; identical to SEQ ID NO: 5354
  REGION 1..512: note = anti-influenza_Chain

SEQ ID NO: 5356 - protein, 513 aa, synthetic construct
  REGION 1..513: note = anti-influenza_Chain
ICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5357 - protein, 513 aa, synthetic construct; identical to SEQ ID NO: 5356
  REGION 1..513: note = anti-influenza_Chain

SEQ ID NO: 5358 - protein, 531 aa, synthetic construct
  REGION 1..531: note = anti-influenza_Chain
TLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGA

SEQ ID NO: 5359 - protein, 531 aa, synthetic construct
  REGION 1..531: note = anti-influenza_Chain
TLCIGYHANNSTDTVDTVLEKNVTVTHSVNLLEDKHNGKLCKLRGVAPLHLGKCNIAGWILGNPECESLSTASSWSCIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGA

SEQ ID NO: 5360 - protein, 531 aa, synthetic construct
  REGION 1..531: note = anti-influenza_Chain
TLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPNTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGA

SEQ ID NO: 5361 - protein, 531 aa, synthetic construct
  REGION 1..531: note = anti-influenza_Chain
TLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFGPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGA

SEQ ID NO: 5362 - protein, 531 aa, synthetic construct; identical to SEQ ID NO: 5358
  REGION 1..531: note = anti-influenza_Chain

SEQ ID NO: 5363 - protein, 531 aa, synthetic construct; identical to SEQ ID NO: 5359
  REGION 1..531: note = anti-influenza_Chain

SEQ ID NO: 5364 - protein, 531 aa, synthetic construct; identical to SEQ ID NO: 5360
  REGION 1..531: note = anti-influenza_Chain

SEQ ID NO: 5365 - protein, 531 aa, synthetic construct; identical to SEQ ID NO: 5361
  REGION 1..531: note = anti-influenza_Chain

SEQ ID NO: 5366 - protein, 535 aa, synthetic construct
  REGION 1..535: note = anti-influenza_Chain
ANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGA

SEQ ID NO: 5367 - protein, 535 aa, synthetic construct
  REGION 1..535: note = anti-influenza_Chain
ANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPRAGAKGFYKNLIWLVKKGNSYPKLNKSYINDKGKEVLVLWGIHHPSTTADQQSLYQNADTYVFVGTSRYSKKFKPEIEIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVDKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGA

SEQ ID NO: 5368 - protein, 535 aa, synthetic construct; identical to SEQ ID NO: 5366
  REGION 1..535: note = anti-influenza_Chain

SEQ ID NO: 5369 - protein, 535 aa, synthetic construct; identical to SEQ ID NO: 5367
  REGION 1..535: note = anti-influenza_Chain

SEQ ID NO: 5370 - protein, 548 aa, synthetic construct
  REGION 1..548: note = anti-influenza_Chain
QKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFPYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNI

SEQ ID NO: 5371 - protein, 548 aa, synthetic construct; identical to SEQ ID NO: 5370
  REGION 1..548: note = anti-influenza_Chain

SEQ ID NO: 5372 - protein, 549 aa, synthetic construct
  REGION 1..549: note = anti-influenza_Chain
MLTFHRIIRKGWMFLLAFLLTALLFCPTGQPAKAAAPFNGTMMQYFEWYLPDDGTLWTKVANEANNLSSLGITALWLPPAYKGTSRSDVGYGVYDLYDLGEFNQKGAVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKSWGKWYVNTTNIDGFRLDAVKHIKFSFFPDWLSDVRSQTGKPLFTVGEYWSYDINKLHNYIMKTNGTMSLFDAPLHNKFYTASKSGGTFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIAWSITTRPWTDEFVRWTEPRLVAWP

SEQ ID NO: 5373 - protein, 549 aa, synthetic construct
  REGION 1..549: note = anti-influenza_Chain
ICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5374 - protein, 549 aa, synthetic construct; identical to SEQ ID NO: 5373
  REGION 1..549: note = anti-influenza_Chain

SEQ ID NO: 5375 - protein, 549 aa, synthetic construct; identical to SEQ ID NO: 5372
  REGION 1..549: note = anti-influenza_Chain

SEQ ID NO: 5376 - protein, 550 aa, synthetic construct
  REGION 1..550: note = anti-influenza_Chain
DQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWAILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNPQYSEEARLKREEISGVKLESIGTYQILSIYSTVASSLALAIMIAGLSLWMCSNGSLQCRICI

SEQ ID NO: 5377 - protein, 550 aa, synthetic construct; identical to SEQ ID NO: 5376
  REGION 1..550: note = anti-influenza_Chain

SEQ ID NO: 5378 - protein, 552 aa, synthetic construct
  REGION 1..552: note = anti-influenza_Chain
MNIQILAFIACVLTGAKGDKICLGHHAVANGTKVNTLTEKGIEVVNATETVETADVKKICTQGKRATDLGRCGLLGTLIGPPQCDQFLEFSSDLIIERREGTDVCYPGRFTNEESLRQILRRSGGIGKESMGFTYSGIRTNGAASACTRSGSSFYAEMKWLLSNSDNSAFPQMTKAYRNPRNKPALIIWGVHHSESASEQTKLYGSGNKLITVRSSKYQQSFTPSPGTRRIDFHWLLLDPNDTVTFTFNGAFIAPDRASFFRGESLGVQSDAPLDSSCRGDCFHSGGTIVSSLPFQNINSRTVGRCPRYVKQKSLLLATGMRNVPEKPKPRGLFGAIAGFIENGWEGLINGWYGFRHQNAQGEGTAADYKSTQSAIDQITGKLNRLIGKTNQQFELIDNEFNEIEQQIGNVINWTRDAMTEIWSYNAELLVAMENQHTIDLADSEMSKLYERVKKQLRENAEEDGTGCFEIFHKCDDQCMESIRNNTYDHTQYRTESLQNRIQIDPVKLSSGYKDIILWFSFGASCFILLAIAMGLVFICIKNGNMQCTICI

SEQ ID NO: 5379 - protein, 552 aa, synthetic construct
  REGION 1..552: note = anti-influenza_Chain
MNTQILAFIACVLTGVKGDKICLGHHAVANGTKVNTLTEKGIEVVNATETVETADVKKICTQGKRATDLGRCGLLGTLIGPPQCDQFLEFSSDLIIERREGTDVCYPGRFTNEESLRQILRRSGGIGKESMGFTYSGIRTNGATSACTRSGSSFYAEMKWLLSNSDNSAFPQMTKAYRNPRNKPALIIWGVHHSESVSEQTKLYGSGNKLITVRSSKYQQSFTPSPGARRIDFHWLLLDPNDTVTFTFNGAFIAPDRASFFRGESLGVQSDVPLDSSCRGDCFHSGGTIVSSLPFQNINSRTVGKCPRYVKQKSLLLATGMRNVPEKPKPRGLFGAIAGFIENGWEGLINGWYGFRHQNAQGEGTAADYKSTQSAIDQITGKLNRLIGKTNQQFELIDNEFNEIEQQIGNVINWTRDAMTEIWSYNAELLVAMENQHTIDLADSEMSKLYERVKKQLRENAEEDGTGCFEIFHKCDDQCMESIRNNTYDHTQYRTESLQNRIQIDPVKLSSGYKDIILWFSFGASCFLLLAIAMGLVFICIKNGNMQCTICI

SEQ ID NO: 5380 - protein, 552 aa, synthetic construct
  REGION 1..552: note = anti-influenza_Chain
MNIQILAFIACVLTGAKGDKICLGHHAVANGTKVNTLTEKGIEVVNATETVETANIKKICTQGKRPTDLGQCGLLGTLIGPPQCDQFLEFSSDLIIERREGTDVCYPGKFTNEESLRQILRRSGGIGKESMGFTYSGIRTNGATSACTRSGSSFYAEMKWLLSNSDNAAFPQMTKSYRNPRNKPALIIWGVHHSESVSEQTKLYGSGNKLIKVRSSKYQQSFTPNPGARRIDFHWLLLDPNDTVTFTFNGAFIAPDRASFFRGESIGVQSDAPLDSSCGGNCFHNGGTIVSSLPFQNINPRTVGKCPRYVKQKSLLLATGMRNVPEKPKKRGLFGAIAGFIENGWEGLINGWYGFRHQNAQGEGTAADYKSTQSAIDQITGKLNRLIGKTNQQFELINNEFNEVEQQIGNVINWTQDAMTEVWSYNAELLVAMENQHTIDLTDSEMSKLYERVRKQLRENAEEDGTGCFEIFHKCDDHCMESIRNNTYDHTQYRTESLQNRIQIDPVKLSGGYKDIILWFSFGASCFLLLAIAMGLVFICIKNGNMQCTICI

SEQ ID NO: 5381 - protein, 552 aa, synthetic construct
  REGION 1..552: note = anti-influenza_Chain
DQICIGYHANNSTEQVDTIMEKNVTVTHAQNILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNKLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKIRLQLRDNAKELGNGCFEFYHRCDNECMESVRNGTYDYPQYSEEARLKREEISGVKLESIGTYQILSIYSTVASSLTLAIMVAGLSLWMCSNGSLQCRICI

SEQ ID NO: 5382 - protein, 552 aa, synthetic construct
  REGION 1..552: note = anti-influenza_Chain
DQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILNPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMMAGLSLWMCSNGSLQCRICI

SEQ ID NO: 5383 - protein, 552 aa, synthetic construct; identical to SEQ ID NO: 5378
  REGION 1..552: note = anti-influenza_Chain

SEQ ID NO: 5384 - protein, 552 aa, synthetic construct; identical to SEQ ID NO: 5379
  REGION 1..552: note = anti-influenza_Chain

SEQ ID NO: 5385 - protein, 552 aa, synthetic construct; identical to SEQ ID NO: 5380
  REGION 1..552: note = anti-influenza_Chain

SEQ ID NO: 5386 - protein, 552 aa, synthetic construct; identical to SEQ ID NO: 5381
  REGION 1..552: note = anti-influenza_Chain

SEQ ID NO: 5387 - protein, 552 aa, synthetic construct; identical to SEQ ID NO: 5382
  REGION 1..552: note = anti-influenza_Chain

SEQ ID NO: 5388 - protein, 560 aa, synthetic construct
  REGION 1..560: note = anti-influenza_Chain
MSNMDIDSINTGTIDKTPEELTPGTSGATRPIIKPATLAPPSNKRTRNPSPERTTTSSETDIGRKIQKKQTPTEIKKSVYKMVVKLGEFYNQMMVKAGLNDDMERNLIQNAQAVERILLAATDDKKTEYQKKRNARDVKEGKEEIDHNKTGGTFYKMVRDDKTIYFSPIKITFLKEEVKTMYKTTMGSDGFSGLNHIMIGHSQMNDVCFQRSKGLKRVGLDPSLISTFAGSTLPRRSGTTGVAIKGGGTLVDEAIRFIGRAMADRGLLRDIKAKTAYEKILLNLKNKCSAPQQKALVDQVIGSRNPGIADIEDLTLLARSMVVVRPSVASKVVLPISIYAKIPQLGFNTEEYSMVGYEAMALYNMATPVSILRMGDDAKDKSQLFFMSCFGAAYEDLRVLSALTGTEFKPRSALKCKGFHVPAKEQVEGMGAALMSIKLQFWAPMTRSGGNEVSGEGGSGQISCSPVFAVERPIALSKQAVRRMLSMNVEGRDADVKGNLLKMMNDSMAKKTSGNAFIGKKMFQISDKNKVNPIEIPIKQTIPNFFFGRDTAEDYDDLDY

SEQ ID NO: 5389 - protein, 560 aa, synthetic construct
  REGION 1..560: note = anti-influenza_Chain
MNTQILALIAYMLIGAKGDKICLGHHAVANGTKVNTLTERGIEVVNATETVETVNIKKICTQGKRPTDLGQCGLLGTLIGPPQCDQFLEFDADLIIERREGTDVCYPGKFTNEESLRQILRGSGGIDKESMGFTYSGIRTNGVTSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSRGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLVFICIKNGNMRCTICI

SEQ ID NO: 5390 - protein, 560 aa, synthetic construct
  REGION 1..560: note = anti-influenza_Chain
MNTQILALIACMLIGAKGDKICLGHHAVANGTKVNTLTERGIEVVNATETVETANIKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGGSLGVQSDVPLDSGCEGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFNEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQINPVKLSSGYKDIILWFSFGASCFLLLAIAMGLVFICIKNGNMRCTICI

SEQ ID NO: 5391 - protein, 560 aa, synthetic construct
  REGION 1..560: note = anti-influenza_Chain
MERIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFERIQIIPKSSWSDHEASSGVSSACPYQGRSSFFRNVVWLIKKNNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKNCQKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNG

SEQ ID NO: 5392 - protein, 560 aa, synthetic construct; identical to SEQ ID NO: 5388
  REGION 1..560: note = anti-influenza_Chain

SEQ ID NO: 5393 - protein, 560 aa, synthetic construct; identical to SEQ ID NO: 5389
  REGION 1..560: note = anti-influenza_Chain

SEQ ID NO: 5394 - protein, 560 aa, synthetic construct; identical to SEQ ID NO: 5390
  REGION 1..560: note = anti-influenza_Chain

SEQ ID NO: 5395 - protein, 560 aa, synthetic construct; identical to SEQ ID NO: 5391
  REGION 1..560: note = anti-influenza_Chain

SEQ ID NO: 5396 - protein, 562 aa, synthetic construct
  REGION 1..562: note = anti-influenza_Chain
MPRALRRVPGSRVMLRVGVVVAVLALVAALANLAVPRPARAAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 5397 - protein, 562 aa, synthetic construct
  REGION 1..562: note = anti-influenza_Chain
MERVWWKEAVVYQIYPRSFYDSNGDGIGDIRGIIAKLDYLKELGVDVVWLSPVYKSPNDDNGYDISDYRDIMDEFGTMADWKTMLEEMHKRGIKLVMDLVVNHTSDEHPWFIESRKSKDNPYRDYYIWRPGKNGKEPNNWESVFSGSAWEYDEMTGEYYLHLFSKKQPDLNWENPKVRREVYEMMKFWLDKGVDGFRMDVINMISKVPELPDGEPQSGKKYASGSRYYMNGPRVHEFLQEMNREVLSKYDIMTVGETPGVTPKEGILYTDPSRRELNMVFQFEHMDLDSGPGGKWDIRPWSLADLKKTMTKWQKELEGKGWNSLYLNNHDQPRAVSRFGDDGKYRVESAKMLATFLHMMQGTPYIYQGEEIGMTNVRFPSIEDYRDIETLNMYKERVEEYGEDPQEVMEKIYYKGRDNARTPMQWDDSENAGFTAGTPWIPVNPNYKEINVKAALEDPNSVFHYYKKLIQLRKQHDIIVYGTYDLILEDDPYIYRYTRTLGNEQLIVITNFSEKTPVFRLPDHIIYKTKELLISNYDVDEAEELKEIRLRPWEARVYKIRLP

SEQ ID NO: 5398 - protein, 562 aa, synthetic construct; identical to SEQ ID NO: 5396
  REGION 1..562: note = anti-influenza_Chain

SEQ ID NO: 5399 - protein, 562 aa, synthetic construct; identical to SEQ ID NO: 5397
  REGION 1..562: note = anti-influenza_Chain

SEQ ID NO: 5400 - protein, 563 aa, synthetic construct
  REGION 1..563: note = anti-influenza_Chain
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKTSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRIC

SEQ ID NO: 5401 - protein, 563 aa, synthetic construct; identical to SEQ ID NO: 5400
  REGION 1..563: note = anti-influenza_Chain

SEQ ID NO: 5402 - protein, 564 aa, synthetic construct
  REGION 1..564: note = anti-influenza_Chain
MEKIVLLFAIVSLVKSDQICIGYHANNSTEQVDTIMEKNVTVTHAQDILEKTHNGKLCSLNGVKPLILRDCSVAGWLLGNPMCDEFLNVPEWSYIVEKDSPINGLCYPGDFNDYEELKHLLSSTNHFEKIQIIPRSSWSDHDASSGVSSACPYNGRSSFFRNVVWLIKKNNAYPTIKRNYNNTNQEDLLVLWGIHHPNDATEQTKLYQNPTTYVSVGTSTLNQRSVPEIATRPKVNGQSGRIEFFWTILKPNDAINFESNGNFIAPEYAYKIAKKGDSAIMKSGLEYGNCNTKCQTPMGAINSSMPFHNIHPLTIGECPRYVKSDRLVLATGLRNVPQRETRGLFGAIAGFIEGGWQGMVDGWYGYHHSNEQGSGYAADKESTQKAIDGITNKVNSIIDKMNTQFEAVGKEFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLNREEISGVKLESIGTYQILSIYSTVASSLALAIMVAGLSFWMCSNGSLQCRICI

SEQ ID NO: 5403 - protein, 564 aa, synthetic construct; identical to SEQ ID NO: 5402
  REGION 1..564: note = anti-influenza_Chain

SEQ ID NO: 5404 - protein, 565 aa, synthetic construct
  REGION 1..565: note = anti-influenza_Chain
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCR

SEQ ID NO: 5405 - protein, 565 aa, synthetic construct
  REGION 1..565: note = anti-influenza_Chain
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCR

SEQ ID NO: 5406 - protein, 565 aa, synthetic construct
  REGION 1..565: note = anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGKSSFFRNVVWLIKKNSSYPTIKRSYNNTNQEDLLVLWGIHHPNDAAEQTRLYQNPTTYISVGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCR

SEQ ID NO: 5407 - protein, 565 aa, synthetic construct
  REGION 1..565: note = anti-influenza_Chain
MSDRRQNRKTPDEQRKANALIINENIEAYIAICKEVGLNGDEMLILENGIAIEKAIRICCDGKYQEKREKKAREAQRADSNFNADSIGIRLVKRAGSGTNITYHAVVELTSRSRIVQILKSHWGNELNRAKIAGKRLGFSALFASNLEAIIYQRGRNAARRNGSAELFTLTQGAGIETRYKWIMEKHIGIGVLIADAKGLINGKREGKRGVDANVKLRAGTTGSPLERAMQGIEKKAFPGPLRALARRVVKANYNDAREALNVIAEASLLLKPQITNKMTMPWCMWLAARLTLKDEFANFCAYAGRRAFEVFNIAMEKIGICSFQGTIMNDDEIESIEDKAQVLMMACFGLAYEDFSLVSAMVSHPLKLRNRMKIGNFRVGEKVSTVLSPLLRFTRWAEFAQRFALQANTSREGAQISNSAVFAVERKITTDVQRVEELLNKVQAHEDEPLQTLYKKVREQISIIGRNKSEIKEFLGSSMYDLNDQEKQNPINFRSGAHPFFFEFDPDYNPIRVKRPKKPIAKRNSNISRLEEEGMDENSEIGQAKKMKPLDQLTSTSSNIPGKN

SEQ ID NO: 5408 - protein, 565 aa, synthetic construct
  REGION 1..565: note = anti-influenza_Chain
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYHWTLLEPGDTIIFEANGNLIAPRYAFTLSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5409 - protein, 565 aa, synthetic construct
  REGION 1..565: note = anti-influenza_Chain
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5410 - protein, 565 aa, synthetic construct
  REGION 1..565: note = anti-influenza_Chain
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPDIGDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5411 - protein, 565 aa, synthetic construct
  REGION 1..565: note = anti-influenza_Chain
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5412 - protein, 565 aa, synthetic construct
  REGION 1..565: note = anti-influenza_Chain
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 5413 - protein, 565 aa, synthetic construct
  REGION 1..565: note = anti-influenza_Chain
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5414 - protein, 559 aa, synthetic construct
  REGION 1..559: note = anti-influenza_Chain
DKICIGYQSTNSTETVDTLTKTNVPVTQAKELLHTEHNGMLCATNLGHPLILDTCTIEGLIYGNPSCDLLLGGREWSYIVERPSAVNGMCYPGNVENLEELRLLFSSASSYQRVQIFPDTIWNVTYSGTSSACSNSFYRSMRWLTQKDNTYPVQDAQYTNNRGKSILFMWGINHPPTDTVQTNLYTRTDTTTSVTTEDINRAFKPVIGPRPLVNGLQGRIDYYWSVLKPGQTLRVRSNGNLIAPWYGHILSGESHGRILKSDLNSGNCVVQCQTERGGLNTTLPFHNVSKYAFGNCPKYVGVKSLKLAVGMRNVPARSSRGLFGAIAGFIEGGWPGLVAGWYGFQHSNDQGVGMAADRDSTQKAIDKITSKVNNIVDKMNKQYEIIDHEFSEIETRLNMINNKIDDQIQDIWAYNAELLVLLENQKTLDEHDANVNNLYNKVKRALGSNAMEDGKGCFELYHKCDDRCMETIRNGTYNRGKYKEESRLERQKIEGVKLESEGTYKSGRLVPRGSPGSGYIPEAPRDGQAYVRKDGEWVLLSTFLGKPIPNPLLGLDSTG

SEQ ID NO: 5415 - protein, 559 aa, synthetic construct; identical to SEQ ID NO: 5414
  REGION 1..559: note = anti-influenza_Chain

SEQ ID NO: 5416 - protein, 565 aa, synthetic construct; identical to SEQ ID NO: 5407
  REGION 1..565: note = anti-influenza_Chain

SEQ ID NO: 5417 - protein, 565 aa, synthetic construct; identical to SEQ ID NO: 5404
  REGION 1..565: note = anti-influenza_Chain

SEQ ID NO: 5418 - protein, 565 aa, synthetic construct; identical to SEQ ID NO: 5405
  REGION 1..565: note = anti-influenza_Chain

SEQ ID NO: 5419 - protein, 565 aa, synthetic construct; identical to SEQ ID NO: 5406
  REGION 1..565: note = anti-influenza_Chain

SEQ ID NO: 5420 - protein, 565 aa, synthetic construct; identical to SEQ ID NO: 5408
  REGION 1..565: note = anti-influenza_Chain

SEQ ID NO: 5421 - protein, 565 aa, synthetic construct; identical to SEQ ID NO: 5409
  REGION 1..565: note = anti-influenza_Chain

SEQ ID NO: 5422 - protein, 565 aa, synthetic construct; identical to SEQ ID NO: 5410
  REGION 1..565: note = anti-influenza_Chain

SEQ ID NO: 5423 - protein, 565 aa, synthetic construct; identical to SEQ ID NO: 5411
  REGION 1..565: note = anti-influenza_Chain

SEQ ID NO: 5424 - protein, 565 aa, synthetic construct; identical to SEQ ID NO: 5412
  REGION 1..565: note = anti-influenza_Chain

SEQ ID NO: 5425 - protein, 565 aa, synthetic construct; identical to SEQ ID NO: 5413
  REGION 1..565: note = anti-influenza_Chain

SEQ ID NO: 5426 - protein, 566 aa, synthetic construct
  REGION 1..566: note = anti-influenza_Chain
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPSIGSRPRIRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5427 - protein, 566 aa, synthetic construct
  REGION 1..566: note = anti-influenza_Chain
MKTIIALSYILCLVSAQKFPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIRSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5428 - protein, 566 aa, synthetic construct
  REGION 1..566: note = anti-influenza_Chain
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFKNESFNWTGVTQNGTSSACIRRSNNSFFSRLNWLTHLKFKYPALNVTMPNKEKFDKLYIWGVHHPGTDNDQIFLYAQASGRITVSTKRSQQTVIPNIGSRLRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5429 - protein, 566 aa, synthetic construct
  REGION 1..566: note = anti-influenza_Chain
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSKCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5430 - protein, 566 aa, synthetic construct
  REGION 1..566: note = anti-influenza_Chain
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5431 - protein, 566 aa, synthetic construct
  REGION 1..566: note = anti-influenza_Chain
MKTIIALSYILCLVFSQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWAGVTQNGTSSACKRRSNKSFFSRLNWLTHLKYKYPALNVTMPNNEKFDKLYIWGVHHPVTDSDQISLYAQASGRITVSTKRSQQTVIPNIGYRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 5432 - protein, 566 aa, synthetic construct
  REGION 1..566: note = anti-influenza_Chain
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNDESFNWTGVTQNGTSSSCKRRSNNSFFSRLNWLTHLKFKYPALNVTMPNNEKFDKLYIWGVHHPVTDNDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5433 - protein, 566 aa, synthetic construct
  REGION 1..566: note = anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWAILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNPQYSEEARLKREEISGVKLESIGTYQILSIYSTVASSLALAIMIAGLSLWMCSNGSLQCRICI

SEQ ID NO: 5434 - protein, 566 aa, synthetic construct
  REGION 1..566: note = anti-influenza_Chain
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5435 - protein, 566 aa, synthetic construct
  REGION 1..566: note = anti-influenza_Chain
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPPTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5436 - protein, 566 aa, synthetic construct; identical to SEQ ID NO: 5433
  REGION 1..566: note = anti-influenza_Chain

SEQ ID NO: 5437 - protein, 566 aa, synthetic construct; identical to SEQ ID NO: 5426
  REGION 1..566: note = anti-influenza_Chain

SEQ ID NO: 5438 - protein, 566 aa, synthetic construct; identical to SEQ ID NO: 5434
  REGION 1..566: note = anti-influenza_Chain

SEQ ID NO: 5439 - protein, 566 aa, synthetic construct; identical to SEQ ID NO: 5435
  REGION 1..566: note = anti-influenza_Chain

SEQ ID NO: 5440 - protein, 566 aa, synthetic construct; identical to SEQ ID NO: 5427
  REGION 1..566: note = anti-influenza_Chain

SEQ ID NO: 5441 - protein, 566 aa, synthetic construct; identical to SEQ ID NO: 5428
  REGION 1..566: note = anti-influenza_Chain

SEQ ID NO: 5442 - protein, 566 aa, synthetic construct; identical to SEQ ID NO: 5429
  REGION 1..566: note = anti-influenza_Chain

SEQ ID NO: 5443 - protein, 566 aa, synthetic construct; identical to SEQ ID NO: 5430
  REGION 1..566: note = anti-influenza_Chain

SEQ ID NO: 5444 - protein, 566 aa, synthetic construct; identical to SEQ ID NO: 5431
  REGION 1..566: note = anti-influenza_Chain

SEQ ID NO: 5445 - protein, 566 aa, synthetic construct; identical to SEQ ID NO: 5432
  REGION 1..566: note = anti-influenza_Chain

SEQ ID NO: 5446 - protein, 561 aa, synthetic construct
  REGION 1..561: note = anti-influenza_Chain
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQIQHSGGRSSLEGPRFEQKLISEEDLNMHTG

SEQ ID NO: 5447 - protein, 561 aa, synthetic construct
  REGION 1..561: note = anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGKSSFFRNVVWLIKKNSSYPTIKRSYNNTNQEDLLVLWGIHHPNDAAEQTRLYQNPTTYISVGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQIQHSGGRSSLEGPRFEQKLISEEDLNMHTG

SEQ ID NO: 5448 - protein, 567 aa, synthetic construct
  REGION 1..567: note = anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIISKSSWSDHEASSGVSSACPYQGTPSFFRNVVWLIKKNNTYPTIKRSYNNTNQEDLLILWGIHHSNNAAEQTKLYQNPTTYISVGTSTLNLRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 5449 - protein, 567 aa, synthetic construct
  REGION 1..567: note = anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 5450 - protein, 561 aa, synthetic construct
  REGION 1..561: note = anti-influenza_Chain
DKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSEVQVDANCEGDCYHSGGTIISNLPFQNINSRAVGKCPRYVKQESLLLATGMKNVPEIPKRRRRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVKRQLRENAEEDGTGCFEIFHKCDDDCMASIRNNTYDHSKYREEAIQNRIQIDPVKLSSGYKDSGRLVPRGSPGSGYIPEAPRDGQAYVRKDGEWVLLSTFLGKPIPNPLLGLDSTG

SEQ ID NO: 5451 - protein, 567 aa, synthetic construct
  REGION 1..567: note = anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 5452 - protein, 561 aa, synthetic construct; identical to SEQ ID NO: 5450
  REGION 1..561: note = anti-influenza_Chain

SEQ ID NO: 5453 - protein, 561 aa, synthetic construct; identical to SEQ ID NO: 5446
  REGION 1..561: note = anti-influenza_Chain

SEQ ID NO: 5454 - protein, 561 aa, synthetic construct; identical to SEQ ID NO: 5447
  REGION 1..561: note = anti-influenza_Chain

SEQ ID NO: 5455 - protein, 567 aa, synthetic construct; identical to SEQ ID NO: 5451
  REGION 1..567: note = anti-influenza_Chain

SEQ ID NO: 5456 - protein, 567 aa, synthetic construct; identical to SEQ ID NO: 5448
  REGION 1..567: note = anti-influenza_Chain

SEQ ID NO: 5457 - protein, 567 aa, synthetic construct; identical to SEQ ID NO: 5449
  REGION 1..567: note = anti-influenza_Chain

SEQ ID NO: 5458 - protein, 568 aa, synthetic construct
  REGION 1..568: note = anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGDFNDYEELKHLLSRINHFEKIQIIPKSSWSDYEASSGVSSACPYQGRSSFFRNVVWLIKKNNAYPTIKRSYNNTNQEDLLVLWGIHHPNDAAEQIRLYQNPTTYISIGTSTLNQRLVPKIATRSKVNGQSGRMEFFWTILKSNDAINFESNGNFIAPEYAYKIVKKGDSTIMKSELEYGNCNTKCQTPIGAINSSMPFHNIHPLTIGECPKYVKSNRLVLATGLRNSPQGERRRRKRGLFGAIAGFIEGGWQGMVDGWYGYHHSNEQGSGYAADKESTQKAIDGVTNKVNSIINKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESMGIYQILSIYSTVASSLALAIMVAGLFLWMCSNGSLQCRICI

SEQ ID NO: 5459 - protein, 568 aa, synthetic construct
  REGION 1..568: note = anti-influenza_Chain
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMMAGLSLWMCSNGSLQCRICI

SEQ ID NO: 5460 - protein, 568 aa, synthetic construct
  REGION 1..568: note = anti-influenza_Chain
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 5461 - protein, 568 aa, synthetic construct; identical to SEQ ID NO: 5458
  REGION 1..568: note = anti-influenza_Chain

SEQ ID NO: 5462 - protein, 568 aa, synthetic construct; identical to SEQ ID NO: 5459
  REGION 1..568: note = anti-influenza_Chain

SEQ ID NO: 5463 - protein, 568 aa, synthetic construct; identical to SEQ ID NO: 5460
  REGION 1..568: note = anti-influenza_Chain

SEQ ID NO: 5464 - protein, 569 aa, synthetic construct
  REGION 1..569: note = anti-influenza_Chain
SKSRGYKMNTQILVFALVASIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSEVQVDANCEGDCYHSGGTIISNLPFQNINSRAVGKCPRYVKQESLLLATGMKNVPEIPKRRRRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVKRQLRENAEEDGTGCFEIFHKCDDDCMASIRNNTYDHSKYREEAIQNRIQIDPVKLSSGYKDVILWFSFGASCFILLAIAMGLVFICVKNGNMRCTICI

SEQ ID NO: 5465 - protein, 569 aa, synthetic construct; identical to SEQ ID NO: 5464
  REGION 1..569: note = anti-influenza_Chain

SEQ ID NO: 5466 - protein, 564 aa, synthetic construct
  REGION 1..564: note = anti-influenza_Chain
DQICIGYHANNSTEKVDTNLERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKEGSDYPVAKGSYNNTSGEQMLIIWGVHHPIDETEQRTLYQNVGTYVSVGTSTLNKRSTPEIATRPKVNGQGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFGNLERRLENLNKRMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQSGRLVPRGSPGSGYIPEAPRDGQAYVRKDGEWVLLSTFLGKPIPNPLLGLDSTG

SEQ ID NO: 5467 - protein, 564 aa, synthetic construct
  REGION 1..564: note = anti-influenza_Chain
QKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNDESFNWTGVTQNGTSSSCKRRSNNSFFSRLNWLTQLKFKYPALNVTMPNNEKFDKLYIWGVHHPVTDNDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGSGRLVPRGSPGSGYIPEAPRDGQAYVRKDGEWVLLSTFLGKPIPNPLLGLDSTG

SEQ ID NO: 5468 - protein, 564 aa, synthetic construct; identical to SEQ ID NO: 5466
  REGION 1..564: note = anti-influenza_Chain

SEQ ID NO: 5469 - protein, 564 aa, synthetic construct; identical to SEQ ID NO: 5467
  REGION 1..564: note = anti-influenza_Chain

SEQ ID NO: 5470 - protein, 565 aa, synthetic construct
  REGION 1..565: note = anti-influenza_Chain
DTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQSGRLVPRGSPGSGYIPEAPRDGQAYVRKDGEWVLLSTFLGKPIPNPLLGLDSTG

SEQ ID NO: 5471 - protein, 565 aa, synthetic construct
  REGION 1..565: note = anti-influenza_Chain
QNYTGNPVICLGHHAVSNGTMVKTLTDDQIEVVTAQELVESQHLPELCPSPLRLVDGQTCDIVNGALGSPGCDHLNGAEWDVFIERPTAVDTCYPFDVPDYQSLRSILANNGKFEFIAEEFQWNTVKQNGKSGACKRANVNDFFNRLNWLTKSDGNAYPLQNLTKVNNGDYARLYIWGVHHPSTDTEQTNLYKNNPGRVTVSTQTSQTSVVPNIGSRPWVRGLSSRISFYWTIVEPGDLIVFNTIGNLIAPRGHYKLNSQKKSTILNTAVPIGSCVSKCHTDKGSISTTKPFQNISRISIGDCPKYVKQGSLKLATGMRSILEKATRGLFGAIAGFIENGWQGLIDGWYGFRHQNAEGTGTAADLKSTQAAIDQINGKLNRLIGKPNEKYHQIEKEFEQVEGRIQDLEKYVEDTKIDLWSYNAELLVALENQHTIDVTDSEMNKLFERVRHQLRENAEDKGNGCFEIFHQCDNSCIESIRNGTYDHDIYRDEAINNRFQIQGVKLIQGYKDSGRLVPRGSPGSGYIPEAPRDGQAYVRKDGEWVLLSTFLGKPIPNPLLGLDSTG

SEQ ID NO: 5472 - protein, 565 aa, synthetic construct
  REGION 1..565: note = anti-influenza_Chain
DQICIGYHANNSTEQVDTIMEKNVTVTHAQDILEKTHNGKLCNLDGVKPLILKDCSVAGWLLGNPMCDEFLNVSEWSYIVEKASPANGLCYPGDFNDYEELKHLLSRINHLKKIKIIPKSYWSNHEASSGVSAACSYLGEPSFFRNVVWLIKKNNTYPPIKVNYTNTNQEDLLVLWGIHHPNDEKEQIRIYQNPNTSISVGTSTLNQRLVPKIATRPKVNGQSGRMEFFWTILKPNDSINFDSNGNFIAPEYAYKIAKKGDSVIMKSELEYGNCNTKCQTPMGAINSSMPFHNIHPLTIGECPKYVKSNRLVLATGLRNAPQTETRGLFGAIAGFIEGGWQGMVDGWYGYHHSNEQGSGYAADKESTQKAIDGITNKVNSIIDKMNTQFEIVGREFNNLERRIENLNKKMEDGFLDVWTYNAELLVLMENERTLDFHDSNVKNLYEKVRLQLRDNAKELGNGCFEFYHKCDNECMESVRNGTYDYPQYSEEARLSREEISGVKMESMVTYQSGRLVPRGSPGSGYIPEAPRDGQAYVRKDGEWVLLSTFLGKPIPNPLLGLDSTG

SEQ ID NO: 5473 - protein, 565 aa, synthetic construct; identical to SEQ ID NO: 5470
  REGION 1..565: note = anti-influenza_Chain

SEQ ID NO: 5474 - protein, 565 aa, synthetic construct; identical to SEQ ID NO: 5471
  REGION 1..565: note = anti-influenza_Chain

SEQ ID NO: 5475 - protein, 565 aa, synthetic construct; identical to SEQ ID NO: 5472
  REGION 1..565: note = anti-influenza_Chain

SEQ ID NO: 5476 - protein, 566 aa, synthetic construct
  REGION 1..566: note = anti-influenza_Chain
DTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQSGRLVPRGSPGSGYIPEAPRDGQAYVRKDGEWVLLSTFLGKPIPNPLLGLDSTG

SEQ ID NO: 5477 - protein, 566 aa, synthetic construct
  REGION 1..566: note = anti-influenza_Chain
DRICIGYQSNNSTDTVNTLIEQKVPVTQTMELVETEKHPAYCNTDLGAPLELRDCKIEAVIYGNPKCDIHLKDQGWSYIVERPSAPEGMCYPGSVENLEELRFVFSSAASYKRIRLFDYSRWNVTSSGTSKACNASTGGQSFYRSINWLTKKKPDTYDFNEGTYVNNEDGDIIFLWGIHHPPDTKEQTTLYKNANTLSSVTTNTINRSFQPNIGPRPLVRGQQGRMDYYWGILKRGETLKIRTNGNLIAPEFGYLLKGESHGRTIQNEDIPIGNCYTKCQTYAGAINSSKPFQNASRHYMGECPKYVKKASLRLAVGLRNTPSVEPRGLFGAIAGFIEGGWSGMIDGWYGFHHSNSEGTGMAADQKSTQEAIDKITNKVNNIVDKMNREFEVVNHEFSEVEKRINMINDKIDDQIEDLWAYNAELLVLLENQKTLDEHDSNVKNLFDEVKRRLSANAIDAGNGCFDILHKCDNECMETIKNGTYDHKEYEEEAKLERSKINGVKLEENTTYKSGRLVPRGSPGSGYIPEAPRDGQAYVRKDGEWVLLSTFLGKPIPNPLLGLDSTG

SEQ ID NO: 5478 - protein, 566 aa, synthetic construct; identical to SEQ ID NO: 5476
  REGION 1..566: note = anti-influenza_Chain

SEQ ID NO: 5479 - protein, 566 aa, synthetic construct; identical to SEQ ID NO: 5477
  REGION 1..566: note = anti-influenza_Chain

SEQ ID NO: 5480 - protein, 567 aa, synthetic construct
  REGION 1..567: note = anti-influenza_Chain
DKICIGYHANNSTTQVDTILEKNVTVTHSVELLENQKEERFCKILNKAPLDLRGCTIEGWILGNPQCDLLLGDQSWSYIVERPTAQNGICYPGALNEVEELKALIGSGERVERFEMFPKSTWTGVDTSSGVTKACPYNSGSSFYRNLLWIIKTKSAAYPVIKGTYNNTGSQPILYFWGVHHPPDTNEQNTLYGSGDRYVRMGTESMNFAKSPEIAARPAVNGQRGRIDYYWSVLKPGETLNVESNGNLIAPWYAYKFVSTNNKGAIFKSNLPIENCDATCQTIAGVLRTNKTFQNVSPLWIGECPKYVKSESLRLATGLRNVPQIETRGLFGAIAGFIEGGWTGMIDGWYGYHHENSQGSGYAADKESTQKAIDGITNKVNSIIDKMNTQFEAVDHEFSNLERRIDNLNKRMEDGFLDVWTYNAELLVLLENERTLDLHDANVKNLYEKVKSQLRDNANDLGNGCFEFWHKCDNECIESVKNGTYDYPKYQDESKLNRQEIESVKLDNLGVYQSGRLVPRGSPGSGYIPEAPRDGQAYVRKDGEWVLLSTFLGKPIPNPLLGLDSTG

SEQ ID NO: 5481 - protein, 567 aa, synthetic construct; identical to SEQ ID NO: 5480
  REGION 1..567: note = anti-influenza_Chain

SEQ ID NO: 5482 - protein, 568 aa, synthetic construct
  REGION 1..568: note = anti-influenza_Chain
DHICIGYHANNSTEQVDTIMEKNVTVTHAQDILEKTHNGKLCDLNGVKPLILKDCSVAGWLLGNPMCDEFINVPEWSYIVEKANPANDLCYPGNFNDYEELKHLLSRINHFEKIQIIPKDSWSDHEASLGVSSACPYQGNSSFFRNVVWLIKKGNAYPTIKKSYNNTNQEDLLVLWGIHHPNDEAEQTRLYQNPTTYISIGTSTLNQRLVPKIATRSKVNGQSGRIDFFWTILKPNDAINFESNGNFIAPEYAYKIVKKGDSTIMKSEVEYGNCNTRCQTPMGAINSSMPFHNIHPLTIGECPKYVKSNKLVLATGLRNSPQRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQSGRLVPRGSPGSGYIPEAPRDGQAYVRKDGEWVLLSTFLGKPIPNPLLGLDSTG

SEQ ID NO: 5483 - protein, 568 aa, synthetic construct
  REGION 1..568: note = anti-influenza_Chain
DQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQSGRLVPRGSPGSGYIPEAPRDGQAYVRKDGEWVLLSTFLGKPIPNPLLGLDSTG

SEQ ID NO: 5484 - protein, 568 aa, synthetic construct; identical to SEQ ID NO: 5482
  REGION 1..568: note = anti-influenza_Chain

SEQ ID NO: 5485 - protein, 568 aa, synthetic construct; identical to SEQ ID NO: 5483
  REGION 1..568: note = anti-influenza_Chain

SEQ ID NO: 5486 - protein, 569 aa, synthetic construct
  REGION 1..569: note = anti-influenza_Chain
DQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQSGRLVPRGSPGSGYIPEAPRDGQAYVRKDGEWVLLSTFLGKPIPNPLLGLDSTG

SEQ ID NO: 5487 - protein, 569 aa, synthetic construct
  REGION 1..569: note = anti-influenza_Chain
DQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQSGRLVPRGSPGSGYIPEAPRDGQAYVRKDGEWVLLSTFLGKPIPNPLLGLDSTG

SEQ ID NO: 5488 - protein, 569 aa, synthetic construct
  REGION 1..569: note = anti-influenza_Chain
DQICIGYHANNSTEQVDTIMEKNVTVTHAQDILEKTHNGKLCDLDGVKPLILRDCSVAGWLLGNPMCDEFLNVSEWSYIVEKINPANDLCYPGNFNNYEELKHLLSRINRFEKIQIIPKSSWPDHEASLGVSSACPYQGGPSFYRNVVWLIKKNNTYPTIKKSYHNTNQEDLLVLWGIHHPNDEAEQTRIYKNPTTYISVGTSTLNQRLVPKIATRSKVNGQSGRVEFFWTILKSNDTINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQSGRLVPRGSPGSGYIPEAPRDGQAYVRKDGEWVLLSTFLGKPIPNPLLGLDSTG

SEQ ID NO: 5489 - protein, 569 aa, synthetic construct; identical to SEQ ID NO: 5486
  REGION 1..569: note = anti-influenza_Chain

SEQ ID NO: 5490 - protein, 569 aa, synthetic construct; identical to SEQ ID NO: 5487
  REGION 1..569: note = anti-influenza_Chain

SEQ ID NO: 5491 - protein, 569 aa, synthetic construct; identical to SEQ ID NO: 5488
  REGION 1..569: note = anti-influenza_Chain

SEQ ID NO: 5492 - protein, 576 aa, synthetic construct
  REGION 1..576: note = anti-influenza_Chain
ICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQNGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLGYIPEAPRDGQAYVRKDGEWVLLSTFLRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5493 - protein, 576 aa, synthetic construct
  REGION 1..576: note = anti-influenza_Chain
MVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGKSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCFHS

SEQ ID NO: 5494 - protein, 576 aa, synthetic construct; identical to SEQ ID NO: 5493
  REGION 1..576: note = anti-influenza_Chain

SEQ ID NO: 5495 - protein, 576 aa, synthetic construct; identical to SEQ ID NO: 5492
  REGION 1..576: note = anti-influenza_Chain

SEQ ID NO: 5496 - protein, 577 aa, synthetic construct
  REGION 1..577: note = anti-influenza_Chain
AKAGVQSVKMEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALALMVAGLSLWMCSNGSLQCRICI

SEQ ID NO: 5497 - protein, 577 aa, synthetic construct; identical to SEQ ID NO: 5496
  REGION 1..577: note = anti-influenza_Chain

SEQ ID NO: 5498 - protein, 579 aa, synthetic construct
  REGION 1..579: note = anti-influenza_Chain
MVVTSNADRICTGITSSNSPHVVKTATQGEVNVTGVIPLTTTPTKSHFANLKGTQTRGKLCPNCLNCTDLDVALGRPKCMGTIPSAKASILHEVKPVTSGCFPIMHDRTKIRQLPNLLRGYENIRLSARNVINAETAPGGPYIVGTSGSCPNVTNGKGFFATMAWAVPKNKNKTATNPLTVEVPYICTKGEDQITVWGFHSDNEAQMVTLYGDSKPQKFTSSANGVTTHYVSQIGGFPNQTEDEGLQQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVFLLHLSIRK

SEQ ID NO: 5499 - protein, 579 aa, synthetic construct; identical to SEQ ID NO: 5498
  REGION 1..579: note = anti-influenza_Chain

SEQ ID NO: 5500 - protein, 577 aa, synthetic construct
  REGION 1..577: note = anti-influenza_Chain
METISLITILLVVTASNADKICIGHQSTNSTETVDTLTETNVPVTHAKELLHTEHNGMLCATSLGHPLILDTCTIEGLVYGNPSCDLLLGGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTDLKGGNCVVQCQTEKGGLNSTLPFHNISKYAFGTCPKYVRVNSLKLAVGLRNVPARSSRGLFGAIAGFIEGGWPGLVAGWYGFQHSNDQGVGMAADRDSTQKAIDKITSKVNNIVDKMNKQYEIIDHEFSEVETRLNMINNKIDDQIQDVWAYNAELLVLLENQKTLDEHDANVNNLYNKVKRALGSNAMEDGKGCFELYHKCDDQCMETIRNGTYNRRKYREESRLERQKIEGVKLESEGTYKSGRLVPRGSPGSGYIPEAPRDGQAYVRKDGEWVLLSTFLGKPIPNPLLGLDSTG

SEQ ID NO: 5501 - protein, 577 aa, synthetic construct; identical to SEQ ID NO: 5500
  REGION 1..577: note = anti-influenza_Chain

SEQ ID NO: 5502 - protein, 584 aa, synthetic construct
  REGION 1..584: note = anti-influenza_Chain
MKAIIVLLMVVTSNADRICTGITSSNSPHVVKTATQGEVNVTGVIPLTTTPTKSHFANLKGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNYLSELEVKNLQRLSGAMNELHDEILELDEKVDDLRADTISSQIELAVLLSNEGIINSEDEHLLALERKLKKMLGPSAVEIGNGCFETKHKCNQTCLDRIAAGTFNAGDFSLPTFDSLNITAASLNDDGLDNHTILLYYSTAASSLAVTLMIAIFIVYMVSRDNVSCSICL

SEQ ID NO: 5503 - protein, 584 aa, synthetic construct
  REGION 1..584: note = anti-influenza_Chain
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 5504 - protein, 584 aa, synthetic construct
  REGION 1..584: note = anti-influenza_Chain
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 5505 - protein, 584 aa, synthetic construct; identical to SEQ ID NO: 5502
  REGION 1..584: note = anti-influenza_Chain

SEQ ID NO: 5506 - protein, 584 aa, synthetic construct; identical to SEQ ID NO: 5503
  REGION 1..584: note = anti-influenza_Chain

SEQ ID NO: 5507 - protein, 584 aa, synthetic construct; identical to SEQ ID NO: 5504
  REGION 1..584: note = anti-influenza_Chain

SEQ ID NO: 5508 - protein, 586 aa, synthetic construct
  REGION 1..586: note = anti-influenza_Chain
MKAIIVLLMVVTSNADRIICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 5509 - protein, 586 aa, synthetic construct; identical to SEQ ID NO: 5508
  REGION 1..586: note = anti-influenza_Chain

SEQ ID NO: 5510 - protein, 583 aa, synthetic construct
  REGION 1..583: note = anti-influenza_Chain
MEARLLVLLCAFAATNADTICIGYHANNSTDTVDTVLEKNVTVTHSVNLLEDSHNGKLCKLKGIAPLQLGKCNIAGWLLGNPECDLLLTASSWSYIVETSNSENGTCYPGDFIDYEELREQLSSVSSFEKFEIFPKTSSWPNHETTKGVTAACSYAGASSFYRNLLWLTKKGSSYPKLSKSYVNNKGKEVLVLWGVHHPPTGTDQQSLYQNADAYVSVGSSKYNRRFTPEIAARPKVRDQAGRMNYYWTLLEPGDTITFEATGNLIAPWYAFALNRGSGSGIITSDAPVHDCNTKCQTPHGAINSSLPFQNIHPVTIGECPKYVRSTKLRMATGLRNIPSIQSRGLFGAIAGFIEGGWTGMIDGWYGYHHQNEQGSGYAADQKSTQNAIDGITNKVNSVIEKMNTQFTAVGKEFNNLERRIENLNKKVDDGFLDIWTYNAELLVLLENERTLDFHDSNVRNLYEKVKSQLKNNAKEIGNGCFEFYHKCDDACMESVRNGTYDYPKYSEESKLNREEIDGVKLESMGVYQSGRLVPRGSPGSGYIPEAPRDGQAYVRKDGEWVLLSTFLGKPIPNPLLGLDSTG

SEQ ID NO: 5511 - protein, 583 aa, synthetic construct; identical to SEQ ID NO: 5510
  REGION 1..583: note = anti-influenza_Chain

SEQ ID NO: 5512 - protein, 585 aa, synthetic construct
  REGION 1..585: note = anti-influenza_Chain
MERTVLLLATVSLVKSDQICIGYHANNSTEQVDTIMEKNVTVTHAQDILERTHNGKLCDLNGVKPLILRDCSVAGWLLGNPMCDEFINVPEWSYIVEKASPANDLCYPGNFNDYEELKHLLSRINHFEKIQIIPKSSWSNHDASSGVSSACPYLGRSSFFRNVVWLIKKNSAYPTIKRSYNNTNQEDLLVLWGVHHPNDAAEQTKLYQNPTTYISVGTSTLNQRLVPEIATRPKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNTPQRERRRKKRGLFGAIAGFIEGGWQGMVDGWYGYHHSNEQGSCYSADKESTQKAIDGVTNKVNSIINKMNTQFEAVGREFNNLERRIENLNKKMEDGFLDVWTYNAELLVLMENERTLDFHDSNVKNLYDKVRLQLRDNAKELGNGCFEFYHKCDNECMESVKNGTYDYPQYSEEARLNREEISGVKLESMGTYQSGRLVPRGSPGSGYIPEAPRDGQAYVRKDGEWVLLSTFLGKPIPNPLLGLDSTG

SEQ ID NO: 5513 - protein, 585 aa, synthetic construct; identical to SEQ ID NO: 5512
  REGION 1..585: note = anti-influenza_Chain

SEQ ID NO: 5514 - protein, 649 aa, synthetic construct
  REGION 1..649: note = anti-influenza_Chain
MGDKINFIFGIHNHQPLGNFGWVFEEAYEKCYWPFLETLEEYPNMKVAIHTSGPLIEWLQDNRPEYIDLLRSLVKRGQVEIVVAGFYEPVLASIPKEDRIEQIRLMKEWAKSIGFDARGVWLTERVWQPELVKTLKESGIDYVIVDDYHFMSAGLSKEELYWPYYTEDGGEVIAVFPIDEKLRYLIPFRPVDKVLEYLHSLIDGDESKVAVFHDDGEKFGIWPGTYEWVYEKGWLREFFDRISSDEKINLMLYTEYLEKYKPRGLVYLPIASYFEMSEWSLPAKQARLFVEFVNELKVKGIFEKYRVFVRGGIWKNFFYKYPESNYMHKRMLMVSKLVRNNPEARKYLLRAQCNDAYWHGLFGGVYLPHLRRAIWNNLIKANSYVSLGKVIRDIDYDGFEEVLIENDNFYAVFKPSYGGSLVEFSSKNRLVNYVDVLARRWEHYHGYVESQFDGVASIHELEKKIPDEIRKEVAYDKYRRFMLQDHVVPLGTTLEDFMFSRQQEIGEFPRVPYSYELLDGGIRLKREHLGIEVEKTVKLVNDGFEVEYIVNNKTGNPVLFAVELNVAVQSIMESPGVLRGKEIVVDDKYAVGKFALKFEDEMEVWKYPVKTLSQSESGWDLIQQGVSYIVPIRLEDKIRFKLKFEEASG

SEQ ID NO: 5515 - protein, 649 aa, synthetic construct
  REGION 1..649: note = anti-influenza_Chain
MSRMTLKSSMKKRVLSLLIAVVFLSLTGVFPSGLIETKVSAAKITENYQFDSRIRLNSIGFIPNHSKKATIAANCSTFYVVKEDGTIVYTGTATSMFDNDTKETVYIADFSSVNEEGTYYLAVPGVGKSVNFKIAMNVYEDAFKTAMLGMYLLRCGTSVSATYNGIHYSHGPCHTNDAYLDYINGQHTKKDSTKGWHDAGDYNKYVVNAGITVGSMFLAWEHFKDQLEPVALEIPEKNNSIPDFLDELKYEIDWILTMQYPDGSGRVAHKVSTRNFGGFIMPENEHDERFFVPWSSAATADFVAMTAMAARIFRPYDPQYAEKCINAAKVSYEFLKNNPANVFANQSGFSTGEYATVSDADDRLWAAAEMWETLGDEEYLRDFENRAAQFSKKIEADFDWDNVANLGMFTYLLSERPGKNPALVQSIKDSLLSTADSIVRTSQNHGYGRTLGTTYYWGCNGTVVRQTMILQVANKISPNNDYVNAALDAISHVFGRNYYNRSYVTGLGINPPMNPHDRRSGADGIWEPWPGYLVGGGWPGPKDWVDIQDSYQTNEIAINWNAALIYALAGFVNYNSPQNEVLYGDVNDDGKVNSTDLTLLKRYVLKAVSTLPSSKAEKNADVNRDGRVNSSDVTILSRYLIRVIEKLPI

SEQ ID NO: 5516 - protein, 649 aa, synthetic construct; identical to SEQ ID NO: 5514
  REGION 1..649: note = anti-influenza_Chain

SEQ ID NO: 5517 - protein, 649 aa, synthetic construct; identical to SEQ ID NO: 5515
  REGION 1..649: note = anti-influenza_Chain

SEQ ID NO: 5518 - protein, 682 aa, synthetic construct
  REGION 1..682: note = anti-influenza_Chain
MKPSHFTEKRFMKKVLGLFLVVVMLASVGVLPTSKVQAAGTTVTSMEYFSPADGPVISKSGVGKASYGFVMPKFNGGSATWNDVYSDVGVNVKVGNNWVDIDQAGGYIYNQNWGHWSDGGFNGYWFTLSATTEIQLYSKANGVKLEYQLVFQNINKTTITAMNPTQGPQITASFTGGAGFTYPTFNNDSAVTYEAVADDLKVYVKPVNSSSWIDIDNNAASGWIYDHNFGQFTDGGGGYWFNVTESINVKLESKTSSANLVYTITFNEPTRNSYVITPYEGTTFTADANGSIGIPLPKIDGGAPIAKELGNFVYQININGQWVDLSNSSQSKFAYSANGYNNMSDANQWGYWADYIYGLWFQPIQENMQIRIGYPLNGQAGGNIGNNFVNYTFIGNPNAPRPDVSDQEDISIGTPTDPAIAGMNLIWQDEFNGTTLDTSKWNYETGYYLNNDPATWGWGNAELQHYTNSTQNVYVQDGKLNIKAMNDSKSFPQDPNRYAQYSSGKINTKDKLSLKYGRVDFRAKLPTGDGVWPALWMLPKDSVYGTWAASGEIDVMEARGRLPGSVSGTIHFGGQWPVNQSSGGDYHFPEGQTFANDYHVYSVVWEEDNIKWYVDGKFFYKVTNQQWYSTAAPNNPNAPFDEPFYLIMNLAVGGNFDGGRTPNASDIPATMQVDYVRVYKEQ

SEQ ID NO: 5519 - protein, 682 aa, synthetic construct; identical to SEQ ID NO: 5518
  REGION 1..682: note = anti-influenza_Chain

SEQ ID NO: 5520 - protein, 686 aa, synthetic construct
  REGION 1..686: note = anti-influenza_Chain
MTKSIYFSLGIHNHQPVGNFDFVIERAYEMSYKPLINFFFKHPDFPINVHFSGFLLLWLEKNHPEYFEKLKIMAERGQIEFVSGGFYEPILPIIPDKDKVQQIKKLNKYIYDKFGQTPKGMWLAERVWEPHLVKYIAEAGIEYVVVDDAHFFSVGLKEEDLFGYYLMEEQGYKLAVFPISMKLRYLIPFADPEETITYLDKFASEDKSKIALLFDDGEKFGLWPDTYRTVYEEGWLETFVSKIKENFLLVTPVNLYTYMQRVKPKGRIYLPTASYREMMEWVLFPEAQKELEELVEKLKTENLWDKFSPYVKGGFWRNFLAKYDESNHMQKKMLYVWKKVQDSPNEEVKEKAMEEVFQGQANDAYWHGIFGGLYLPHLRTAIYEHLIKAENYLENSEIRFNIFDFDCDGNDEIIVESPFFNLYLSPNHGGSVLEWDFKTKAFNLTNVLTRRKEAYHSKLSYVTSEAQGKSIHERWTAKEEGLENILFYDNHRRVSFTEKIFESEPVLEDLWKDSSRLEVDSFYENYDYEINKDENKIRVLFSGVFRGFELCKSYILYKDKSFVDVVYEIKNVSETPISLNFGWEINLNFLAPNHPDYYFLIGDQKYPLSSFGIEKVNNWKIFSGIGIELECVLDVEASLYRYPIETVSLSEEGFERVYQGSALIHFYKVDLPVGSTWRTTIRFWVK

SEQ ID NO: 5521 - protein, 686 aa, synthetic construct; identical to SEQ ID NO: 5520
  REGION 1..686: note = anti-influenza_Chain

SEQ ID NO: 5522 - protein, 705 aa, synthetic construct
  REGION 1..705: note = anti-influenza_Chain
MPTNLFFNAHHSPVGAFASFTLGFPGKSGGLDLELARPPRQNVLIGVESLHESGLYHVLPFLETAEEDESKRYDIENPDPNPQKPNILIPFAKEEIQREFHVATDTWKAGDLTFTIYSPVKAVPNPETADEEELKLALVPAVIVEMTIDNTNGTRARRAFFGFEGTDPYTSMRRIDDTCPQLRGVGQGRILSIVSKDEGVRSALHFSMEDILTAQLEENWTFGLGKVGALIVDVPAGEKKTYQFAVCFYRGGYVTAGMDASYFYTRFFQNIEEVGLYALEQAEVLKEQSFRSNKLIEKEWLSDDQTFMMAHAIRSYYGNTQLLEHEGKPIWVVNEGEYRMMNTFDLTVDQLFFELKLNPWTVKNVLDLYVERYSYEDRVRFPGEETEYPSGISFTHDMGVANTFSRPHYSSYELYGISGCFSHMTHEQLVNWVLCAAVYIEQTKDWAWRDKRLAILEQCLESMVRRDHPDPEQRNGVMGLDSTRTMGGAEITTYDSLDVSLGQARNNLYLAGKCWAAYVALEKLFRDVGKEELAALAGEQAEKCAATIVSHVTDDGYIPAIMGEGNDSKIIPAIEGLVFPYFTNCHEALDENGRFGAYIQALRNHLQYVLREGICLFPDGGWKISSTSNNSWLSKIYLCQFIARHILGWEWDEQGKRADAAHVAWLTHPTLSIWSWSDQIIAGEITGSKYYPRGVTSILWLEEGE

SEQ ID NO: 5523 - protein, 705 aa, synthetic construct; identical to SEQ ID NO: 5522
  REGION 1..705: note = anti-influenza_Chain

SEQ ID NO: 5524 - protein, 716 aa, synthetic construct
  REGION 1..716: note = anti-influenza_Chain
MEDFVRQCFNPMIVELAEKAMKEYGEDLKIETNKFAAICTHLEVCFMYSDFHFINEQGESIIVEPEDPNALLKHRFEIIEGRDRTMAWTVVNSICNTTGAEKPKFLPDLYDYKENRFIEIGVTRREVHIYYLEKANKIKSEKTHIHIFSFTGEEMATKADYTLDEESRARIKTRLFTIRQEMASRGLWDSFRQSERGEETIEERFEITGTMRRLADQSLPPNFSCLENFRAYVDGFEPNGYIEGKLSQMSKEVNARIEPFLRTTPRPIRLPDGPPCFQRSKFLLMDSLKLSIEDPSHEGEGIPLYDAIKCMRTFFGWKEPSVVKPHGKGINPNYLLSWKQVLAELQDIESEEKIPRTKNMKKTSQLKWALGENMAPEKVDFDDCKDISDLKQYDSDEPELRSLSSWIQNEFNKACELTDSIWIELDEIGEDVAPIEHIASMRRNYFTAEVSHCRATEYIMKGVYINTALLNASCAAMDDFQLIPMISKCRTKEGRRKTNLYGFIIKGRSHLRNDTDVVNFVSMEFSLTDPRLEPHKWEKYCVLEIGDMLLRSAIGQVSRPMFLYVRTNGTSKIKMKWGMEMRRCLLQSLQQIESMIEAESSVKEKDMTKEFFENRSETWPIGESPKGVEEGSIGKVCRTLLAKSVFNSLYASPQLEGFSAESRKLLLIVQALRDNLEPGTFDLGGLYEAIEECLINDPWVLLNASWFNSFLTHALR

SEQ ID NO: 5525 - protein, 716 aa, synthetic construct; identical to SEQ ID NO: 5524
  REGION 1..716: note = anti-influenza_Chain

SEQ ID NO: 5526 - protein, 752 aa, synthetic construct
  REGION 1..752: note = anti-influenza_Chain
MNINPYFLFIDVPIQAAISTTFPYTGVPPYSHGTGTGYTIDTVIRTHEYSNKGKQYISDVTGCVMVDPTNGPLPEDNEPSAYAQLDCVLEALDRMDEEHPGLFQAGSQNAMEALMVTTVDKLTQGRQTFDWTVCRNQPAATALNTTITSFRLNDLNGADKGGLVPFCQDIIDSLDKPEMIFFTVKNIKKKLPAKNRKGFLIKRIPMKVKDRITRVEYIKRALSLNTMTKDAERGKLKRRAIATAGIQIRGFVLVVENLAKNICENLEQSGLPVGGNEKKAKLSNAVAKMLSNCPPGGISMTVTGDNTKWNECLNPRIFLAMTERITRDSPIWFRDFCSIAPVLFSNKIARLGKGFMITSKTKRLKAQIPCPDLFNIPLERYNEETRAKLKKLKPFFNEEGTASLSPGMMMGMFNMLSTVLGVAALGIKNIGNKEYLWDGLQSSDDFALFVNAKDEETCMEGINDFYRTCKLLGINMSKKKSYCNETGMFEFTSMFYRDGFVSNFAMELPSFGVAGVNESADMAIGMTIIKNNMINNGMGPATAQTAIQLFIADYRYTYKCHRGDSKVEGKRMKIIKELWENTKGRDGLLVADGGPNLYNLRNLHIPEIILKYNIMDPEYKGRLLHPQNPFVGHLSIEGIKEADITPAHGPIKKMDYDAVSGTHSWRTKRNRSILNTDQRNMILEEQCYAKCCNLFEACFNSASYRKPVGQHSMLEAMAHRLRMDARLDYESGRMSKEDFEKAMAHLGEIGYM

SEQ ID NO: 5527 - protein, 752 aa, synthetic construct; identical to SEQ ID NO: 5526
  REGION 1..752: note = anti-influenza_Chain

SEQ ID NO: 5528 - protein, 755 aa, synthetic construct
  REGION 1..755: note = anti-influenza_Chain
MAVDIKKIIKQMTLEEKAGLCSGLDFWHTKPVERLGIPSIMMTDGPHGLRKQREDAEIADINNSVPATCFPSAAGLACSWDRELVERVGAALGEECQAENVSILLGPGANIKRSPLCGRNFEYFSEDPYLSSELAASHIKGVQSQGVGACLKHFAANNQEHRRMTVDTIVDERTLREIYFASFENAVKKARPWVVMCAYNKLNGEYCSENRYLLTEVLKNEWMHDGFVVSDWGAVNDRVSGLDAGLDLEMPTSHGITDKKIVEAVKSGKLSENILNRAVERILKVIFMALENKKENAQYDKDAHHRLARQAAAESMVLLKNEDDVLPLKKSGTIALIGAFVKKPRYQGSGSSHITPTRLDDIYEEIKKAGGDKVNLVYSEGYRLENDGIDEELINEAKKAASSSDVAVVFAGLPDEYESEGFDRTHMSIPENQNRLIEAVAEVQSNIVVVLLNGSPVEMPWIDKVKSVLEAYLGGQALGGALADVLFGEVNPSGKLAETFPVKLSHNPSYLNFPGEDDRVEYKEGLFVGYRYYDTKGIEPLFPFGHGLSYTKFEYSDISVDKKDVSDNSIINVSVKVKNVGKMAGKEIVQLYVKDVKSSVRRPEKELKGFEKVFLNPGEEKTVTFTLDKRAFAYYNTQIKDWHVESGEFLILIGRSSRDIVLKESVRVNSTVKIRKRFTVNSAVEDVMSDSSAAAVLGPVLKEITDALQIDMDNAHDMMAANIKNMPLRSLVGYSQGRLSEEMLEELVDKINNVE

SEQ ID NO: 5529 - protein, 755 aa, synthetic construct; identical to SEQ ID NO: 5528
  REGION 1..755: note = anti-influenza_Chain

SEQ ID NO: 5530 - protein, 759 aa, synthetic construct
  REGION 1..759: note = anti-influenza_Chain
MERIKELRNLMSQSRTREILTKTTVDHMAIIKKYTSGRQEKNPALRMKWMMAMKYPITADKRITEMIPERNEQGQTLWSKMNDAGSDRVMVSPLAVTWWNRNGPMTNTVHYPKIYKTYFERVERLKHGTFGPVHFRNQVKIRRRVDINPGHADLSAKEAQDVIMEVVFPNEVGARILTSESQLTITKEKKEELQDCKISPLMVAYMLERELVRKTRFLPVAGGTSSVYIEVLHLTQGTCWEQMYTPGGEVKNDDVDQSLIIAARNIVRRAAVSADPLASLLEMCHSTQIGGIRMVDILKQNPTEEQAVGICKAAMGLRISSSFSFGGFTFKRTSGSSVKREEEVLTGNLQTLKIRVHEGYEEFTMVGRRATAILRKATRRLIQLIVSGRDEQSIAEAIIVAMVFSQEDCMIKAVRGDLNFVNRANQRLNPMHQLLRHFQKDAKVLFQNWGVEPIDNVMGMIGILPDMTPSIEMSMRGVRISKMGVDEYSSTERVVVSIDRFLRVRDQRGNVLLSPEEVSETQGTEKLTITYSSSMMWEINGPESVLVNTYQWIIRNWETVKIQWSQNPTMLYNKMEFEPFQSLVPKAIRGQYSGFVRTLFQQMRDVLGTFDTAQIIKLLPFAAAPPKQSRMQFSSFTVNVRGSGMRILVRGNSPVFNYNKATKRLTVLGKDAGTLTEDPDEGTAGVESAVLRGFLILGKEDRRYGPALSINELSNLAKGEKANVLIGQGDVVLVMKRKRDSSILTDSQTATKRIRMAIN

SEQ ID NO: 5531 - protein, 759 aa, synthetic construct; identical to SEQ ID NO: 5530
  REGION 1..759: note = anti-influenza_Chain

SEQ ID NO: 5532 - protein, 824 aa, synthetic construct
  REGION 1..824: note = anti-influenza_Chain
MMLRKKTKQLISSILILVLLLSLFPAALAAEGNTREDNFKHLLGNDNVKRPSEAGALQLQEVDGQMTLVDQHGEKIQLRGMSTHGLQWFPEILNDNAYKALSNDWDSNMIRLAMYVGENGYATNPELIKQRVIDGIELAIENDMYVIVDWHVHAPGDPRDPVYAGAKDFFREIAALYPNNPHIIYELANEPSSNNNGGAGIPNNEEGWKAVKEYADPIVEMLRKSGNADDNIIIVGSPNWSQRPDLAADNPIDDHHTMYTVHFYTGSHAASTESYPSETPNSERGNVMSNTRYALENGVAVFATEWGTSQASGDGGPYFDEADVWIEFLNENNISWANWSLTNKNEVSGAFTPFELGKSNATNLDPGPDHVWAPEELSLSGEYVRARIKGVNYEPIDRTKYTKVLWDFNDGTKQGFGVNSDSPNKELIAVDNENNTLKVSGLDVSNDVSDGNFWANARLSANGWGKSVDILGAEKLTMDVIVDEPTTVAIAAIPQSSKSGWANPERAVRVNAEDFVQQTDGKYKAGLTITGEDAPNLKNIAFHEEDNNMNNIILFVGTDAADVIYLDNIKVIGTEVEIPVVHDPKGEAVLPSVFEDGTRQGWDWAGESGVKTALTIEEANGSNALSWEFGYPEVKPSDNWATAPRLDFWKSDLVRGENDYVAFDFYLDPVRATEGAMNINLVFQPPTNGYWVQAPKTYTINFDELEEANQVNGLYHYEVKINVRDITNIQDDTLLRNMMIIFADVESDFAGRVFVDNVRFEGAATTEPVEPEPVDPGEETPPVDEKEAKKEQKEAEKEEKEAVKEEKKEAKEEKKAVKNEAKKK

SEQ ID NO: 5533 - protein, 824 aa, synthetic construct; identical to SEQ ID NO: 5532
  REGION 1..824: note = anti-influenza_Chain

SEQ ID NO: 5534 - protein, 1021 aa, synthetic construct
  REGION 1..1021: note = anti-influenza_Chain
MAGPHRSRAAGPPPFAVDEHVALEMVAFRGEVFAGHGLLADQRLIAHTGRPALNAQRITQQKQRDQCRGQRHRHHQGGRNLRKAHRTFHEHQSTQDQAHDAPHGQQAKTGHEGLGHEHAQAQHQQGQSNVVDRQDGEPVEAQHQKDGAQRAGNAPAGRVELEQQPVEAQHQQQEGDVRIGKRRQNAFAPPALDHVHGGPGRLQRHGLAVERHVPAVQQHQQRVQRGRQQIDHVLGHGLPGRQRLAFRDGPRRPVGVASPVLGQRPCPGHRIVQNLFRHGIDPCRVGRCRRSPSELHGMGCADVRARGHGRHMRGQRDEHPGRGRPCARRRHVDDDRDRTPQEKLYDVARGLDEPARRVHFDDEADRSVFRGLAQPAPDEPEGRRRDRLVLQRQSVNHRRGRLSRHRQQHQPQQQRPHGNQAFLGKYEKRRRKPTACLKSLRRFPDKDAPVLYFVNQLEKTKRRMTLLLVWLIFTGVAGEIRLEAEDGELLGVAVDSTLTGYSGRGYVTGFDAPEDSVRFSFEAPRGVYRVVFGVSFSSRFASYALRVDDWHQTGSLIKRGGGFFEASIGEIWLDEGAHTMAFQLMNGALDYVRLEPVSYGPPARPPAQLSDSQATASAQALFAFLLSEYGRHILAGQQQNPYRRDFDAINYVRNVTGKEPALVSFDLIDYSPTREAHGVVHYQTPEDWIAWAGRDGIVSLMWHWNAPTDLIEDPSQDCYWWYGFYTRCTTFDVAAALADTSSERYRLLLRDIDVIAAQLQKFQQADIPVLWRPLHEAAGGWFWWGAKGPEPFKQLWRLLYERLVHHHGLHNLIWVYTHEPGAAEWYPGDAYVDIVGRDVYADDPDALMRSDWNELQTLFGGRKLVALTETGTLPDVEVITDYGIWWSWFSIWTDPFLRDVDPDRLTRVYHSERVLTRDELPDWRSYVLHATTVQPAGDLALAVYPNPGAGRLHVEVGLPVAAPVVVEVFNLLGQRVFQYQAGMQPAGLWRRAFELALAPGVYLVQVRAGNLVARRRWVSVR

SEQ ID NO: 5535 - protein, 1021 aa, synthetic construct; identical to SEQ ID NO: 5534
  REGION 1..1021: note = anti-influenza_Chain

SEQ ID NO: 5536 - protein, 1055 aa, synthetic construct
  REGION 1..1055: note = anti-influenza_Chain
MRKKRRGFLNASTAVLVGILAGFLGVVLAATGALGFAVRESLLLKQFLFLSFEGNTDGASPFGKDVVVTASQDVAADGEYSLKVENRTSVWDGVEIDLTGKVNTGTDYLLSFHVYQTSDSPQLFSVLARTEDEKGERYKILADKVVVPNYWKEILVPFSPTFEGTPAKFSLIITSPKKTDFVFYVDNVQVLTPKEAGPKVVYETSFEKGIGDWQPRGSDVKISISPKVAHSGKKSLFVSNRQKGWHGAQISLKGILKTGKTYAFEAWVYQESGQDQTIIMTMQRKYSSDSSTKYEWIKAATVPSGQWVQLSGTYTIPAGVTVEDLTLYFESQNPTLEFYVDDVKVVDTTSAEIKLEMNPEEEIPALKDVLKDYFRVGVALPSKVFINQKDIALISKHSNSSTAENEMKPDSLLAGIENGKLKFRFETADKYIEFAQQNGMVVRGHTLVWHNQTPEWFFKDENGNLLSKEEMTERLREYIHTVVGHFKGKVYAWDVVNEAVDPNQPDGLRRSTWYQIMGPDYIELAFKFAREADPNAKLFYNDYNTFEPKKRDIIYNLVKSLKEKGLIDGIGMQCHISLATDIRQIEEAIKKFSTIPGIEIHITELDISVYRDSTSNYSEAPRTALIEQAHKMAQLFKIFKKYSNVITNVTFWGLKDDYSWRATRRNDWPLIFDKDYQAKLAYWAIVAPEVLPPLPKESKISEGEAVVVGMMDDSYMMSKPIEIYDEEGNVKATIRAIWKDSTIYVYGEVQDATKKPAEDGVAIFINPNNERTPYLQPDDTYVVLWTNWKSEVNREDVEVKKFVGPGFRRYSFEMSITIPGVEFKKDSYIGFDVAVIDDGKWYSWSDTTNSQKTNTMNYGTLKLEGVMVATAKYGTPVIDGEIDDIWNTTEEIETKSVAMGSLEKNATAKVRVLWDEENLYVLAIVKDPVLNKDNSNPWEQDSVEIFIDENNHKTGYYEDDDAQFRVNYMNEQSFGTGASAARFKTAVKLIEGGYIVEAAIKWKTIKPSPNTVIGFNVQVNDANEKGQRVGIISWSDPTNNSWRDPSKFGNLRLIK

SEQ ID NO: 5537 - protein, 1055 aa, synthetic construct; identical to SEQ ID NO: 5536
  REGION 1..1055: note = anti-influenza_Chain

SEQ ID NO: 5538 - protein, 1059 aa, synthetic construct
  REGION 1..1059: note = anti-influenza_Chain
MQVRKRRGLLDVSTAVLVGILAGFLGVVLAASGVLSFGKEASSKGDSSLETVLALSFEGTTEGVVPFGKDVVLTASQDVAADGEYSLKVENRTSPWDGVEIDLTGKVKSGADYLLSFQVYQSSDAPQLFNVVARTEDEKGERYDVILDKVVVSDHWKEILVPFSPTFEGTPAKYSLIIVASKNTNFNFYLDKVQVLAPKESGPKVIYETSFENGVGDWQPRGDVNIEASSEVAHSGKSSLFISNRQKGWQGAQINLKGILKTGKTYAFEAWVYQNSGQDQTIIMTMQRKYSSDASTQYEWIKSATVPSGQWVQLSGTYTIPAGVTVEDLTLYFESQNPTLEFYVDDVKIVDTTSAEIKIEMEPEKEIPALKEVLKDYFKVGVALPSKVFLNPKDIELITKHFNSITAENEMKPESLLAGIENGKLKFRFETADKYIQFVEENGMVIRGHTLVWHNQTPDWFFKDENGNLLSKEAMTERLKEYIHTVVGHFKGKVYAWDVVNEAVDPNQPDGLRRSTWYQIMGPDYIELAFKFAREADPDAKLFYNDYNTFEPRKRDIIYNLVKDLKEKGLIDGIGMQCHISLATDIKQIEEAIKKFSTIPGIEIHITELDMSVYRDSSSNYPEAPRTALIEQAHKMMQLFEIFKKYSNVITNVTFWGLKDDYSWRATRRNDWPLIFDKDHQAKLAYWAIVAPEVLPPLPKESRISEGEAVVVGMMDDSYLMSKPIEILDEEGNVKATIRAVWKDSTIYIYGEVQDKTKKPAEDGVAIFINPNNERTPYLQPDDTYAVLWTNWKTEVNREDVQVKKFVGPGFRRYSFEMSITIPGVEFKKDSYIGFDAAVIDDGKWYSWSDTTNSQKTNTMNYGTLKLEGIMVATAKYGTPVIDGEIDEIWNTTEEIETKAVAMGSLDKNATAKVRVLWDENYLYVLAIVKDPVLNKDNSNPWEQDSVEIFIDENNHKTGYYEDDDAQFRVNYMNEQTFGTGGSPARFKTAVKLIEGGYIVEAAIKWKTIKPTPNTVIGFNIQVNDANEKGQRVGIISWSDPTNNSWRDPSKFGNLRLIK

SEQ ID NO: 5539 - protein, 1059 aa, synthetic construct; identical to SEQ ID NO: 5538
  REGION 1..1059: note = anti-influenza_Chain

SEQ ID NO: 5540 - protein, 106 aa, synthetic construct
  REGION 1..106: note = anti-OX40_LightChain
EIVVTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 5541 - protein, 107 aa, synthetic construct
  REGION 1..107: note = anti-OX40_LightChain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIK

SEQ ID NO: 5542 - protein, 107 aa, synthetic construct
  REGION 1..107: note = anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIK

SEQ ID NO: 5543 - protein, 107 aa, synthetic construct
  REGION 1..107: note = anti-OX40_LightChain
DIQMTQSPSSLSASVGDRVTITCRASQDISNYLNWYQQKPGKTVKLLIYYTSRLRSGVPSRFSGSGSGTDFTLTISSLQPEDFATYYCQQGHTLPPTFGQGTKVEIK

SEQ ID NO: 5544 - protein, 107 aa, synthetic construct
  REGION 1..107: note = anti-OX40_LightChain
DIQMTQSPSSLSASVGDRVTITCRASQDISNYLNWYQQKPGKTVKLLIYYTSRLRSGVPSRFSGSGSGKDYTLTISSLQPEDFATYFCQQGHTLPPTFGQGTKVEIK

SEQ ID NO: 5545 - protein, 107 aa, synthetic construct
  REGION 1..107: note = anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPATFGQGTKVEIK

SEQ ID NO: 5546 - protein, 107 aa, synthetic construct
  REGION 1..107: note = anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQQGHTAPPTFGQGTKVEIK

SEQ ID NO: 5547 - protein, 107 aa, synthetic construct
  REGION 1..107: note = anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQQGATLPPTFGQGTKVEIK

SEQ ID NO: 5548 - protein, 107 aa, synthetic construct
  REGION 1..107: note = anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQQGHALPPTFGQGTKVEIK

SEQ ID NO: 5549 - protein, 107 aa, synthetic construct
  REGION 1..107: note = anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQQAHTLPPTFGQGTKVEIK

SEQ ID NO: 5550 - protein, 107 aa, synthetic construct
  REGION 1..107: note = anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQQGHTLAPTFGQGTKVEIK

SEQ ID NO: 5551 - protein, 107 aa, synthetic construct
  REGION 1..107: note = anti-OX40_LightChain
DIQMTQSPSSLSASVGDRVTITCRASQDISNYLNWYQQKPGKAPKLLIYYTSRLRSGVPSRFSGSGSGTDFTLTISSLQPEDFATYYCQAGHTLPPTFGQGTKVEIK

SEQ ID NO: 5552 - protein, 107 aa, synthetic construct
  REGION 1..107: note = anti-OX40_LightChain
DIQMTQSPSSLSASVGDRVTITCRASQDISNYLNWYQQKPGKAPKLLIYYTSKLHSGVPSRFSGSGSGTDYTLTISSLQPEDFATYYCQQGSALPWTFGQGTKVEIK

SEQ ID NO: 5553 - protein, 107 aa, synthetic construct
  REGION 1..107: note = anti-OX40_LightChain
DIQMTQSPSSLSASVGDRVTITCRASQDISNYLNWYQQKPGKAVKLLIYYTSKLHSGVPSRFSGSGSRTDYTLTISSLQPEDFATYYCQQGSALPWTFGQGTKVEIK

SEQ ID NO: 5554 - protein, 117 aa, synthetic construct
  REGION 1..117: note = anti-OX40_HeavyChain
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSS

SEQ ID NO: 5555 - protein, 117 aa, synthetic construct
  REGION 1..117: note = anti-OX40_HeavyChain
EVQLVQSGAEVKKPGASVKVSCKASGYTFTDSYMSWVRQAPGQGLEWIGDMYPDNGDSSYNQKFRERVTITVDTSTSTAYLELSSLRSEDTAVYYCVLAPRWYFSVWGQGTLVTVSS

SEQ ID NO: 5556 - protein, 117 aa, synthetic construct
  REGION 1..117: note = anti-OX40_HeavyChain
EVQLVQSGAEVKKPGASVKVSCKASGYTFTDSYMSWVRQAPGQGLEWIGDMYPDNGDSSYNQKFRERVTLTVDTSTSTAYLELSSLRSEDTAVYYCVLAPRWYFSVWGQGTLVTVSS

SEQ ID NO: 5557 - protein, 117 aa, synthetic construct
  REGION 1..117: note = anti-OX40_HeavyChain
EVQLVQSGAEVKKPGASVKVSCKASGYTFTDAYMSWVRQAPGQGLEWIGDMYPDNGDSSYNQKFRERVTITRDTSTSTAYLELSSLRSEDTAVYYCVLAPRWYFSVWGQGTLVTVSS

SEQ ID NO: 5558 - protein, 117 aa, synthetic construct
  REGION 1..117: note = anti-OX40_HeavyChain
EVQLVQSGAEVKKPGASVKVSCKASGYTFTESYMSWVRQAPGQGLEWIGDMYPDNGDSSYNQKFRERVTITRDTSTSTAYLELSSLRSEDTAVYYCVLAPRWYFSVWGQGTLVTVSS

SEQ ID NO: 5559 - protein, 117 aa, synthetic construct
  REGION 1..117: note = anti-OX40_HeavyChain
EVQLVQSGAEVKKPGASVKVSCKASGYTFTDSYMSWVRQAPGQGLEWIGDMYPDNADSSYNQKFRERVTITRDTSTSTAYLELSSLRSEDTAVYYCVLAPRWYFSVWGQGTLVTVSS

SEQ ID NO: 5560 - protein, 117 aa, synthetic construct
  REGION 1..117: note = anti-OX40_HeavyChain
EVQLVQSGAEVKKPGASVKVSCKASGYTFTDSYMSWVRQAPGQGLEWIGDMYPDNADASYNQKFRERVTITRDTSTSTAYLELSSLRSEDTAVYYCVLAPRWYFSVWGQGTLVTVSS

SEQ ID NO: 5561 - protein, 117 aa, synthetic construct
  REGION 1..117: note = anti-OX40_HeavyChain
EVQLVQSGAEVKKPGASVKVSCKASGYTFTDSYMSWVRQAPGQGLEWIGDMYPDNGDASYNQKFRERVTITRDTSTSTAYLELSSLRSEDTAVYYCVLAPRWYFSVWGQGTLVTVSS

SEQ ID NO: 5562 - protein, 117 aa, synthetic construct
  REGION 1..117: note = anti-OX40_HeavyChain
EVQLVQSGAEVKKPGASVKVSCKASGYTFTDSYMSWVRQAPGQGLEWIGDMYPDSGDSSYNQKFRERVTITRDTSTSTAYLELSSLRSEDTAVYYCVLAPRWYFSVWGQGTLVTVSS

SEQ ID NO: 5563 - protein, 117 aa, synthetic construct
  REGION 1..117: note = anti-OX40_HeavyChain
EVQLVQSGAEVKKPGASVKVSCKASGYTFTDSYMSWVRQAPGQGLEWIGDMYPDNGSSSYNQKFRERVTITRDTSTSTAYLELSSLRSEDTAVYYCVLAPRWYFSVWGQGTLVTVSS

SEQ ID NO: 5564 - protein, 117 aa, synthetic construct
  REGION 1..117: note = anti-OX40_HeavyChain
EVQLVQSGAEVKKPGASVKVSCKASGYTFTDAYMSWVRQAPGQGLEWIGDMYPDNADASYNQKFRERVTITRDTSTSTAYLELSSLRSEDTAVYYCVLAPRWYFSVWGQGTLVTVSS

SEQ ID NO: 5565 - protein, 117 aa, synthetic construct
  REGION 1..117: note = anti-OX40_HeavyChain
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSAWGQGTLVTVSS

SEQ ID NO: 5566 - protein, 117 aa, synthetic construct
  REGION 1..117: note = anti-OX40_HeavyChain
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFAVWGQGTLVTVSS

SEQ ID NO: 5567 - protein, 117 aa, synthetic construct
  REGION 1..117: note = anti-OX40_HeavyChain
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCALAPRWYFSVWGQGTLVTVSS

SEQ ID NO: 5568 - protein, 117 aa, synthetic construct
  REGION 1..117: note = anti-OX40_HeavyChain
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVAAPRWYFSVWGQGTLVTVSS

SEQ ID NO: 5569 - protein, 118 aa, synthetic construct
  REGION 1..118: note = anti-OX40_HeavyChain
EVQLVESGGGLVQPGGSLRLSCAASGFTFSSYSMNWVRQAPGKGLEWVSYISSSSSTIDYADSVKGRFTISRDNAKNSLYLQMNSLRDEDTAVYYCARESGWYLFDYWGQGTLVTVSS

SEQ ID NO: 5570 - protein, 121 aa, synthetic construct
  REGION 1..121: note = anti-OX40_HeavyChain
QVQLQESGPGLVKPSQTLSLTCAVYGGSFSSGYWNWIRQHPGKGLEWIGYISYNGITYHNPSLKSRITINPDTSKNQFSLQLNSVTPEDTAVYYCARYRYDYDGGHAMDYWGQGTLVTVSS

SEQ ID NO: 5571 - protein, 121 aa, synthetic construct
  REGION 1..121: note = anti-OX40_HeavyChain
QVQLQESGPGLVKPSQTLSLTCAVYGGSFSSGYWNWIRKHPGKGLEWIGYISYNGITYHNPSLKSRITINRDTSKNQFSLQLNSVTPEDTAVYYCARYRYDYDGGHAMDYWGQGTLVTVSS

SEQ ID NO: 5572 - protein, 121 aa, synthetic construct
  REGION 1..121: note = anti-OX40_HeavyChain
QVQLQESGPGLVKPSQTLSLTCAVYGDSFSSGYWNWIRKHPGKGLEYMGYISYNGITYHNPSLKSRITINRDTSKNQYSLQLNSVTPEDTAVYFCARYRYDYDGGHAMDYWGQGTLVTVSS

SEQ ID NO: 5573 - protein, 121 aa, synthetic construct
  REGION 1..121: note = anti-OX40_HeavyChain
QVQLQESGPGLVKPSQTLSLTCAVYGDSFSSGYWNWIRKHPGKGLEYIGYISYNGITYHNPSLKSRITINRDTSKNQYSLQLNSVTPEDTAVYFCARYRYDYDGGHAMDYWGQGTLVTVSS

SEQ ID NO: 5574 - protein, 121 aa, synthetic construct
  REGION 1..121: note = anti-OX40_HeavyChain
QVQLQESGPGLVKPSQTLSLTCAVYGDSFSSGYWNWIRKHPGKGLEYIGYISYNGITYHNPSLKSRITINRDTSKNQFSLQLNSVTPEDTAVYFCARYRYDYDGGHAMDYWGQGTLVTVSS

SEQ ID NO: 5575 - protein, 121 aa, synthetic construct
  REGION 1..121: note = anti-OX40_HeavyChain
QVQLQESGPGLVKPSQTLSLTCAVYGDSFSSGYWNWIRKHPGKGLEYIGYISYNGITYHNPSLKSRITINRDTSKNQYSLQLNSVTPEDTAVYYCARYRYDYDGGHAMDYWGQGTLVTVSS

SEQ ID NO: 5576 - protein, 121 aa, synthetic construct
  REGION 1..121: note = anti-OX40_HeavyChain
QVQLQESGPGLVKPSQTLSLTCAVYGDSFSSGYWNWIRKHPGKGLEYIGYISYNGITYHNPSLKSRITINRDTSKNQFSLQLNSVTPEDTAVYYCARYRYDYDGGHAMDYWGQGTLVTVSS

SEQ ID NO: 5577 - protein, 121 aa, synthetic construct
  REGION 1..121: note = anti-OX40_HeavyChain
QVQLQESGPGLVKPSQTLSLTCAVYGGSFSSGYWNWIRKHPGKGLEYIGYISYNGITYHNPSLKSRITINPDTSKNQYSLQLNSVTPEDTAVYFCARYRYDYDGGHAMDYWGQGTLVTVSS

SEQ ID NO: 5578 - protein, 121 aa, synthetic construct
  REGION 1..121: note = anti-OX40_HeavyChain
QVQLQESGPGLVKPSQTLSLTCAVYGGSFSSGYWNWIRKHPGKGLEYIGYISYNGITYHNPSLKSRITINRDTSKNQYSLQLNSVTPEDTAVYFCARYRYDYDGGHAMDYWGQGTLVTVSS

SEQ ID NO: 5579 - protein, 121 aa, synthetic construct
  REGION 1..121: note = anti-OX40_HeavyChain
QVQLQESGPGLVKPSQTLSLTCAVYGGSFSSGYWNWIRKHPGKGLEYIGYISYNGITYHNPSLKSRITINRDTSKNQYSLQLNSVTPEDTAVYYCARYRYDYDGGHAMDYWGQGTLVTVSS

SEQ ID NO: 5580 - protein, 121 aa, synthetic construct
  REGION 1..121: note = anti-OX40_HeavyChain
QVQLQESGPGLVKPSQTLSLTCAVYGGSFSSGYWNWIRKHPGKGLEYIGYISYNGITYHNPSLKSRITINPDTSKNQYSLQLNSVTPEDTAVYYCARYRYDYDGGHAMDYWGQGTLVTVSS

SEQ ID NO: 5581 - protein, 121 aa, synthetic construct
  REGION 1..121: note = anti-OX40_HeavyChain
QVQLQESGPGLVKPSQTLSLTCAVYGGSFSSGYWNWIRKHPGKGLEYIGYISYNAITYHNPSLKSRITINRDTSKNQYSLQLNSVTPEDTAVYYCARYKYDYDAGHAMDYWGQGTLVTVSS

SEQ ID NO: 5582 - protein, 121 aa, synthetic construct
  REGION 1..121: note = anti-OX40_HeavyChain
QVQLQESGPGLVKPSQTLSLTCAVYGGSFSSGYWNWIRKHPGKGLEYIGYISYNAITYHNPSLKSRITINRDTSKNQYSLQLNSVTPEDTAVYYCARYRYDYDGGHAMDYWGQGTLVTVSS

SEQ ID NO: 5583 - protein, 121 aa, synthetic construct
  REGION 1..121: note = anti-OX40_HeavyChain
QVQLQESGPGLVKPSQTLSLTCAVYGGSFSSGYWNWIRKHPGKGLEYIGYISYNGITYHNPSLKSRITINRDTSKNQYSLQLNSVTPEDTAVYYCARYKYDYDGGHAMDYWGQGTLVTVSS

SEQ ID NO: 5584 - protein, 121 aa, synthetic construct
  REGION 1..121: note = anti-OX40_HeavyChain
QVQLQESGPGLVKPSQTLSLTCAVYGGSFSSGYWNWIRKHPGKGLEYIGYISYSGITYHNPSLKSRITINRDTSKNQYSLQLNSVTPEDTAVYYCARYRYDYDGGHAMDYWGQGTLVTVSS

SEQ ID NO: 5585 - protein, 121 aa, synthetic construct
  REGION 1..121: note = anti-OX40_HeavyChain
QVQLQESGPGLVKPSQTLSLTCAVYGGSFSSGYWNWIRKHPGKGLEYIGYISYSGITYHNPSLKSRITINRDTSKNQYSLQLNSVTPEDTAVYYCARYKYDYDGGHAMDYWGQGTLVTVSS

SEQ ID NO: 5586 - protein, 121 aa, synthetic construct
  REGION 1..121: note = anti-OX40_HeavyChain
EVQLQESGPSLVKPSQTLSLTCSVTGDSFTSGYWNWIRKFPGNRLEYMGYISYNAITYHNPSLKSRISITRDTSKNHYYLQLNSVTTEDTATYFCARYRYDYDGGHAMDYWGQGTLVTVSS

SEQ ID NO: 5587 - protein, 121 aa, synthetic construct
  REGION 1..121: note = anti-OX40_HeavyChain
QVQLQESGPGLVKPSQTLSLTCAVYGGSFSSGYWNWIRKHPGKGLEYIGYISYNAITYHNPSLKSRITINRDTSKNQYSLQLNSVTPEDTAVYYCARYKYDYDGGHAMDYWGQGTLVTVSS

SEQ ID NO: 5588 - protein, 124 aa, synthetic construct
  REGION 1..124: note = anti-OX40_HeavyChain
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDQSTADYYFYYGMDVWGQGTTVTVSS

SEQ ID NO: 5589 - protein, 127 aa, synthetic construct
  REGION 1..127: note = anti-OX40_LightChain
METPAQLLFLLLLWLPDTTGEIVLTQSPGTLSLSPGERAILSCRASQSVSSSFLAWYQQKPGQAPRLLIYGAFSRATGIPDRFSGSGSGTDFTLTISRLEPEDFAVYYCQQYDSSRTFGQGTKVEIK

SEQ ID NO: 5590 - protein, 127 aa, synthetic construct
  REGION 1..127: note = anti-OX40_LightChain
MEAPAQLLFLLLLWLPDTTGEIVLTQSPATLSLSPGERATLSCRASQGVSSYLAWYQQKPGQAPRLLIYDASNRATGIPARFSGSGPGTDFTLTISSLEPEDFAVYYCQQRSNWHPTFGQGTKVEIK

SEQ ID NO: 5591 - protein, 127 aa, synthetic construct
  REGION 1..127: note = anti-OX40_LightChain
MEAPAQLLFLLLLWLPDTTGEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 5592 - protein, 129 aa, synthetic construct
  REGION 1..129: note = anti-OX40_LightChain
METPAQLLFLLLLWLPDTTGEIVLTQSPGTLSLSPGERATLSCRASQSVSSSYLAWYQQKPGQAPRLLIYGASSRATGIPDRFSGSGSGTDFTLTISRLEPEDFAVYYCQQYDSSLTFGGGTKVEIKRT

SEQ ID NO: 5593 - protein, 130 aa, synthetic construct
  REGION 1..130: note = anti-OX40_LightChain
MDMRVLAQLLGLLLLCFPGARCDIQMTQSPSSLSASVGNRVTITCRASQDISSWLAWYQQKPEKAPKSLIYAASSLQSGVPSRFSGSGSGTDFTLTISSLQPEDFATYYCQQYNSYPLTFGQGTRLEIKR

SEQ ID NO: 5594 - protein, 136 aa, synthetic construct
  REGION 1..136: note = anti-OX40_HeavyChain
MDTLCSTLLLLTIPSWVLSQITLKESGPTLVKPTQTLTLSCTFSGFSLSTSGVGVGWIRQPPGKALEWLALIHWDDAERYSPSLKSRLTITKDTSKNQVVLTMTNMDLVDTATYYCAHTRGAFDIWGQGTMVTVSS

SEQ ID NO: 5595 - protein, 136 aa, synthetic construct
  REGION 1..136: note = anti-OX40_HeavyChain
MDTLCSTLLLLTIPSWVLSQITLKESGPTLVKPTQTLTLTCTFSGFSLSTSGVGVGWIRQPPGKALEWLALIYWDDHSPYSPSLKSRLTITKDTSKNQVVLTMTNMDPVDTATYYCARTRGAFDIWGQGTMVTVSS

SEQ ID NO: 5596 - protein, 140 aa, synthetic construct
  REGION 1..140: note = anti-OX40_HeavyChain
MEWGPCWVFLVVILEGVQCGVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARGVYHNGWSFFDYWGQGTLLTVSS

SEQ ID NO: 5597 - protein, 141 aa, synthetic construct
  REGION 1..141: note = anti-OX40_HeavyChain
MDTLCSTLLLLTIPSWVLSQITLKESGPTLVKPKQTLTLTCTFSGFSLSTSGMGVGWIRQPPGKALEWLAVIYWDDHQLYSPSLKSRLTITKDTSKNQVVLTMTNMDPVDTATYYCAHRRGAFQHWGQGTLVTVSSASTKG

SEQ ID NO: 5598 - protein, 154 aa, synthetic construct
  REGION 1..154: note = anti-OX40_HeavyChain
MTMITPSLVPSSDPLVTAASVLEFALLIRLTIGQAVVSTQSTGGGLVQPGRSLRLSCAASGFTLDDYGMHWVRQAPGKGLEWVSGISWNSDSIGYVDSVKGRFTISRDNAKNSLYLQMNSLRVEDTALYYCVKDISGWYSFDYWGQGTLVTVSS

SEQ ID NO: 5599 - protein, 213 aa, synthetic construct
  REGION 1..213: note = anti-OX40_LightChain
EIVVTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5600 - protein, 450 aa, synthetic construct
  REGION 1..450: note = anti-OX40_HeavyChain
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDQSTADYYFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 5601 - protein, 7 aa, synthetic construct
  REGION 1..7: note = anti-HIV_VRC01_VRC02_NIH45-46_LightChain_CDR
CQQYEFF

SEQ ID NO: 5602 - protein, 14 aa, synthetic construct
  REGION 1..14: note = anti-HIV_VRC01_HeavyChain_CDR
TRGKNCDYNWDFEH

SEQ ID NO: 5603 - protein, 7 aa, synthetic construct
  REGION 1..7: note = anti-HIV_3BNC60_LightChain_CDR
CQVYEFI

SEQ ID NO: 5604 - protein, 12 aa, synthetic construct
  REGION 1..12: note = anti-HIV_3BNC60_HeavyChain_CDR
ARQRSDFWDFDV

SEQ ID NO: 5605 - protein, 12 aa, synthetic construct
  REGION 1..12: note = anti-HIV_5H/I1-BMV-D5_HeavyChain_CDR
ARDNPTLLGSDY

SEQ ID NO: 5606 - protein, 11 aa, synthetic construct
  REGION 1..11: note = anti-HIV_8ANC195_LightChain_CDR
CQQYDTYPGTF

SEQ ID NO: 5607 - protein, 11 aa, synthetic construct [sequence omitted]

SEQ ID NO: 5608 - protein, 26 aa, synthetic construct
  REGION 1..26: note = anti-HIV_CH01_HeavyChain_CDR
ARGTDYTIDDAGIHYQGSGTFWYFDL

SEQ ID NO: 5609 - protein, 26 aa, synthetic construct
  REGION 1..26: note = anti-HIV_CH02_HeavyChain_CDR
ARGTDYTIDDQGRFYQGSGTFWYFDF

SEQ ID NO: 5610 - protein, 26 aa, synthetic construct
  REGION 1..26: note = anti-HIV_CH03_HeavyChain_CDR
ARGTDYTIDDQGIFYKGSGTFWYFDL

SEQ ID NO: 5611 - protein, 11 aa, synthetic construct [sequence omitted]

SEQ ID NO: 5612 - protein, 26 aa, synthetic construct
  REGION 1..26: note = anti-HIV_CH04_HeavyChain_CDR
ARGTDYTIDDQGIRYQGSGTFWYFDV

SEQ ID NO: 5613 - protein, 18 aa, synthetic construct
  REGION 1..18: note = anti-HIV_NIH45-46_HeavyChain_CDR
TRGKYCTARDYYNWDFEH

SEQ ID NO: 5614 - protein, 30 aa, synthetic construct
  REGION 1..30: note = anti-HIV_PG16_HeavyChain_CDR
AREAGGPIWHDDVKYYDFNDGYYNYHYMDV

SEQ ID NO: 5615 - protein, 12 aa, synthetic construct
  REGION 1..12: note = anti-HIV_PGT122_LightChain_CDR
HIWDSRRPTNWV

SEQ ID NO: 5616 - protein, 24 aa, synthetic construct
  REGION 1..24: note = anti-HIV_PGT122_HeavyChain_CDR
TKHGRRIYGVVAFKEWFTYFYMDV

SEQ ID NO: 5617 - protein, 12 aa, synthetic construct
  REGION 1..12: note = anti-HIV_PGT123_LightChain_CDR
HIYDARGGTNWV

SEQ ID NO: 5618 - protein, 24 aa, synthetic construct
  REGION 1..24: note = anti-HIV_PGT123_HeavyChain_CDR
ALHGKRIYGIVALGELFTYFYMDV

SEQ ID NO: 5619 - protein, 10 aa, synthetic construct
  REGION 1..10: note = anti-HIV_PGT125_PGT128_LightChain_CDR
GSLVGNWDVI

SEQ ID NO: 5620 - protein, 19 aa, synthetic construct
  REGION 1..19: note = anti-HIV_PGT125_HeavyChain_CDR
FDGEVLVYNHWPKPAWVDL

SEQ ID NO: 5621 - protein, 10 aa, synthetic construct
  REGION 1..10: note = anti-HIV_PGT126_PGT127_LightChain_CDR
SSLVGNWDVI

SEQ ID NO: 5622 - protein, 19 aa, synthetic construct
  REGION 1..19: note = anti-HIV_PGT126_HeavyChain_CDR
FDGEVLVYHDWPKPAWVDL

SEQ ID NO: 5623 - protein, 19 aa, synthetic construct
  REGION 1..19: note = anti-HIV_PGT127_HeavyChain_CDR
FGGEVLVYRDWPKPAWVDL

SEQ ID NO: 5624 - protein, 19 aa, synthetic construct
  REGION 1..19: note = anti-HIV_PGT128_HeavyChain_CDR
FGGEVLRYTDWPKPAWVDL

SEQ ID NO: 5625 - protein, 10 aa, synthetic construct
  REGION 1..10: note = anti-HIV_PGT130_LightChain_CDR
SSLFGRWDVV

SEQ ID NO: 5626 - protein, 19 aa, synthetic construct
  REGION 1..19: note = anti-HIV_PGT130_HeavyChain_CDR
SGGDILYYYEWQKPHWFSP

SEQ ID NO: 5627 - protein, 10 aa, synthetic construct
  REGION 1..10: note = anti-HIV_PGT131_LightChain_CDR
SSLSGRWDIV

SEQ ID NO: 5628 - protein, 19 aa, synthetic construct
  REGION 1..19: note = anti-HIV_PGT131_HeavyChain_CDR
SGGDILYYIEWQKPHWFYP

SEQ ID NO: 5629 - protein, 9 aa, synthetic construct
  REGION 1..9: note = anti-HIV_PGT135_PGT136_PGT137_LightChain_CDR
QQYEEWPRT

SEQ ID NO: 5630 - protein, 18 aa, synthetic construct
  REGION 1..18: note = anti-HIV_PGT135_HeavyChain_CDR
HRHHDVFMLVPIAGWFDV

SEQ ID NO: 5631 - protein, 18 aa, synthetic construct
  REGION 1..18: note = anti-HIV_PGT136_HeavyChain_CDR
HKYHDIFRVVPVAGWFDP

SEQ ID NO: 5632 - protein, 18 aa, synthetic construct
  REGION 1..18: note = anti-HIV_PGT137_HeavyChain_CDR
HKYHDIVMVVPIAGWFDP

SEQ ID NO: 5633 - protein, 9 aa, synthetic construct
  REGION 1..9: note = anti-HIV_PGT141_PGT142_PGT143_PGT144_LightChain_CDR
MQGLNRPWT

SEQ ID NO: 5634 - protein, 32 aa, synthetic construct
  REGION 1..32: note = anti-HIV_PGT141_HeavyChain_CDR
GSKHRLRDYVLYDDYGLINYQEWNDYLEFLDV

SEQ ID NO: 5635 - protein, 32 aa, synthetic construct
  REGION 1..32: note = anti-HIV_PGT144_HeavyChain_CDR
GSKHRLRDYVLYDDYGLINQQEWNDYLEFLDV

SEQ ID NO: 5636 - protein, 9 aa, synthetic construct
  REGION 1..9: note = anti-HIV_PGT145_LightChain_CDR
MQGLHSPWT

SEQ ID NO: 5637 - protein, 31 aa, synthetic construct
  REGION 1..31: note = anti-HIV_PGT145_HeavyChain_CDR
GSKHRLRDYFLYNEYGPNYEEWGDYLATLDV

SEQ ID NO: 5638 - protein, 7 aa, synthetic construct [sequence omitted]

SEQ ID NO: 5639 - protein, 15 aa, synthetic construct
  REGION 1..15: note anti-HIV_VRC-CH30_VRC-CH31_VRC-CH32_VRC-CH34_HeavyChain_CDR
ARAQKRGRSEWAYAH

SEQ ID NO: 5640 - protein, 15 aa, synthetic construct
  REGION 1..15: note = anti-HIV_VRC-CH33_HeavyChain_CDR
ARAQKRARSEWAYAH

SEQ ID NO: 5641 - protein, 7 aa, synthetic construct
  REGION 1..7: note = anti-HIV_VRC-PG04_LightChain_CDR
CQQLEFF

SEQ ID NO: 5642 - protein, 16 aa, synthetic construct
  REGION 1..16: note = anti-HIV_VRC-PG04_HeavyChain_CDR
ARQKFYTGGQGWYFDL

SEQ ID NO: 5643 - protein, 7 aa, synthetic construct
  REGION 1..7: note = anti-HIV_VRC-PG04b_LightChain_CDR
CQQVEFF

SEQ ID NO: 5644 - protein, 16 aa, synthetic construct
  REGION 1..16: note = anti-HIV_VRC-PG04b_HeavyChain_CDR
ARQKFERGGQGWYFDL

SEQ ID NO: 5645 - protein, 7 aa, synthetic construct
  REGION 1..7: note = anti-HIV_VRC03_LightChain_CDR
CQQFEFF

SEQ ID NO: 5646 - protein, 16 aa, synthetic construct
  REGION 1..16: note = anti-HIV_VRC03_HeavyChain_CDR
VRRGSCDYCGDFPWQY

SEQ ID NO: 5647 - protein, 7 aa, synthetic construct
  REGION 1..7: note = anti-HIV_1TJG_P-Chain
ELDKWAS

SEQ ID NO: 5648 - protein, 23 aa, synthetic construct
  REGION 1..23: note = anti-HIV_2B1H_P-Chain
NNTKKSIKIRPRQAFYATNGIIG

SEQ ID NO: 5649 - protein, 23 aa, synthetic construct
  REGION 1..23: note = anti-HIV_2B1A_P-Chain
NNTRKSIHLGPGRAFYATGDIIG

SEQ ID NO: 5650 - protein, 19 aa, synthetic construct
  REGION 1..19: note = anti-HIV_2B0S_P-Chain
KRKRIHIGPGRAFYTTKNA

SEQ ID NO: 5651 - protein, 23 aa, synthetic construct
  REGION 1..23: note = anti-HIV_3UJJ_P-Chain
NNTRKSIRIGPGQAFYATGDIIG

SEQ ID NO: 5652 - protein, 23 aa, synthetic construct
  REGION 1..23: note = anti-HIV_3UJI_P-Chain
YNKRKRIHIGPGRAFYTTKNIIG

SEQ ID NO: 5653 - protein, 25 aa, synthetic construct
  REGION 1..25: note = anti-HIV_3MLZ_P-Chain
SNNTRKGIHIGPGRAFYATGQITGD

SEQ ID NO: 5654 - protein, 20 aa, synthetic construct
  REGION 1..20: note = anti-HIV_3MLV_Q-Chain
NNTRKRIRVGPGQTVYATNA

SEQ ID NO: 5655 - protein, 23 aa, synthetic construct
  REGION 1..23: note = anti-HIV_3MLU_P-Chain
NNTRKSIRIGPGQAFYATGGIIG

SEQ ID NO: 5656 - protein, 20 aa, synthetic construct
  REGION 1..20: note = anti-HIV_3MLR_P-Chain
NNTKKGIAIGPGRTLYAREK

SEQ ID NO: 5657 - protein, 16 aa, synthetic construct
  REGION 1..16: note = anti-HIV_4XCF_P-Chain
NWWDITNWLWYIKKKK

SEQ ID NO: 5658 - protein, 15 aa, synthetic construct
  REGION 1..15: note = anti-HIV_4XBE_P-Chain
NWFDITNWLWYIKKK

SEQ ID NO: 5659 - protein, 16 aa, synthetic construct
  REGION 1..16: note = anti-HIV_4XAW_P-Chain
NWFDITNWLWYIKKKK

SEQ ID NO: 5660 - protein, 15 aa, synthetic construct
  REGION 1..15: note = anti-HIV_2QSC_P-Chain
RKRIHIGPGRAFYTT

SEQ ID NO: 5661 - protein, 20 aa, synthetic construct
  REGION 1..20: note = anti-HIV_3MLS_S-Chain
ACQAFYASSPRKSIHIGACA

SEQ ID NO: 5662 - protein, 14 aa, synthetic construct
  REGION 1..14: note = anti-HIV_3GO1_P-Chain
RKRIHIGPGRAFYT

SEQ ID NO: 5663 - protein, 14 aa, synthetic construct
  REGION 1..14: note = anti-HIV_4M1D_Q-Chain
CRIHIGPGRAFYTC

SEQ ID NO: 5664 - protein, 13 aa, synthetic construct
  REGION 1..13: note = anti-HIV_3C2A_Q-Chain
KSIHLGPGRAFYA

SEQ ID NO: 5665 - protein, 4 aa, synthetic construct
  REGION 1..4: note = anti-HIV_CDR
QSKT

SEQ ID NO: 5666 - protein, 4 aa, synthetic construct
  REGION 1..4: note = anti-HIV_CDR
DLID

SEQ ID NO: 5667 - protein, 5 aa, synthetic construct
  REGION 1..5: note = anti-HIV_CDR
DHYWS

SEQ ID NO: 5668 - protein, 5 aa, synthetic construct
  REGION 1..5: note = anti-HIV_CDR
GRFWS

SEQ ID NO: 5669 - protein, 5 aa, synthetic construct
  REGION 1..5: note = anti-HIV_CDR
NYYWT

SEQ ID NO: 5670 - protein, 5 aa, synthetic construct
  REGION 1..5: note = anti-HIV_CDR
DAYWS

SEQ ID NO: 5671 - protein, 5 aa, synthetic construct
  REGION 1..5: note = anti-HIV_CDR
DSYWS

SEQ ID NO: 5672 - protein, 5 aa, synthetic construct
  REGION 1..5: note = anti-HIV_CDR
DNYWS

SEQ ID NO: 5673 - protein, 5 aa, synthetic construct
  REGION 1..5: note = anti-HIV_CDR
NSYWT

SEQ ID NO: 5674 - protein, 5 aa, synthetic construct
  REGION 1..5: note = anti-HIV_CDR
SYYWS

SEQ ID NO: 5675 - protein, 5 aa, synthetic construct
  REGION 1..5: note = anti-HIV_CDR
SFGMH

SEQ ID NO: 5676 - protein, 5 aa, synthetic construct
  REGION 1..5: note = anti-HIV_CDR
AAFQW

SEQ ID NO: 5677 - protein, 5 aa, synthetic construct
  REGION 1..5: note = anti-HIV_CDR
QQLRT

SEQ ID NO: 5678 - protein, 5 aa, synthetic construct
  REGION 1..5: note = anti-HIV_CDR
QQYDS

SEQ ID NO: 5679 - protein, 5 aa, synthetic construct
  REGION 1..5: note = anti-HIV_CDR
QQLAT

SEQ ID NO: 5680 - protein, 5 aa, synthetic construct
  REGION 1..5: note = anti-HIV_CDR
ESFQW

SEQ ID NO: 5681 - protein, 5 aa, synthetic construct
  REGION 1..5: note = anti-HIV_CDR
EVYEF

SEQ ID NO: 5682 - protein, 5 aa, synthetic construct
  REGION 1..5: note = anti-HIV_CDR
ASLEF

SEQ ID NO: 5683 - protein, 5 aa, synthetic construct
  REGION 1..5: note = anti-HIV_CDR
SVYEF

SEQ ID NO: 5684 - protein, 5 aa, synthetic construct
  REGION 1..5: note = anti-HIV_CDR
AALEF

SEQ ID NO: 5685 - protein, 5 aa, synthetic construct
  REGION 1..5: note = anti-HIV_CDR
AVVEF

SEQ ID NO: 5686 - protein, 5 aa, synthetic construct
  REGION 1..5: note = anti-HIV_CDR
QLFEF

SEQ ID NO: 5687 - protein, 5 aa, synthetic construct
  REGION 1..5: note = anti-HIV_CDR
AVFQW

SEQ ID NO: 5688 - protein, 5 aa, synthetic construct
  REGION 1..5: note = anti-HIV_CDR
AVLEF

SEQ ID NO: 5689 - protein, 5 aa, synthetic construct
  REGION 1..5: note = anti-HIV_CDR
NGFDV

SEQ ID NO: 5690 - protein, 5 aa, synthetic construct
  REGION 1..5: note = anti-HIV_CDR
QQYEF

SEQ ID NO: 5691 - protein, 5 aa, synthetic construct
  REGION 1..5: note = anti-HIV_CDR
QHYEF

SEQ ID NO: 5692 - protein, 5 aa, synthetic construct
  REGION 1..5: note = anti-HIV_CDR
QVYEV

SEQ ID NO: 5693 - protein, 5 aa, synthetic construct
  REGION 1..5: note = anti-HIV_CDR
QVYEF

SEQ ID NO: 5694 - protein, 5 aa, synthetic construct
  REGION 1..5: note = anti-HIV_CDR
FSKES

SEQ ID NO: 5695 - protein, 5 aa, synthetic construct
  REGION 1..5: note = anti-HIV_CDR
LKLSS

SEQ ID NO: 5696 - protein, 5 aa, synthetic construct
  REGION 1..5: note = anti-HIV_CDR
YKVSS

SEQ ID NO: 5697 - protein, 5 aa, synthetic construct
  REGION 1..5: note = anti-HIV_CDR
PPQES

SEQ ID NO: 5698 - protein, 5 aa, synthetic construct
  REGION 1..5: note = anti-HIV_CDR
TARDY

SEQ ID NO: 5699 - protein, 5 aa, synthetic construct
  REGION 1..5: note = anti-HIV_CDR
MQSIQ

SEQ ID NO: 5700 - protein, 5 aa, synthetic construct
  REGION 1..5: note = anti-HIV_CDR
HQLDT

SEQ ID NO: 5701 - protein, 5 aa, synthetic construct
  REGION 1..5: note = anti-HIV_CDR
HQLDS

SEQ ID NO: 5702 - protein, 5 aa, synthetic construct
  REGION 1..5: note = anti-HIV_CDR
QQLGT

SEQ ID NO: 5703 - protein, 5 aa, synthetic construct
  REGION 1..5: note = anti-HIV_CDR
QKATT

SEQ ID NO: 5704 - protein, 5 aa, synthetic construct
  REGION 1..5: note = anti-HIV_CDR
LFAGT

SEQ ID NO: 5705 - protein, 6 aa, synthetic construct
  REGION 1..6: note = anti-HIV_CDR
VRGSSP

SEQ ID NO: 5706 - protein, 6 aa, synthetic construct
  REGION 1..6: note = anti-HIV_CDR
GLLFVV

SEQ ID NO: 5707 - protein, 6 aa, synthetic construct
  REGION 1..6: note = anti-HIV_CDR
MDWTWS

SEQ ID NO: 5708 - protein, 6 aa, synthetic construct
  REGION 1..6: note = anti-HIV_CDR
MDWTWR

SEQ ID NO: 5709 - protein, 6 aa, synthetic construct
  REGION 1..6: note = anti-HIV_CDR
MKHLWF

SEQ ID NO: 5710 - protein, 6 aa, synthetic construct
  REGION 1..6: note = anti-HIV_CDR
MDWIWR

SEQ ID NO: 5711 - protein, 6 aa, synthetic construct
  REGION 1..6: note = anti-HIV_CDR
MDWTWT

SEQ ID NO: 5712 - protein, 6 aa, synthetic construct
  REGION 1..6: note = anti-HIV_CDR
MKHLFL

SEQ ID NO: 5713 - protein, 6 aa, synthetic construct
  REGION 1..6: note = anti-HIV_CDR
QLLQSN

SEQ ID NO: 5714 - protein, 6 aa, synthetic construct
  REGION 1..6: note = anti-HIV_CDR
GGSPEH

SEQ ID NO: 5715 - protein, 6 aa, synthetic construct
  REGION 1..6: note = anti-HIV_CDR
LEGTDY

SEQ ID NO: 5716 - protein, 6 aa, synthetic construct
  REGION 1..6: note = anti-HIV_CDR
QQYPST

SEQ ID NO: 5717 - protein, 7 aa, synthetic construct
  REGION 1..7: note = anti-HIV_CDR
NNHDRPS

SEQ ID NO: 5718 - protein, 7 aa, synthetic construct
  REGION 1..7: note = anti-HIV_CDR
NNQDRPA

SEQ ID NO: 5719 - protein, 7 aa, synthetic construct
  REGION 1..7: note = anti-HIV_CDR
NNNDRPS

SEQ ID NO: 5720 - protein, 7 aa, synthetic construct
  REGION 1..7: note = anti-HIV_CDR
NNQDRPS

SEQ ID NO: 5721 - protein, 7 aa, synthetic construct
  REGION 1..7: note = anti-HIV_CDR
DDSDRPS

SEQ ID NO: 5722 - protein, 7 aa, synthetic construct
  REGION 1..7: note = anti-HIV_CDR
WASTRHT

SEQ ID NO: 5723 - protein, 7 aa, synthetic construct
  REGION 1..7: note = anti-HIV_CDR
GATARDF

SEQ ID NO: 5724 - protein, 7 aa, synthetic construct
  REGION 1..7: note = anti-HIV_CDR
ASIKLAL

SEQ ID NO: 5725 - protein, 7 aa, synthetic construct
  REGION 1..7: note = anti-HIV_CDR
QQYGRSP

SEQ ID NO: 5726 - protein, 7 aa, synthetic construct
  REGION 1..7: note = anti-HIV_CDR
QQYYISP

SEQ ID NO: 5727 - protein, 7 aa, synthetic construct
  REGION 1..7: note = anti-HIV_CDR
QQSHSPS

SEQ ID NO: 5728 - protein, 7 aa, synthetic construct
  REGION 1..7: note = anti-HIV_CDR
GRCARRW

SEQ ID NO: 5729 - protein, 7 aa, synthetic construct
  REGION 1..7: note = anti-HIV_CDR
RFLFVVA

SEQ ID NO: 5730 - protein, 7 aa, synthetic construct
  REGION 1..7: note = anti-HIV_CDR
MSVSFLI

SEQ ID NO: 5731 - protein, 7 aa, synthetic construct
  REGION 1..7: note = anti-HIV_CDR
GSSNRCP

SEQ ID NO: 5732 - protein, 7 aa, synthetic construct
  REGION 1..7: note = anti-HIV_CDR
MKHLWFF

SEQ ID NO: 5733 - protein, 7 aa, synthetic construct
  REGION 1..7: note = anti-HIV_CDR
ASWDFDF

SEQ ID NO: 5734 - protein, 7 aa, synthetic construct
  REGION 1..7: note = anti-HIV_CDR
EIGVAEH

SEQ ID NO: 5735 - protein, 7 aa, synthetic construct
  REGION 1..7: note = anti-HIV_CDR
QKYDTAP

SEQ ID NO: 5736 - protein, 7 aa, synthetic construct
  REGION 1..7: note = anti-HIV_CDR
QQSSSTP

SEQ ID NO: 5737 - protein, 7 aa, synthetic construct
  REGION 1..7: note = anti-HIV_CDR
QQSAGTP

SEQ ID NO: 5738 - protein, 7 aa, synthetic construct
  REGION 1..7: note = anti-HIV_CDR
QQSSSKP

SEQ ID NO: 5739 - protein, 7 aa, synthetic construct
  REGION 1..7: note = anti-HIV_CDR
QEYNTYT

SEQ ID NO: 5740 - protein, 7 aa, synthetic construct
  REGION 1..7: note = anti-HIV_CDR
QEYNNYN

SEQ ID NO: 5741 - protein, 7 aa, synthetic construct
  REGION 1..7: note = anti-HIV_CDR
HYDALDY

SEQ ID NO: 5742 - protein, 8 aa, synthetic construct
  REGION 1..8: note = anti-HIV_CDR
AIFKGVQC

SEQ ID NO: 5743 - protein, 8 aa, synthetic construct
  REGION 1..8: note = anti-HIV_CDR
GPLGDYDF

SEQ ID NO: 5744 - protein, 8 aa, synthetic construct
  REGION 1..8: note = anti-HIV_CDR
QQYGSSLR

SEQ ID NO: 5745 - protein, 8 aa, synthetic construct
  REGION 1..8: note = anti-HIV_CDR
QQYSHYRT

SEQ ID NO: 5746 - protein, 8 aa, synthetic construct
  REGION 1..8: note = anti-HIV_CDR
QYYGMSVT

SEQ ID NO: 5747 - protein, 8 aa, synthetic construct
  REGION 1..8: note = anti-HIV_CDR
QQYENWLT

SEQ ID NO: 5748 - protein, 8 aa, synthetic construct
  REGION 1..8: note = anti-HIV_CDR
SGVHYMDV

SEQ ID NO: 5749 - protein, 8 aa, synthetic construct
  REGION 1..8: note = anti-HIV_CDR
QQYSGPLT

SEQ ID NO: 5750 - protein, 8 aa, synthetic construct
  REGION 1..8: note = anti-HIV_CDR
QQYYTVPS

SEQ ID NO: 5751 - protein, 8 aa, synthetic construct
  REGION 1..8: note = anti-HIV_CDR
QQYGSSIT

SEQ ID NO: 5752 - protein, 8 aa, synthetic construct
  REGION 1..8: note = anti-HIV_CDR
HQYNKWDT

SEQ ID NO: 5753 - protein, 8 aa, synthetic construct
  REGION 1..8: note = anti-HIV_CDR
QQSYTTPL

SEQ ID NO: 5754 - protein, 8 aa, synthetic construct
  REGION 1..8: note = anti-HIV_CDR
QRWETIDY

SEQ ID NO: 5755 - protein, 8 aa, synthetic construct
  REGION 1..8: note = anti-HIV_CDR
CSYAGSYT

SEQ ID NO: 5756 - protein, 8 aa, synthetic construct
  REGION 1..8: note = anti-HIV_CDR
QQYDNLPT

SEQ ID NO: 5757 - protein, 8 aa, synthetic construct
  REGION 1..8: note = anti-HIV_CDR
QQCTLPLT

SEQ ID NO: 5758 - protein, 8 aa, synthetic construct
  REGION 1..8: note = anti-HIV_CDR
QQSYSSVT

SEQ ID NO: 5759 - protein, 8 aa, synthetic construct
  REGION 1..8: note = anti-HIV_CDR
QQSHTSVT

SEQ ID NO: 5760 - protein, 8 aa, synthetic construct
  REGION 1..8: note = anti-HIV_CDR
QQTYASVT

SEQ ID NO: 5761 - protein, 8 aa, synthetic construct
  REGION 1..8: note = anti-HIV_CDR
QQYNSDYT

SEQ ID NO: 5762 - protein, 8 aa, synthetic construct
  REGION 1..8: note = anti-HIV_CDR
HLYVSRPV

SEQ ID NO: 5763 - protein, 8 aa, synthetic construct
  REGION 1..8: note = anti-HIV_CDR
QQYGRSPL

SEQ ID NO: 5764 - protein, 8 aa, synthetic construct
  REGION 1..8: note = anti-HIV_CDR
QQYGSSPL

SEQ ID NO: 5765 - protein, 8 aa, synthetic construct
  REGION 1..8: note = anti-HIV_CDR
QQYNDWPA

SEQ ID NO: 5766 - protein, 8 aa, synthetic construct
  REGION 1..8: note = anti-HIV_CDR
HQYGSSQR

SEQ ID NO: 5767 - protein, 8 aa, synthetic construct
  REGION 1..8: note = anti-HIV_CDR
QQTYSSVT

SEQ ID NO: 5768 - protein, 8 aa, synthetic construct
  REGION 1..8: note = anti-HIV_CDR
QQTYRSVT

SEQ ID NO: 5769 - protein, 8 aa, synthetic construct
  REGION 1..8: note = anti-HIV_CDR
QQYGSSWT

SEQ ID NO: 5770 - protein, 8 aa, synthetic construct
  REGION 1..8: note = anti-HIV_CDR
SSYAGINN

SEQ ID NO: 5771 - protein, 8 aa, synthetic construct
  REGION 1..8: note = anti-HIV_CDR
QKYGSSLT

SEQ ID NO: 5772 - protein, 8 aa, synthetic construct
  REGION 1..8: note = anti-HIV_CDR
MQALETLG

SEQ ID NO: 5773 - protein, 8 aa, synthetic construct
  REGION 1..8: note = anti-HIV_CDR
QQYAGSLT

SEQ ID NO: 5774 - protein, 8 aa, synthetic construct
  REGION 1..8: note = anti-HIV_CDR
RNWGNFDH

SEQ ID NO: 5775 - protein, 9 aa, synthetic construct
  REGION 1..9: note = anti-HIV_CDR
QQHYTTPWT

SEQ ID NO: 5776 - protein, 9 aa, synthetic construct
  REGION 1..9: note = anti-HIV_CDR
QQSFAVPYT

SEQ ID NO: 5777 - protein, 9 aa, synthetic construct
  REGION 1..9: note = anti-HIV_CDR
QQYKSYSGT

SEQ ID NO: 5778 - protein, 9 aa, synthetic construct
  REGION 1..9: note = anti-HIV_CDR
HQYAYSPRT

SEQ ID NO: 5779 - protein, 9 aa, synthetic construct
  REGION 1..9: note = anti-HIV_CDR
QQYNSFPPT

SEQ ID NO: 5780 - protein, 9 aa, synthetic construct
  REGION 1..9: note = anti-HIV_CDR
QQTYSNPRM

SEQ ID NO: 5781 - protein, 9 aa, synthetic construct
  REGION 1..9: note = anti-HIV_CDR
QQYEDPPWT

SEQ ID NO: 5782 - protein, 9 aa, synthetic construct
  REGION 1..9: note = anti-HIV_CDR
HQYFNTPRT

SEQ ID NO: 5783 - protein, 9 aa, synthetic construct
  REGION 1..9: note = anti-HIV_CDR
HQYFSTPRT

SEQ ID NO: 5784 - protein, 9 aa, synthetic construct
  REGION 1..9: note = anti-HIV_CDR
QHRSNWPWT

SEQ ID NO: 5785 - protein, 9 aa, synthetic construct
  REGION 1..9: note = anti-HIV_CDR
RGRRQIGDY

SEQ ID NO: 5786 - protein, 9 aa, synthetic construct
  REGION 1..9: note = anti-HIV_CDR
QQYGLSPWT

SEQ ID NO: 5787 - protein, 9 aa, synthetic construct
  REGION 1..9: note = anti-HIV_CDR
QQTYTSPIT

SEQ ID NO: 5788 - protein, 9 aa, synthetic construct
  REGION 1..9: note = anti-HIV_CDR
QQYGSSPPT

SEQ ID NO: 5789 - protein, 9 aa, synthetic construct
  REGION 1..9: note = anti-HIV_CDR
QQYGTSSCT

SEQ ID NO: 5790 - protein, 9 aa, synthetic construct
  REGION 1..9: note = anti-HIV_CDR
QQYDDAPIT

SEQ ID NO: 5791 - protein, 9 aa, synthetic construct
  REGION 1..9: note = anti-HIV_CDR
GPLLRYLDS

SEQ ID NO: 5792 - protein, 9 aa, synthetic construct
  REGION 1..9: note = anti-HIV_CDR
CLKKTSSYV

SEQ ID NO: 5793 - protein, 9 aa, synthetic construct
  REGION 1..9: note = anti-HIV_CDR
QQYNHWPQT

SEQ ID NO: 5794 - protein, 9 aa, synthetic construct
  REGION 1..9: note = anti-HIV_CDR
QQYSNLPYT

SEQ ID NO: 5795 - protein, 9 aa, synthetic construct
  REGION 1..9: note = anti-HIV_CDR
QQYDTYPGT

SEQ ID NO: 5796 - protein, 9 aa, synthetic construct
  REGION 1..9: note = anti-HIV_CDR
QEYSSTPYN

SEQ ID NO: 5797 - protein, 9 aa, synthetic construct
  REGION 1..9: note = anti-HIV_CDR
GAWDDTLYV

SEQ ID NO: 5798 - protein, 9 aa, synthetic construct
  REGION 1..9: note = anti-HIV_CDR
AAWDDTLYV

SEQ ID NO: 5799 - protein, 9 aa, synthetic construct
  REGION 1..9: note = anti-HIV_CDR
QQYYSDSIT

SEQ ID NO: 5800 - protein, 9 aa, synthetic construct
  REGION 1..9: note = anti-HIV_CDR
QQYGRSPYT

SEQ ID NO: 5801 - protein, 9 aa, synthetic construct
  REGION 1..9: note = anti-HIV_CDR
QQYTNYPWT

SEQ ID NO: 5802 - protein, 9 aa, synthetic construct
  REGION 1..9: note = anti-HIV_CDR
QQRHNWPIS

SEQ ID NO: 5803 - protein, 9 aa, synthetic construct
  REGION 1..9: note = anti-HIV_CDR
QQYHNWPRT

SEQ ID NO: 5804 - protein, 9 aa, synthetic construct
  REGION 1..9: note = anti-HIV_CDR
QQRSTWPPT

SEQ ID NO: 5805 - protein, 9 aa, synthetic construct
  REGION 1..9: note = anti-HIV_CDR
QQYDSFSWT

SEQ ID NO: 5806 - protein, 9 aa, synthetic construct
  REGION 1..9: note = anti-HIV_CDR
QQYNNLPVT

SEQ ID NO: 5807 - protein, 9 aa, synthetic construct
  REGION 1..9: note = anti-HIV_CDR
QQYNRYSYT

SEQ ID NO: 5808 - protein, 9 aa, synthetic construct
  REGION 1..9: note = anti-HIV_CDR
QEYYILPCS

SEQ ID NO: 5809 - protein, 9 aa, synthetic construct
  REGION 1..9: note = anti-HIV_CDR
QQYDNLLAH

SEQ ID NO: 5810 - protein, 9 aa, synthetic construct
  REGION 1..9: note = anti-HIV_CDR
HQCDNLIAR

SEQ ID NO: 5811 - protein, 9 aa, synthetic construct
  REGION 1..9: note = anti-HIV_CDR
QQSFSTLWT

SEQ ID NO: 5812 - protein, 9 aa, synthetic construct
  REGION 1..9: note = anti-HIV_CDR
HQSYSTPPT

SEQ ID NO: 5813 - protein, 9 aa, synthetic construct
  REGION 1..9: note = anti-HIV_CDR
QQGYSTPWT

SEQ ID NO: 5814 - protein, 9 aa, synthetic construct
  REGION 1..9: note = anti-HIV_CDR
QQYSTTPRT

SEQ ID NO: 5815 - protein, 9 aa, synthetic construct
  REGION 1..9: note = anti-HIV_CDR
QLYNSVPQT

SEQ ID NO: 5816 - protein, 9 aa, synthetic construct
  REGION 1..9: note = anti-HIV_CDR
QQRTSWPQT

SEQ ID NO: 5817 - protein, 9 aa, synthetic construct
  REGION 1..9: note = anti-HIV_CDR
QQFNTYSQT

SEQ ID NO: 5818 - protein, 9 aa, synthetic construct
  REGION 1..9: note = anti-HIV_CDR
MQSLQTPIT

SEQ ID NO: 5819 - protein, 9 aa, synthetic construct
  REGION 1..9: note = anti-HIV_CDR
QQYNSYPLT

SEQ ID NO: 5820 - protein, 9 aa, synthetic construct
  REGION 1..9: note = anti-HIV_CDR
QQYNSYSGT

SEQ ID NO: 5821 - protein, 9 aa, synthetic construct
  REGION 1..9: note = anti-HIV_CDR
QSYDSSLSG

SEQ ID NO: 5822 - protein, 9 aa, synthetic construct
  REGION 1..9: note = anti-HIV_CDR
SQGNTAIDY

SEQ ID NO: 5823 - protein, 9 aa, synthetic construct
  REGION 1..9: note = anti-HIV_CDR
EEPRDAFDL

SEQ ID NO: 5824 - protein, 9 aa, synthetic construct
  REGION 1..9: note = anti-HIV_CDR
QQSYTTPVT

SEQ ID NO: 5825 - protein, 9 aa, synthetic construct
  REGION 1..9: note = anti-HIV_CDR
AGREGWFDP

SEQ ID NO: 5826 - protein, 9 aa, synthetic construct
  REGION 1..9: note = anti-HIV_CDR
QQYYSTPHT

SEQ ID NO: 5827 - protein, 9 aa, synthetic construct
  REGION 1..9: note = anti-HIV_CDR
QQSYSIAGT

SEQ ID NO: 5828 - protein, 9 aa, synthetic construct
  REGION 1..9: note = anti-HIV_CDR
QNYNKPPRT

SEQ ID NO: 5829 - protein, 9 aa, synthetic construct
  REGION 1..9: note = anti-HIV_CDR
MQSIQLPLT

SEQ ID NO: 5830 - protein, 9 aa, synthetic construct
  REGION 1..9: note = anti-HIV_CDR
MQALQTSLT

SEQ ID NO: 5831 - protein, 9 aa, synthetic construct
  REGION 1..9: note = anti-HIV_CDR
QQYSSSPRT

SEQ ID NO: 5832 - protein, 9 aa, synthetic construct
  REGION 1..9: note = anti-HIV_CDR
QAWDSSTAV

SEQ ID NO: 5833 - protein, 9 aa, synthetic construct
  REGION 1..9: note = anti-HIV_CDR
QHYNNWPYT

SEQ ID NO: 5834 - protein, 9 aa, synthetic construct
  REGION 1..9: note = anti-HIV_CDR
QQYDRLPIT

SEQ ID NO: 5835 - protein, 9 aa, synthetic construct
  REGION 1..9: note = anti-HIV_CDR
QQYGSSPIT

SEQ ID NO: 5836 - protein, 9 aa, synthetic construct
  REGION 1..9: note = anti-HIV_CDR
QQYDVWPLT

SEQ ID NO: 5837 - protein, 9 aa, synthetic construct
  REGION 1..9: note = anti-HIV_CDR
HQYASSPRT

SEQ ID NO: 5838 - protein, 9 aa, synthetic construct
  REGION 1..9: note = anti-HIV_CDR
MQSLHLPYT

SEQ ID NO: 5839 - protein, 9 aa, synthetic construct
  REGION 1..9: note = anti-HIV_CDR
QQYYSSPLT

SEQ ID NO: 5840 - protein, 9 aa, synthetic construct
  REGION 1..9: note = anti-HIV_CDR
QQHDTFPFT

SEQ ID NO: 5841 - protein, 9 aa, synthetic construct
  REGION 1..9: note = anti-HIV_CDR
QQSYSTPYT

SEQ ID NO: 5842 - protein, 9 aa, synthetic construct
  REGION 1..9: note = anti-HIV_CDR
QQYKTYPVT

SEQ ID NO: 5843 - protein, 9 aa, synthetic construct
  REGION 1..9: note = anti-HIV_CDR
QQYYSTPVT

SEQ ID NO: 5844 - protein, 9 aa, synthetic construct
  REGION 1..9: note = anti-HIV_CDR
QQYNWPPFT

SEQ ID NO: 5845 - protein, 9 aa, synthetic construct
  REGION 1..9: note = anti-HIV_CDR
MQGTHWPWT

SEQ ID NO: 5846 - protein, 9 aa, synthetic construct
  REGION 1..9: note = anti-HIV_CDR
HQCGSSPRT

SEQ ID NO: 5847 - protein, 9 aa, synthetic construct
  REGION 1..9: note = anti-HIV_CDR
QQYNSYFRT

SEQ ID NO: 5848 - protein, 9 aa, synthetic construct
  REGION 1..9: note = anti-HIV_CDR
QQYHNWPPS

SEQ ID NO: 5849 - protein, 9 aa, synthetic construct
  REGION 1..9: note = anti-HIV_CDR
MQGTYWLWT

SEQ ID NO: 5850 - protein, 9 aa, synthetic construct
  REGION 1..9: note = anti-HIV_CDR
QQGFSAPFT

SEQ ID NO: 5851 - protein, 9 aa, synthetic construct
  REGION 1..9: note = anti-HIV_CDR
QQYNTYPLT

SEQ ID NO: 5852 - protein, 9 aa, synthetic construct
  REGION 1..9: note = anti-HIV_CDR
MQGTHWPRT

SEQ ID NO: 5853 - protein, 9 aa, synthetic construct
  REGION 1..9: note = anti-HIV_CDR
FGRTPWFDP

SEQ ID NO: 5854 - protein, 9 aa, synthetic construct
  REGION 1..9: note = anti-HIV_CDR
QQYFTSVIT

SEQ ID NO: 5855 - protein, 9 aa, synthetic construct
  REGION 1..9: note = anti-HIV_CDR
HHYMSDLQT

SEQ ID NO: 5856 - protein, 9 aa, synthetic construct
  REGION 1..9: note = anti-HIV_CDR
HHYSSSSHT

SEQ ID NO: 5857 - protein, 9 aa, synthetic construct
  REGION 1..9: note = anti-HIV_CDR
HHYKSDCQT

SEQ ID NO: 5858 - protein, 9 aa, synthetic construct
  REGION 1..9: note = anti-HIV_CDR
QHRSSWPLT

SEQ ID NO: 5859 - protein, 9 aa, synthetic construct
  REGION 1..9: note = anti-HIV_CDR
LQHHSYPWT

SEQ ID NO: 5860 - protein, 9 aa, synthetic construct
  REGION 1..9: note = anti-HIV_CDR
QQYGTSPGT

SEQ ID NO: 5861 - protein, 9 aa, synthetic construct
  REGION 1..9: note = anti-HIV_CDR
QQYGSSPTT

SEQ ID NO: 5862 - protein, 9 aa, synthetic construct
  REGION 1..9: note = anti-HIV_CDR
QQYGTSPTT

SEQ ID NO: 5863 - protein, 9 aa, synthetic construct
  REGION 1..9: note = anti-HIV_CDR
MQATHWPPG

SEQ ID NO: 5864 - protein, 9 aa, synthetic construct
  REGION 1..9: note = anti-HIV_CDR
QRYNRDPYI

SEQ ID NO: 5865 - protein, 9 aa, synthetic construct
  REGION 1..9: note = anti-HIV_CDR
QQYDNLPLA

SEQ ID NO: 5866 - protein, 9 aa, synthetic construct
  REGION 1..9: note = anti-HIV_CDR
SSYSATGVA

SEQ ID NO: 5867 - protein, 9 aa, synthetic construct
  REGION 1..9: note = anti-HIV_CDR
QHYGNSRWT

SEQ ID NO: 5868 - protein, 9 aa, synthetic construct
  REGION 1..9: note = anti-HIV_CDR
QQYETYPWT

SEQ ID NO: 5869 - protein, 9 aa, synthetic construct
  REGION 1..9: note = anti-HIV_CDR
QQYGSSPST

SEQ ID NO: 5870 - protein, 9 aa, synthetic construct
  REGION 1..9: note = anti-HIV_CDR
QQSQRTPHT

SEQ ID NO: 5871 - protein, 9 aa, synthetic construct
  REGION 1..9: note = anti-HIV_CDR
QQYDILPLT

SEQ ID NO: 5872 - protein, 9 aa, synthetic construct
  REGION 1..9: note = anti-HIV_CDR
QQSNSSPWT

SEQ ID NO: 5873 - protein, 9 aa, synthetic construct
  REGION 1..9: note = anti-HIV_CDR
QQSYDTPRT

SEQ ID NO: 5874 - protein, 9 aa, synthetic construct
  REGION 1..9: note = anti-HIV_CDR
QQFGSSPGT

SEQ ID NO: 5875 - protein, 9 aa, synthetic construct
  REGION 1..9: note = anti-HIV_CDR
HQYGSSPQT

SEQ ID NO: 5876 - protein, 9 aa, synthetic construct
  REGION 1..9: note = anti-HIV_CDR
HQYGSSPQS

SEQ ID NO: 5877 - protein, 9 aa, synthetic construct
  REGION 1..9: note = anti-HIV_CDR
LQHNSYPLT

SEQ ID NO: 5878 - protein, 9 aa, synthetic construct
  REGION 1..9: note = anti-HIV_CDR
QQYNDWPIT

SEQ ID NO: 5879 - protein, 9 aa, synthetic construct
  REGION 1..9: note = anti-HIV_CDR
QQTFTFPYT

SEQ ID NO: 5880 - protein, 9 aa, synthetic construct
  REGION 1..9: note = anti-HIV_CDR
QQSYTFPYI

SEQ ID NO: 5881 - protein, 9 aa, synthetic construct
  REGION 1..9: note = anti-HIV_CDR
QYYGSSPYT

SEQ ID NO: 5882 - protein, 9 aa, synthetic construct
  REGION 1..9: note = anti-HIV_CDR
QQSFGTPRT

SEQ ID NO: 5883 - protein, 9 aa, synthetic construct
  REGION 1..9: note = anti-HIV_CDR
QQYNDWPRT

SEQ ID NO: 5884 - protein, 9 aa, synthetic construct
  REGION 1..9: note = anti-HIV_CDR
QQYGSSPRT

SEQ ID NO: 5885 - protein, 9 aa, synthetic construct
  REGION 1..9: note = anti-HIV_CDR
LQHNRYPWT

SEQ ID NO: 5886 - protein, 9 aa, synthetic construct
  REGION 1..9: note = anti-HIV_CDR
LQHNNYPWT

SEQ ID NO: 5887 - protein, 9 aa, synthetic construct
  REGION 1..9: note = anti-HIV_CDR
LQYSTYPLT

SEQ ID NO: 5888 - protein, 9 aa, synthetic construct
  REGION 1..9: note = anti-HIV_CDR
LQYNAYPLT

SEQ ID NO: 5889 - protein, 9 aa, synthetic construct
  REGION 1..9: note = anti-HIV_CDR
QQYDSAPVT

SEQ ID NO: 5890 - protein, 9 aa, synthetic construct
  REGION 1..9: note = anti-HIV_CDR
QQTYTFPYS

SEQ ID NO: 5891 - protein, 9 aa, synthetic construct
  REGION 1..9: note = anti-HIV_CDR
GYDNSGPDY

SEQ ID NO: 5892 - protein, 9 aa, synthetic construct
  REGION 1..9: note = anti-HIV_CDR
QQYNNWPPA

SEQ ID NO: 5893 - protein, 9 aa, synthetic construct
  REGION 1..9: note = anti-HIV_CDR
HQYALSPWT

SEQ ID NO: 5894 - protein, 9 aa, synthetic construct
  REGION 1..9: note = anti-HIV_CDR
QKYDTDPMT

SEQ ID NO: 5895 - protein, 9 aa, synthetic construct
  REGION 1..9: note = anti-HIV_CDR
QQYNYYPIT

SEQ ID NO: 5896 - protein, 9 aa, synthetic construct
  REGION 1..9: note = anti-HIV_CDR
QQTFTDPVT

SEQ ID NO: 5897 - protein, 9 aa, synthetic construct
  REGION 1..9: note = anti-HIV_CDR
AAWDDSLHV

SEQ ID NO: 5898 - protein, 9 aa, synthetic construct
  REGION 1..9: note = anti-HIV_CDR
QQYASSPFT

SEQ ID NO: 5899 - protein, 9 aa, synthetic construct
  REGION 1..9: note = anti-HIV_CDR
QQSSSTPFT

SEQ ID NO: 5900 - protein, 9 aa, synthetic construct
  REGION 1..9: note = anti-HIV_CDR
QQRSNWAIT

SEQ ID NO: 5901 - protein, 9 aa, synthetic construct
  REGION 1..9: note = anti-HIV_CDR
QQYGSSPFT

SEQ ID NO: 5902 - protein, 9 aa, synthetic construct
  REGION 1..9: note = anti-HIV_CDR
QKYNGAPWT

SEQ ID NO: 5903 - protein, 9 aa, synthetic construct
  REGION 1..9: note = anti-HIV_CDR
QKYNNAPWT

SEQ ID NO: 5904 - protein, 9 aa, synthetic construct
  REGION 1..9: note = anti-HIV_CDR
QQRVNWPPN

SEQ ID NO: 5905 - protein, 9 aa, synthetic construct
  REGION 1..9: note = anti-HIV_CDR
QQRGHWPLT

SEQ ID NO: 5906 - protein, 9 aa, synthetic construct
  REGION 1..9: note = anti-HIV_CDR
QQYRYSVII

SEQ ID NO: 5907 - protein, 9 aa, synthetic construct
  REGION 1..9: note = anti-HIV_CDR
QQSGTSLLT

SEQ ID NO: 5908 - protein, 9 aa, synthetic construct
  REGION 1..9: note = anti-HIV_CDR
MKSQHSPRT

SEQ ID NO: 5909 - protein, 9 aa, synthetic construct
  REGION 1..9: note = anti-HIV_CDR
MQPLQTPYT

SEQ ID NO: 5910 - protein, 9 aa, synthetic construct
  REGION 1..9: note = anti-HIV_CDR
QQYTAYPWT

SEQ ID NO: 5911 - protein, 9 aa, synthetic construct
  REGION 1..9: note = anti-HIV_CDR
LQNHNYPRT

SEQ ID NO: 5912 - protein, 9 aa, synthetic construct
  REGION 1..9: note = anti-HIV_CDR
LQTHSYPRT

SEQ ID NO: 5913 - protein, 10 aa, synthetic construct
  REGION 1..10: note = anti-HIV_CDR
AAWDDSFDYV

SEQ ID NO: 5914 - protein, 10 aa, synthetic construct
  REGION 1..10: note = anti-HIV_CDR
QHSFGSPPWT

SEQ ID NO: 5915 - protein, 10 aa, synthetic construct
  REGION 1..10: note = anti-HIV_CDR
SSFTPTNTLV

SEQ ID NO: 5916 - protein, 10 aa, synthetic construct
  REGION 1..10: note = anti-HIV_CDR
QQYGTLHPRT

SEQ ID NO: 5917 - protein, 10 aa, synthetic construct
  REGION 1..10: note = anti-HIV_CDR
QQYNNWPPIT

SEQ ID NO: 5918 - protein, 10 aa, synthetic construct
  REGION 1..10: note = anti-HIV_CDR
QQYYQWLSYT

SEQ ID NO: 5919 - protein, 10 aa, synthetic construct
  REGION 1..10: note = anti-HIV_CDR
QQRANWRLLT

SEQ ID NO: 5920 - protein, 10 aa, synthetic construct
  REGION 1..10: note = anti-HIV_CDR
RHSDYCDLDV

SEQ ID NO: 5921 - protein, 10 aa, synthetic construct
  REGION 1..10: note = anti-HIV_CDR
RRSDYCDFDV

SEQ ID NO: 5922 - protein, 10 aa, synthetic construct
  REGION 1..10: note = anti-HIV_CDR
RHTDYCDFDV

SEQ ID NO: 5923 - protein, 10 aa, synthetic construct
  REGION 1..10: note = anti-HIV_CDR
QRSDYWDFDV

SEQ ID NO: 5924 - protein, 10 aa, synthetic construct
  REGION 1..10: note = anti-HIV_CDR
RHSDYCDFDI

SEQ ID NO: 5925 - protein, 10 aa, synthetic construct
  REGION 1..10: note = anti-HIV_CDR
CEVDADETIT

SEQ ID NO: 5926 - protein, 10 aa, synthetic construct
  REGION 1..10: note = anti-HIV_CDR
CEVDAEETII

SEQ ID NO: 5927 - protein, 10 aa, synthetic construct
  REGION 1..10: note = anti-HIV_CDR
QRSDFWDFDV

SEQ ID NO: 5928 - protein, 10 aa, synthetic construct
  REGION 1..10: note = anti-HIV_CDR
RHSDYCDFDV

SEQ ID NO: 5929 - protein, 10 aa, synthetic construct
  REGION 1..10: note = anti-HIV_CDR
CSYAGGRTVV

SEQ ID NO: 5930 - protein, 10 aa, synthetic construct
  REGION 1..10: note = anti-HIV_CDR
AAWDDSLDYV

SEQ ID NO: 5931 - protein, 10 aa, synthetic construct
  REGION 1..10: note = anti-HIV_CDR
QQRSNWPRLT

SEQ ID NO: 5932 - protein, 10 aa, synthetic construct
  REGION 1..10: note = anti-HIV_CDR
QQYNNWPPFT

SEQ ID NO: 5933 - protein, 10 aa, synthetic construct
  REGION 1..10: note = anti-HIV_CDR
MQGTYWPPLT

SEQ ID NO: 5934 - protein, 10 aa, synthetic construct
  REGION 1..10: note = anti-HIV_CDR
QQYGSSLLYT

SEQ ID NO: 5935 - protein, 10 aa, synthetic construct
  REGION 1..10: note = anti-HIV_CDR
QQSFGIPPWT

SEQ ID NO: 5936 - protein, 10 aa, synthetic construct
  REGION 1..10: note = anti-HIV_CDR
CSYAGSYSYV

SEQ ID NO: 5937 - protein, 10 aa, synthetic construct
  REGION 1..10: note = anti-HIV_CDR
YSYAGNSLGV

SEQ ID NO: 5938 - protein, 10 aa, synthetic construct
  REGION 1..10: note = anti-HIV_CDR
SSYTISSPRV

SEQ ID NO: 5939 - protein, 10 aa, synthetic construct
  REGION 1..10: note = anti-HIV_CDR
QEWELQPFDY

SEQ ID NO: 5940 - protein, 10 aa, synthetic construct
  REGION 1..10: note = anti-HIV_CDR
LIPVSGAFDV

SEQ ID NO: 5941 - protein, 10 aa, synthetic construct
  REGION 1..10: note = anti-HIV_CDR
DRDYDEDFDF

SEQ ID NO: 5942 - protein, 10 aa, synthetic construct
  REGION 1..10: note = anti-HIV_CDR
QEYGRSPPFP

SEQ ID NO: 5943 - protein, 10 aa, synthetic construct
  REGION 1..10: note = anti-HIV_CDR
TLDGNFHWDF

SEQ ID NO: 5944 - protein, 10 aa, synthetic construct
  REGION 1..10: note = anti-HIV_CDR
FTQRQGGFDY

SEQ ID NO: 5945 - protein, 10 aa, synthetic construct
  REGION 1..10: note = anti-HIV_CDR
QQYYKWPPIT

SEQ ID NO: 5946 - protein, 10 aa, synthetic construct
  REGION 1..10: note = anti-HIV_CDR
QQYGSSAPYT

SEQ ID NO: 5947 - protein, 10 aa, synthetic construct
  REGION 1..10: note = anti-HIV_CDR
QQLNSDPPWT

SEQ ID NO: 5948 - protein, 10 aa, synthetic construct
  REGION 1..10: note = anti-HIV_CDR
QHHGSSPTWT

SEQ ID NO: 5949 - protein, 10 aa, synthetic construct
  REGION 1..10: note = anti-HIV_CDR
QQYKKWPPWT

SEQ ID NO: 5950 - protein, 10 aa, synthetic construct
  REGION 1..10: note = anti-HIV_CDR
QQYGFSLPVT

SEQ ID NO: 5951 - protein, 10 aa, synthetic construct
  REGION 1..10: note = anti-HIV_CDR
QSYNGDPPVT

SEQ ID NO: 5952 - protein, 10 aa, synthetic construct
  REGION 1..10: note = anti-HIV_CDR
QQYGSSRRWT

SEQ ID NO: 5953 - protein, 10 aa, synthetic construct
  REGION 1..10: note = anti-HIV_CDR
QQFNSYPPLT

SEQ ID NO: 5954 - protein, 10 aa, synthetic construct
  REGION 1..10: note = anti-HIV_CDR
REGSQGAFDI

SEQ ID NO: 5955 - protein, 10 aa, synthetic construct
  REGION 1..10: note = anti-HIV_CDR
GDSGPTGFDY

SEQ ID NO: 5956 - protein, 10 aa, synthetic construct
  REGION 1..10: note = anti-HIV_CDR
VRRGSSYPDY

SEQ ID NO: 5957 - protein, 10 aa, synthetic construct
  REGION 1..10: note = anti-HIV_CDR
SAYYRNWFDS

SEQ ID NO: 5958 - protein, 10 aa, synthetic construct
  REGION 1..10: note = anti-HIV_CDR
QSYDSSVSVV

SEQ ID NO: 5959 - protein, 10 aa, synthetic construct
  REGION 1..10: note = anti-HIV_CDR
SSYTSSLTLV

SEQ ID NO: 5960 - protein, 10 aa, synthetic construct
  REGION 1..10: note = anti-HIV_CDR
YEGKRSGMDV

SEQ ID NO: 5961 - protein, 10 aa, synthetic construct
  REGION 1..10: note = anti-HIV_CDR
QQYGSSPEYT

SEQ ID NO: 5962 - protein, 10 aa, synthetic construct
  REGION 1..10: note = anti-HIV_CDR
QYYDHRPAIA

SEQ ID NO: 5963 - protein, 10 aa, synthetic construct
  REGION 1..10: note = anti-HIV_CDR
QQYDNLPRVT

SEQ ID NO: 5964 - protein, 10 aa, synthetic construct
  REGION 1..10: note = anti-HIV_CDR
GAYTTTSTLV

SEQ ID NO: 5965 - protein, 10 aa, synthetic construct
  REGION 1..10: note = anti-HIV_CDR
QQYKSYSPLT

SEQ ID NO: 5966 - protein, 10 aa, synthetic construct
  REGION 1..10: note = anti-HIV_CDR
QQSYNTRPLT

SEQ ID NO: 5967 - protein, 10 aa, synthetic construct
  REGION 1..10: note = anti-HIV_CDR
QQYGGSPPDT

SEQ ID NO: 5968 - protein, 10 aa, synthetic construct
  REGION 1..10: note = anti-HIV_CDR
CSYTSSATVV

SEQ ID NO: 5969 - protein, 10 aa, synthetic construct
  REGION 1..10: note = anti-HIV_CDR
CSHTSSDTLV

SEQ ID NO: 5970 - protein, 10 aa, synthetic construct
  REGION 1..10: note = anti-HIV_CDR
QHYGNSPRVT

SEQ ID NO: 5971 - protein, 10 aa, synthetic construct
  REGION 1..10: note = anti-HIV_CDR
DAFVSSAMDV

SEQ ID NO: 5972 - protein, 10 aa, synthetic construct
  REGION 1..10: note = anti-HIV_CDR
LRATTPGFDY

SEQ ID NO: 5973 - protein, 10 aa, synthetic construct
  REGION 1..10: note = anti-HIV_CDR
LRATIPGFDY

SEQ ID NO: 5974 - protein, 10 aa, synthetic construct
  REGION 1..10: note = anti-HIV_CDR
LRATIAGFDY

SEQ ID NO: 5975 - protein, 10 aa, synthetic construct
  REGION 1..10: note = anti-HIV_CDR
CSYAGSYIWV

SEQ ID NO: 5976 - protein, 10 aa, synthetic construct
  REGION 1..10: note = anti-HIV_CDR
CSYAGTYSYV

SEQ ID NO: 5977 - protein, 10 aa, synthetic construct
  REGION 1..10: note = anti-HIV_CDR
SSYAGSNNFV

SEQ ID NO: 5978 - protein, 10 aa, synthetic construct
  REGION 1..10: note = anti-HIV_CDR
GSFTTSLTLV

SEQ ID NO: 5979 - protein, 10 aa, synthetic construct
  REGION 1..10: note = anti-HIV_CDR
QQYATSSLYT

SEQ ID NO: 5980 - protein, 10 aa, synthetic construct
  REGION 1..10: note = anti-HIV_CDR
QWYGTLHPRT

SEQ ID NO: 5981 - protein, 10 aa, synthetic construct
  REGION 1..10: note = anti-HIV_CDR
SSYSSTNTYV

SEQ ID NO: 5982 - protein, 10 aa, synthetic construct
  REGION 1..10: note = anti-HIV_CDR
TFITASWFDS

SEQ ID NO: 5983 - protein, 10 aa, synthetic construct
  REGION 1..10: note = anti-HIV_CDR
TGGLLRFPEV

SEQ ID NO: 5984 - protein, 10 aa, synthetic construct
  REGION 1..10: note = anti-HIV_CDR
CSYAGSYTYV

SEQ ID NO: 5985 - protein, 10 aa, synthetic construct
  REGION 1..10: note = anti-HIV_CDR
QQRYSWPSLT

SEQ ID NO: 5986 - protein, 10 aa, synthetic construct
  REGION 1..10: note = anti-HIV_CDR
LQCGSSPPYT

SEQ ID NO: 5987 - protein, 10 aa, synthetic construct
  REGION 1..10: note = anti-HIV_CDR
SSYAGTNHWV

SEQ ID NO: 5988 - protein, 10 aa, synthetic construct
  REGION 1..10: note = anti-HIV_CDR
SSYAATNHWV

SEQ ID NO: 5989 - protein, 10 aa, synthetic construct
  REGION 1..10: note = anti-HIV_CDR
QYYGTSPPST

SEQ ID NO: 5990 - protein, 10 aa, synthetic construct
  REGION 1..10: note = anti-HIV_CDR
QYYGSSPPST

SEQ ID NO: 5991 - protein, 10 aa, synthetic construct
  REGION 1..10: note = anti-HIV_CDR
QEFGRAPPYP

SEQ ID NO: 5992 - protein, 10 aa, synthetic construct
  REGION 1..10: note = anti-HIV_CDR
QEYGRSPPYP

SEQ ID NO: 5993 - protein, 10 aa, synthetic construct
  REGION 1..10: note = anti-HIV_CDR
QEYGRAPPYP

SEQ ID NO: 5994 - protein, 10 aa, synthetic construct
  REGION 1..10: note = anti-HIV_CDR
HIAVGGSEEH

SEQ ID NO: 5995 - protein, 10 aa, synthetic construct
  REGION 1..10: note = anti-HIV_CDR
HIAVGGSEDH

SEQ ID NO: 5996 - protein, 10 aa, synthetic construct
  REGION 1..10: note = anti-HIV_CDR
HIAVGGREEE

SEQ ID NO: 5997 - protein, 11 aa, synthetic construct
  REGION 1..11: note = anti-HIV_CDR
GEKSRGSRAVQ

SEQ ID NO: 5998 - protein, 11 aa, synthetic construct
  REGION 1..11: note = anti-HIV_CDR
GEKSFASRAVQ

SEQ ID NO: 5999 - protein, 11 aa, synthetic construct
  REGION 1..11: note = anti-HIV_CDR
GRQALGSRAVQ

SEQ ID NO: 6000 - protein, 11 aa, synthetic construct
  REGION 1..11: note = anti-HIV_CDR
GEESLGSRSVI

SEQ ID NO: 6001 - protein, 11 aa, synthetic construct
  REGION 1..11: note = anti-HIV_CDR
GEKSLGSRAVQ

SEQ ID NO: 6002 - protein, 11 aa, synthetic construct
  REGION 1..11: note = anti-HIV_CDR
GKESIGSRAVQ

SEQ ID NO: 6003 - protein, 11 aa, synthetic construct
  REGION 1..11: note = anti-HIV_CDR
GGNNIGSKSVH

SEQ ID NO: 6004 - protein, 11 aa, synthetic construct
  REGION 1..11: note = anti-HIV_CDR
GEKSIGSRAVQ

SEQ ID NO: 6005 - protein, 11 aa, synthetic construct
  REGION 1..11: note = anti-HIV_CDR
KASQDVSTAVA

SEQ ID NO: 6006 - protein, 11 aa, synthetic construct
  REGION 1..11: note = anti-HIV_CDR
GSRNLSHRLLS

SEQ ID NO: 6007 - protein, 11 aa, synthetic construct
  REGION 1..11: note = anti-HIV_CDR
GTYDSQGSTRL

SEQ ID NO: 6008 - protein, 11 aa, synthetic construct
  REGION 1..11: note = anti-HIV_CDR
QQRTIWPPGCS

SEQ ID NO: 6009 - protein, 11 aa, synthetic construct
  REGION 1..11: note = anti-HIV_CDR
GTWDSSLSAVL

SEQ ID NO: 6010 - protein, 11 aa, synthetic construct
  REGION 1..11: note = anti-HIV_CDR
ASWDNSLSGPV

SEQ ID NO: 6011 - protein, 11 aa, synthetic construct
  REGION 1..11: note = anti-HIV_CDR
ASWDDSLSGWV

SEQ ID NO: 6012 - protein, 11 aa, synthetic construct
  REGION 1..11: note = anti-HIV_CDR
LLLPYYGGPWI

SEQ ID NO: 6013 - protein, 11 aa, synthetic construct
  REGION 1..11: note = anti-HIV_CDR
QHRTNWPPSIT

SEQ ID NO: 6014 - protein, 11 aa, synthetic construct
  REGION 1..11: note = anti-HIV_CDR
QSYDRSLRGSV

SEQ ID NO: 6015 - protein, 11 aa, synthetic construct
  REGION 1..11: note = anti-HIV_CDR
SSGNYDFAFDI

SEQ ID NO: 6016 - protein, 11 aa, synthetic construct
  REGION 1..11: note = anti-HIV_CDR
SSGNYDFAYDI

SEQ ID NO: 6017 - protein, 11 aa, synthetic construct
  REGION 1..11: note = anti-HIV_CDR
SSGNFEFAFEI

SEQ ID NO: 6018 - protein, 11 aa, synthetic construct
  REGION 1..11: note = anti-HIV_CDR
ATYDSHGSIRL

SEQ ID NO: 6019 - protein, 11 aa, synthetic construct
  REGION 1..11: note = anti-HIV_CDR
GTYDTSLSLRL

SEQ ID NO: 6020 - protein, 11 aa, synthetic construct
  REGION 1..11: note = anti-HIV_CDR
AAFDSALSLPL

SEQ ID NO: 6021 - protein, 11 aa, synthetic construct
  REGION 1..11: note = anti-HIV_CDR
ATYDSDGSIRL

SEQ ID NO: 6022 - protein, 11 aa, synthetic construct
  REGION 1..11: note = anti-HIV_CDR
ATYDSGWSIRL

SEQ ID NO: 6023 - protein, 11 aa, synthetic construct
  REGION 1..11: note = anti-HIV_CDR
ATYDTGLSLRL

SEQ ID NO: 6024 - protein, 11 aa, synthetic construct
  REGION 1..11: note = anti-HIV_CDR
AAYDSTLSLRL

SEQ ID NO: 6025 - protein, 11 aa, synthetic construct
  REGION 1..11: note = anti-HIV_CDR
AAYDSAVSLPV

SEQ ID NO: 6026 - protein, 11 aa, synthetic construct
  REGION 1..11: note = anti-HIV_CDR
ATYDTDLSLRL

SEQ ID NO: 6027 - protein, 11 aa, synthetic construct
  REGION 1..11: note = anti-HIV_CDR
AAYDSSLSLRL

SEQ ID NO: 6028 - protein, 11 aa, synthetic construct
  REGION 1..11: note = anti-HIV_CDR
AAYDSTFSLPV

SEQ ID NO: 6029 - protein, 11 aa, synthetic construct
  REGION 1..11: note = anti-HIV_CDR
ATYDSQGSTRL

SEQ ID NO: 6030 - protein, 11 aa, synthetic construct
  REGION 1..11: note = anti-HIV_CDR
ATYDSQRSIRL

SEQ ID NO: 6031 - protein, 11 aa, synthetic construct
  REGION 1..11: note = anti-HIV_CDR
AVYDSSLSLGL

SEQ ID NO: 6032 - protein, 11 aa, synthetic construct
  REGION 1..11: note = anti-HIV_CDR
QHRSIWPLMCT

SEQ ID NO: 6033 - protein, 11 aa, synthetic construct
  REGION 1..11: note = anti-HIV_CDR
LQPVYIFRGTW

SEQ ID NO: 6034 - protein, 11 aa, synthetic construct
  REGION 1..11: note = anti-HIV_CDR
CEVDADETVTC

SEQ ID NO: 6035 - protein, 11 aa, synthetic construct
  REGION 1..11: note = anti-HIV_CDR
CEVDAEVTMTV

SEQ ID NO: 6036 - protein, 11 aa, synthetic construct
  REGION 1..11: note = anti-HIV_CDR
SSYADTNDFGV

SEQ ID NO: 6037 - protein, 11 aa, synthetic construct
  REGION 1..11: note = anti-HIV_CDR
CSFTYVNPTYL

SEQ ID NO: 6038 - protein, 11 aa, synthetic construct
  REGION 1..11: note = anti-HIV_CDR
GTWDGSLTTGV

SEQ ID NO: 6039 - protein, 11 aa, synthetic construct
  REGION 1..11: note = anti-HIV_CDR
QSYDNSLSGWV

SEQ ID NO: 6040 - protein, 11 aa, synthetic construct
  REGION 1..11: note = anti-HIV_CDR
QQYYSIPPWTF

SEQ ID NO: 6041 - protein, 11 aa, synthetic construct
  REGION 1..11: note = anti-HIV_CDR
MQGTYWPPSIT

SEQ ID NO: 6042 - protein, 11 aa, synthetic construct
  REGION 1..11: note = anti-HIV_CDR
QSYDSSLGVEV

SEQ ID NO: 6043 - protein, 11 aa, synthetic construct
  REGION 1..11: note = anti-HIV_CDR
QVWDSGRDSWV

SEQ ID NO: 6044 - protein, 11 aa, synthetic construct
  REGION 1..11: note = anti-HIV_CDR
QSYDSSLSGWV

SEQ ID NO: 6045 - protein, 11 aa, synthetic construct
  REGION 1..11: note = anti-HIV_CDR
GSWDGSLNAGV

SEQ ID NO: 6046 - protein, 11 aa, synthetic construct
  REGION 1..11: note = anti-HIV_CDR
LSADSSSTYQV

SEQ ID NO: 6047 - protein, 11 aa, synthetic construct
  REGION 1..11: note = anti-HIV_CDR
CSYAGRDTSWV

SEQ ID NO: 6048 - protein, 11 aa, synthetic construct
  REGION 1..11: note = anti-HIV_CDR
QQRSNWPPGLT

SEQ ID NO: 6049 - protein, 11 aa, synthetic construct
  REGION 1..11: note = anti-HIV_CDR
KGRGYGYWFDS

SEQ ID NO: 6050 - protein, 11 aa, synthetic construct
  REGION 1..11: note = anti-HIV_CDR
EMAATSDAFDI

SEQ ID NO: 6051 - protein, 11 aa, synthetic construct
  REGION 1..11: note = anti-HIV_CDR
SIYSTGPAPVY

SEQ ID NO: 6052 - protein, 11 aa, synthetic construct
  REGION 1..11: note = anti-HIV_CDR
RGSLLIKYFDY

SEQ ID NO: 6053 - protein, 11 aa, synthetic construct
  REGION 1..11: note = anti-HIV_CDR
QQYDNLPPRVT

SEQ ID NO: 6054 - protein, 11 aa, synthetic construct
  REGION 1..11: note = anti-HIV_CDR
DVRLVAVPGAD

SEQ ID NO: 6055 - protein, 11 aa, synthetic construct
  REGION 1..11: note = anti-HIV_CDR
QQRTTWPPEYT

SEQ ID NO: 6056 - protein, 11 aa, synthetic construct
  REGION 1..11: note = anti-HIV_CDR
AAWDDSLNGWV

SEQ ID NO: 6057 - protein, 11 aa, synthetic construct
  REGION 1..11: note = anti-HIV_CDR
RRRSAWSPFDS

SEQ ID NO: 6058 - protein, 11 aa, synthetic construct
  REGION 1..11: note = anti-HIV_CDR
ATWDSSLRTAL

SEQ ID NO: 6059 - protein, 11 aa, synthetic construct
  REGION 1..11: note = anti-HIV_CDR
GTWDSSLRAAL

SEQ ID NO: 6060 - protein, 11 aa, synthetic construct
  REGION 1..11: note = anti-HIV_CDR
QQRSIWPPSLT

SEQ ID NO: 6061 - protein, 11 aa, synthetic construct
  REGION 1..11: note = anti-HIV_CDR
EFQTSGVVREG

SEQ ID NO: 6062 - protein, 11 aa, synthetic construct
  REGION 1..11: note = anti-HIV_CDR
HIGAGGPYSEY

SEQ ID NO: 6063 - protein, 11 aa, synthetic construct
  REGION 1..11: note = anti-HIV_CDR
RGHSFTSPFDS

SEQ ID NO: 6064 - protein, 11 aa, synthetic construct
  REGION 1..11: note = anti-HIV_CDR
QHLNSYPRMYT

SEQ ID NO: 6065 - protein, 11 aa, synthetic construct
  REGION 1..11: note = anti-HIV_CDR
QQRSNWPPKIT

SEQ ID NO: 6066 - protein, 11 aa, synthetic construct
  REGION 1..11: note = anti-HIV_CDR
AAWDDSLGGVV

SEQ ID NO: 6067 - protein, 11 aa, synthetic construct
  REGION 1..11: note = anti-HIV_CDR
GTWDSSLSAVV

SEQ ID NO: 6068 - protein, 11 aa, synthetic construct
  REGION 1..11: note = anti-HIV_CDR
QQRANWPPGGT

SEQ ID NO: 6069 - protein, 11 aa, synthetic construct
  REGION 1..11: note = anti-HIV_CDR
GGGYPRGNMDV

SEQ ID NO: 6070 - protein, 11 aa, synthetic construct
  REGION 1..11: note = anti-HIV_CDR
LLLLYYGGPWI

SEQ ID NO: 6071 - protein, 11 aa, synthetic construct
  REGION 1..11: note = anti-HIV_CDR
QQRGIWPLQIT

SEQ ID NO: 6072 - protein, 11 aa, synthetic construct
  REGION 1..11: note = anti-HIV_CDR
RSPGGGYAFDI

SEQ ID NO: 6073 - protein, 11 aa, synthetic construct
  REGION 1..11: note = anti-HIV_CDR
SGPGLLRGFDY

SEQ ID NO: 6074 - protein, 11 aa, synthetic construct
  REGION 1..11: note = anti-HIV_CDR
QQRTTRPPEYT

SEQ ID NO: 6075 - protein, 11 aa, synthetic construct
  REGION 1..11: note = anti-HIV_CDR
QQRTTRPPDYT

SEQ ID NO: 6076 - protein, 11 aa, synthetic construct
  REGION 1..11: note = anti-HIV_CDR
QGRTTRPPDYT

SEQ ID NO: 6077 - protein, 11 aa, synthetic construct
  REGION 1..11: note = anti-HIV_CDR
QQRSTTPPEYT

SEQ ID NO: 6078 - protein, 11 aa, synthetic construct
  REGION 1..11: note = anti-HIV_CDR
QQRTSWPLALS

SEQ ID NO: 6079 - protein, 11 aa, synthetic construct
  REGION 1..11: note = anti-HIV_CDR
RGHSFSLPFDS

SEQ ID NO: 6080 - protein, 12 aa, synthetic construct
  REGION 1..12: note = anti-HIV_CDR
HYWDSRSPISWV

SEQ ID NO: 6081 - protein, 12 aa, synthetic construct
  REGION 1..12: note = anti-HIV_CDR
HKWDSRSPLSWV

SEQ ID NO: 6082 - protein, 12 aa, synthetic construct
  REGION 1..12: note = anti-HIV_CDR
HMWDSRSGFSWS

SEQ ID NO: 6083 - protein, 12 aa, synthetic construct
  REGION 1..12: note = anti-HIV_CDR
HIWDSRVPTKWV

SEQ ID NO: 6084 - protein, 12 aa, synthetic construct
  REGION 1..12: note = anti-HIV_CDR
QVWDSSSDHPWV

SEQ ID NO: 6085 - protein, 12 aa, synthetic construct
  REGION 1..12: note = anti-HIV_CDR
HIYDARRPTNWV

SEQ ID NO: 6086 - protein, 12 aa, synthetic construct
  REGION 1..12: note = anti-HIV_CDR
LDGEAFRYYLDL

SEQ ID NO: 6087 - protein, 12 aa, synthetic construct
  REGION 1..12: note = anti-HIV_CDR
PQYNLGRDPLDV

SEQ ID NO: 6088 - protein, 12 aa, synthetic construct
  REGION 1..12: note = anti-HIV_CDR
PEPSSIVAPLYY

SEQ ID NO: 6089 - protein, 12 aa, synthetic construct
  REGION 1..12: note = anti-HIV_CDR
GGGDGRNWHLHP

SEQ ID NO: 6090 - protein, 12 aa, synthetic construct
  REGION 1..12: note = anti-HIV_CDR
PKSGRDYWSFDL

SEQ ID NO: 6091 - protein, 12 aa, synthetic construct
  REGION 1..12: note = anti-HIV_CDR
PRGGRDNWSFHV

SEQ ID NO: 6092 - protein, 12 aa, synthetic construct
  REGION 1..12: note = anti-HIV_CDR
PHSPDDAWSLDV

SEQ ID NO: 6093 - protein, 12 aa, synthetic construct
  REGION 1..12: note = anti-HIV_CDR
PLRGGDTWHYHS

SEQ ID NO: 6094 - protein, 12 aa, synthetic construct
  REGION 1..12: note = anti-HIV_CDR
LQPVYILRSICH

SEQ ID NO: 6095 - protein, 12 aa, synthetic construct
  REGION 1..12: note = anti-HIV_CDR
LQPVYILKCNWC

SEQ ID NO: 6096 - protein, 12 aa, synthetic construct
  REGION 1..12: note = anti-HIV_CDR
EYRFDDWGPLDH

SEQ ID NO: 6097 - protein, 12 aa, synthetic construct
  REGION 1..12: note = anti-HIV_CDR
AAWDDSLNGHGV

SEQ ID NO: 6098 - protein, 12 aa, synthetic construct
  REGION 1..12: note = anti-HIV_CDR
LYFDWAPHAFDI

SEQ ID NO: 6099 - protein, 12 aa, synthetic construct
  REGION 1..12: note = anti-HIV_CDR
GLYDSSGYYFGY

SEQ ID NO: 6100 - protein, 12 aa, synthetic construct
  REGION 1..12: note = anti-HIV_CDR
LGCSGGSCYEDS

SEQ ID NO: 6101 - protein, 12 aa, synthetic construct
  REGION 1..12: note = anti-HIV_CDR
ASGSYILGTMDV

SEQ ID NO: 6102 - protein, 12 aa, synthetic construct
  REGION 1..12: note = anti-HIV_CDR
YSTDNSGKQHWV

SEQ ID NO: 6103 - protein, 12 aa, synthetic construct
  REGION 1..12: note = anti-HIV_CDR
VKQFLEWLYLDY

SEQ ID NO: 6104 - protein, 12 aa, synthetic construct
  REGION 1..12: note = anti-HIV_CDR
GVRSIVGAHFDY

SEQ ID NO: 6105 - protein, 12 aa, synthetic construct
  REGION 1..12: note = anti-HIV_CDR
GVGTRYYVYFDS

SEQ ID NO: 6106 - protein, 12 aa, synthetic construct
  REGION 1..12: note = anti-HIV_CDR
APYISSSHLDYW

SEQ ID NO: 6107 - protein, 12 aa, synthetic construct
  REGION 1..12: note = anti-HIV_CDR
RGIAAAGFYFQH

SEQ ID NO: 6108 - protein, 12 aa, synthetic construct
  REGION 1..12: note = anti-HIV_CDR
RGIAAAAFYFQT

SEQ ID NO: 6109 - protein, 12 aa, synthetic construct
  REGION 1..12: note = anti-HIV_CDR
RGIAAAGFYFQN

SEQ ID NO: 6110 - protein, 12 aa, synthetic construct
  REGION 1..12: note = anti-HIV_CDR
QSYDTSLTDTGV

SEQ ID NO: 6111 - protein, 12 aa, synthetic construct
  REGION 1..12: note = anti-HIV_CDR
QSYDTSLSDTGV

SEQ ID NO: 6112 - protein, 12 aa, synthetic construct
  REGION 1..12: note = anti-HIV_CDR
RTTLVNFGVFDL

SEQ ID NO: 6113 - protein, 12 aa, synthetic construct
  REGION 1..12: note = anti-HIV_CDR
PVVNTILPYCDV

SEQ ID NO: 6114 - protein, 12 aa, synthetic construct
  REGION 1..12: note = anti-HIV_CDR
CYSGRSRYFFDS

SEQ ID NO: 6115 - protein, 12 aa, synthetic construct
  REGION 1..12: note = anti-HIV_CDR
AAWDDSLDGFWV

SEQ ID NO: 6116 - protein, 12 aa, synthetic construct
  REGION 1..12: note = anti-HIV_CDR
LRRGYYDSGEDY

SEQ ID NO: 6117 - protein, 12 aa, synthetic construct
  REGION 1..12: note = anti-HIV_CDR
LRRGYFDSGGDH

SEQ ID NO: 6118 - protein, 12 aa, synthetic construct
  REGION 1..12: note = anti-HIV_CDR
SSYTSSSTLGVV

SEQ ID NO: 6119 - protein, 12 aa, synthetic construct
  REGION 1..12: note = anti-HIV_CDR
LDGEAFRYYFDS

SEQ ID NO: 6120 - protein, 12 aa, synthetic construct
  REGION 1..12: note = anti-HIV_CDR
RRGQRLLAYFDY

SEQ ID NO: 6121 - protein, 12 aa, synthetic construct
  REGION 1..12: note = anti-HIV_CDR
PQYNLGREPLNV

SEQ ID NO: 6122 - protein, 12 aa, synthetic construct
  REGION 1..12: note = anti-HIV_CDR
AHHDFWRAPVDV

SEQ ID NO: 6123 - protein, 12 aa, synthetic construct
  REGION 1..12: note = anti-HIV_CDR
GRREGLNFLLDY

SEQ ID NO: 6124 - protein, 12 aa, synthetic construct
  REGION 1..12: note = anti-HIV_CDR
PEPSSIVGALYY

SEQ ID NO: 6125 - protein, 12 aa, synthetic construct
  REGION 1..12: note = anti-HIV_CDR
GPDDFWSGYPKY

SEQ ID NO: 6126 - protein, 12 aa, synthetic construct
  REGION 1..12: note = anti-HIV_CDR
DYSAAGRHLFDS

SEQ ID NO: 6127 - protein, 12 aa, synthetic construct
  REGION 1..12: note = anti-HIV_CDR
DYTARGRHFFDY

SEQ ID NO: 6128 - protein, 12 aa, synthetic construct
  REGION 1..12: note = anti-HIV_CDR
DYTASGRHFFDY

SEQ ID NO: 6129 - protein, 12 aa, synthetic construct
  REGION 1..12: note = anti-HIV_CDR
QSYDSSLSGSWV

SEQ ID NO: 6130 - protein, 12 aa, synthetic construct
  REGION 1..12: note = anti-HIV_CDR
PAQAGVGPRFDY

SEQ ID NO: 6131 - protein, 12 aa, synthetic construct
  REGION 1..12: note = anti-HIV_CDR
GAINSSPLYFDS

SEQ ID NO: 6132 - protein, 12 aa, synthetic construct
  REGION 1..12: note = anti-HIV_CDR
GDITSSPLYFDF

SEQ ID NO: 6133 - protein, 12 aa, synthetic construct
  REGION 1..12: note = anti-HIV_CDR
GAINSSPSYFDS

SEQ ID NO: 6134 - protein, 12 aa, synthetic construct
  REGION 1..12: note = anti-HIV_CDR
WVVTAAEEYFDY

SEQ ID NO: 6135 - protein, 13 aa, synthetic construct
  REGION 1..13: note = anti-HIV_CDR
DPQVEVRGNAFDI

SEQ ID NO: 6136 - protein, 13 aa, synthetic construct
  REGION 1..13: note = anti-HIV_CDR
DHGDPRTGYYFDY

SEQ ID NO: 6137 - protein, 13 aa, synthetic construct
  REGION 1..13: note = anti-HIV_CDR
DESGYDLNWHLDS

SEQ ID NO: 6138 - protein, 13 aa, synthetic construct
  REGION 1..13: note = anti-HIV_CDR
DGSGDDRNWHLDP

SEQ ID NO: 6139 - protein, 13 aa, synthetic construct
  REGION 1..13: note = anti-HIV_CDR
DRRDDGLDWLLDP

SEQ ID NO: 6140 - protein, 13 aa, synthetic construct
  REGION 1..13: note = anti-HIV_CDR
DGGGDDRTWLLDA

SEQ ID NO: 6141 - protein, 13 aa, synthetic construct
  REGION 1..13: note = anti-HIV_CDR
DGSGDARDWHLHP

SEQ ID NO: 6142 - protein, 13 aa, synthetic construct
  REGION 1..13: note = anti-HIV_CDR
DGSGDDTSWYLDP

SEQ ID NO: 6143 - protein, 13 aa, synthetic construct
  REGION 1..13: note = anti-HIV_CDR
DGSGDDTSWHLDP

SEQ ID NO: 6144 - protein, 13 aa, synthetic construct
  REGION 1..13: note = anti-HIV_CDR
DRRDDDRAWLLDP

SEQ ID NO: 6145 - protein, 13 aa, synthetic construct
  REGION 1..13: note = anti-HIV_CDR
DGSGDARDWHLDP

SEQ ID NO: 6146 - protein, 13 aa, synthetic construct
  REGION 1..13: note = anti-HIV_CDR
DGSGDATSWHLHP

SEQ ID NO: 6147 - protein, 13 aa, synthetic construct
  REGION 1..13: note = anti-HIV_CDR
DESGDDLKWHLHP

SEQ ID NO: 6148 - protein, 13 aa, synthetic construct
  REGION 1..13: note = anti-HIV_CDR
DGSGDDTSWHLHP

SEQ ID NO: 6149 - protein, 13 aa, synthetic construct
  REGION 1..13: note = anti-HIV_CDR
AQGDILTEGYFDY

SEQ ID NO: 6150 - protein, 13 aa, synthetic construct
  REGION 1..13: note = anti-HIV_CDR
DRMFWQQLAKYDS

SEQ ID NO: 6151 - protein, 13 aa, synthetic construct
  REGION 1..13: note = anti-HIV_CDR
STWDYSLSAHEDV

SEQ ID NO: 6152 - protein, 13 aa, synthetic construct
  REGION 1..13: note = anti-HIV_CDR
AAWDDSLSGLNWV

SEQ ID NO: 6153 - protein, 13 aa, synthetic construct
  REGION 1..13: note = anti-HIV_CDR
LSSDRIVVVGPDY

SEQ ID NO: 6154 - protein, 13 aa, synthetic construct
  REGION 1..13: note = anti-HIV_CDR
EAGSVTATGPFDS

SEQ ID NO: 6155 - protein, 13 aa, synthetic construct
  REGION 1..13: note = anti-HIV_CDR
DFGRAYAIGYFEY

SEQ ID NO: 6156 - protein, 13 aa, synthetic construct
  REGION 1..13: note = anti-HIV_CDR
DRAPYGAFEPFDF

SEQ ID NO: 6157 - protein, 13 aa, synthetic construct
  REGION 1..13: note = anti-HIV_CDR
NGHSSLGGGYFPH

SEQ ID NO: 6158 - protein, 13 aa, synthetic construct
  REGION 1..13: note = anti-HIV_CDR
NGHSALGGEYFQH

SEQ ID NO: 6159 - protein, 13 aa, synthetic construct
  REGION 1..13: note = anti-HIV_CDR
AARRAFYYYYMDV

SEQ ID NO: 6160 - protein, 13 aa, synthetic construct
  REGION 1..13: note = anti-HIV_CDR
ANYYDSSGYGLDI

SEQ ID NO: 6161 - protein, 13 aa, synthetic construct
  REGION 1..13: note = anti-HIV_CDR
HSRPGAPPHYFDY

SEQ ID NO: 6162 - protein, 13 aa, synthetic construct
  REGION 1..13: note = anti-HIV_CDR
GLTVATLYDAFDV

SEQ ID NO: 6163 - protein, 13 aa, synthetic construct
  REGION 1..13: note = anti-HIV_CDR
RDRYNWKYYYLDV

SEQ ID NO: 6164 - protein, 13 aa, synthetic construct
  REGION 1..13: note = anti-HIV_CDR
DRGSSGWYGWLDP

SEQ ID NO: 6165 - protein, 13 aa, synthetic construct
  REGION 1..13: note = anti-HIV_CDR
DRLSSFWSGGIDQ

SEQ ID NO: 6166 - protein, 13 aa, synthetic construct
  REGION 1..13: note = anti-HIV_CDR
DVIVGALLGAFDI

SEQ ID NO: 6167 - protein, 13 aa, synthetic construct
  REGION 1..13: note = anti-HIV_CDR
HLIAPTAGNYFYP

SEQ ID NO: 6168 - protein, 13 aa, synthetic construct
  REGION 1..13: note = anti-HIV_CDR
DSRPQALVAALDV

SEQ ID NO: 6169 - protein, 13 aa, synthetic construct
  REGION 1..13: note = anti-HIV_CDR
DEIVGALLGAFDI

SEQ ID NO: 6170 - protein, 13 aa, synthetic construct
  REGION 1..13: note = anti-HIV_CDR
SDPAIAAAGSLDL

SEQ ID NO: 6171 - protein, 13 aa, synthetic construct
  REGION 1..13: note = anti-HIV_CDR
PYVQTVATTTFDF

SEQ ID NO: 6172 - protein, 13 aa, synthetic construct
  REGION 1..13: note = anti-HIV_CDR
GPKSVASLSYFDK

SEQ ID NO: 6173 - protein, 13 aa, synthetic construct
  REGION 1..13: note = anti-HIV_CDR
GALWFGQLRGLDP

SEQ ID NO: 6174 - protein, 13 aa, synthetic construct
  REGION 1..13: note = anti-HIV_CDR
DLRPMRGNWAMHV

SEQ ID NO: 6175 - protein, 13 aa, synthetic construct
  REGION 1..13: note = anti-HIV_CDR
DPQVNRRGNCFDH

SEQ ID NO: 6176 - protein, 13 aa, synthetic construct
  REGION 1..13: note = anti-HIV_CDR
DPQIEIRGNAFDI

SEQ ID NO: 6177 - protein, 13 aa, synthetic construct
  REGION 1..13: note = anti-HIV_CDR
VPRTTATRNAFDI

SEQ ID NO: 6178 - protein, 13 aa, synthetic construct
  REGION 1..13: note = anti-HIV_CDR
HKSVLLWFRELDY

SEQ ID NO: 6179 - protein, 13 aa, synthetic construct
  REGION 1..13: note = anti-HIV_CDR
DSEDYVDYYYMDV

SEQ ID NO: 6180 - protein, 13 aa, synthetic construct
  REGION 1..13: note = anti-HIV_CDR
LPRTTGIRNAFDI

SEQ ID NO: 6181 - protein, 13 aa, synthetic construct
  REGION 1..13: note = anti-HIV_CDR
LPRTTGIRNAFDF

SEQ ID NO: 6182 - protein, 14 aa, synthetic construct
  REGION 1..14: note = anti-HIV_CDR
GTLWFGESGLRLDH

SEQ ID NO: 6183 - protein, 14 aa, synthetic construct
  REGION 1..14: note = anti-HIV_CDR
VAYVHVVTTRSLDN

SEQ ID NO: 6184 - protein, 14 aa, synthetic construct
  REGION 1..14: note = anti-HIV_CDR
ADYDLLTSSYHFDS

SEQ ID NO: 6185 - protein, 14 aa, synthetic construct
  REGION 1..14: note = anti-HIV_CDR
TRCFGANCFNFMDV

SEQ ID NO: 6186 - protein, 14 aa, synthetic construct
  REGION 1..14: note = anti-HIV_CDR
GGLYCSSISCIMDV

SEQ ID NO: 6187 - protein, 14 aa, synthetic construct
  REGION 1..14: note = anti-HIV_CDR
NEPQYHSLPGMFDY

SEQ ID NO: 6188 - protein, 14 aa, synthetic construct
  REGION 1..14: note = anti-HIV_CDR
EPREMGTLTAGFEY

SEQ ID NO: 6189 - protein, 14 aa, synthetic construct
  REGION 1..14: note = anti-HIV_CDR
ATGYSYGYLDAFDI

SEQ ID NO: 6190 - protein, 14 aa, synthetic construct
  REGION 1..14: note = anti-HIV_CDR
GSLWFGESGLRLDH

SEQ ID NO: 6191 - protein, 14 aa, synthetic construct
  REGION 1..14: note = anti-HIV_CDR
DNTISGVVPRWFDY

SEQ ID NO: 6192 - protein, 14 aa, synthetic construct
  REGION 1..14: note = anti-HIV_CDR
IYDGRGYYSYFFDL

SEQ ID NO: 6193 - protein, 14 aa, synthetic construct
  REGION 1..14: note = anti-HIV_CDR
DRFNWNDGGYFFDS

SEQ ID NO: 6194 - protein, 14 aa, synthetic construct
  REGION 1..14: note = anti-HIV_CDR
GHSSSWTKFNWFGP

SEQ ID NO: 6195 - protein, 14 aa, synthetic construct
  REGION 1..14: note = anti-HIV_CDR
SIAADDYYYYYMDV

SEQ ID NO: 6196 - protein, 14 aa, synthetic construct
  REGION 1..14: note = anti-HIV_CDR
SFYDNGGYYLGLDY

SEQ ID NO: 6197 - protein, 14 aa, synthetic construct
  REGION 1..14: note = anti-HIV_CDR
DKDASIYGYRILNH

SEQ ID NO: 6198 - protein, 14 aa, synthetic construct
  REGION 1..14: note = anti-HIV_CDR
VLTDLDQGNPRMDV

SEQ ID NO: 6199 - protein, 14 aa, synthetic construct
  REGION 1..14: note = anti-HIV_CDR
REIKFGELSFYFDS

SEQ ID NO: 6200 - protein, 14 aa, synthetic construct
  REGION 1..14: note = anti-HIV_CDR
REIRFGELSFYFDY

SEQ ID NO: 6201 - protein, 14 aa, synthetic construct
  REGION 1..14: note = anti-HIV_CDR
PHSPTNIPSRPLDY

SEQ ID NO: 6202 - protein, 14 aa, synthetic construct
  REGION 1..14: note = anti-HIV_CDR
GDYDILTSSYQFDY

SEQ ID NO: 6203 - protein, 14 aa, synthetic construct
  REGION 1..14: note = anti-HIV_CDR
STPLVWPPANGLDV

SEQ ID NO: 6204 - protein, 14 aa, synthetic construct
  REGION 1..14: note = anti-HIV_CDR
TRNTGNSLPYWFDL

SEQ ID NO: 6205 - protein, 15 aa, synthetic construct
  REGION 1..15: note = anti-HIV_CDR
EKGQWLTVPPYYFDS

SEQ ID NO: 6206 - protein, 15 aa, synthetic construct
  REGION 1..15: note = anti-HIV_CDR
GSGRWTIGARIYFDN

SEQ ID NO: 6207 - protein, 15 aa, synthetic construct
  REGION 1..15: note = anti-HIV_CDR
LEADGADYSPKMFDF

SEQ ID NO: 6208 - protein, 15 aa, synthetic construct
  REGION 1..15: note = anti-HIV_CDR
LEADGGDYSPKMFDY

SEQ ID NO: 6209 - protein, 15 aa, synthetic construct
  REGION 1..15: note = anti-HIV_CDR
LEADGDNYSPKMVDY

SEQ ID NO: 6210 - protein, 15 aa, synthetic construct
  REGION 1..15: note = anti-HIV_CDR
LEADGDDYSPKMFDY

SEQ ID NO: 6211 - protein, 15 aa, synthetic construct
  REGION 1..15: note = anti-HIV_CDR
LEADGSDYSPKMFDF

SEQ ID NO: 6212 - protein, 15 aa, synthetic construct
  REGION 1..15: note = anti-HIV_CDR
LEADGDDYSPKMFDH

SEQ ID NO: 6213 - protein, 15 aa, synthetic construct
  REGION 1..15: note = anti-HIV_CDR
LEADGDDYSPKMVDY

SEQ ID NO: 6214 - protein, 15 aa, synthetic construct
  REGION 1..15: note = anti-HIV_CDR
APRLDLGELSSGFHF

SEQ ID NO: 6215 - protein, 15 aa, synthetic construct
  REGION 1..15: note = anti-HIV_CDR
APRLELGELSSGFHY

SEQ ID NO: 6216 - protein, 15 aa, synthetic construct
  REGION 1..15: note = anti-HIV_CDR
GRLLMQWPPRGGFDP

SEQ ID NO: 6217 - protein, 15 aa, synthetic construct
  REGION 1..15: note = anti-HIV_CDR
GRLFMQWPPRGGFDP

SEQ ID NO: 6218 - protein, 15 aa, synthetic construct
  REGION 1..15: note = anti-HIV_CDR
GRLFVQWPPQGGFDP

SEQ ID NO: 6219 - protein, 15 aa, synthetic construct
  REGION 1..15: note = anti-HIV_CDR
GRLFMQWPPQGGFDP

SEQ ID NO: 6220 - protein, 15 aa, synthetic construct
  REGION 1..15: note = anti-HIV_CDR
GRLFVQWPPQGGFDT

SEQ ID NO: 6221 - protein, 15 aa, synthetic construct
  REGION 1..15: note = anti-HIV_CDR
NNNTRKSINIGPGRA

SEQ ID NO: 6222 - protein, 15 aa, synthetic construct
  REGION 1..15: note = anti-HIV_CDR
PGYCNNNICTHWFDT

SEQ ID NO: 6223 - protein, 15 aa, synthetic construct
  REGION 1..15: note = anti-HIV_CDR
DLLPDYPVSSAPEDF

SEQ ID NO: 6224 - protein, 15 aa, synthetic construct
  REGION 1..15: note = anti-HIV_CDR
ESWLYSNGDYYYMDV

SEQ ID NO: 6225 - protein, 15 aa, synthetic construct
  REGION 1..15: note = anti-HIV_CDR
RYCSSTTCYRGHFDY

SEQ ID NO: 6226 - protein, 15 aa, synthetic construct
  REGION 1..15: note = anti-HIV_CDR
QTTDEGRQWLVGFQH

SEQ ID NO: 6227 - protein, 15 aa, synthetic construct
  REGION 1..15: note = anti-HIV_CDR
PSYGGYDDQGWYFEY

SEQ ID NO: 6228 - protein, 15 aa, synthetic construct
  REGION 1..15: note = anti-HIV_CDR
AAIPIGDSKYSYFDS

SEQ ID NO: 6229 - protein, 15 aa, synthetic construct
  REGION 1..15: note = anti-HIV_CDR
APPPGSTEWAYYFDY

SEQ ID NO: 6230 - protein, 15 aa, synthetic construct
  REGION 1..15: note = anti-HIV_CDR
AQFHNSGYYYSGLDY

SEQ ID NO: 6231 - protein, 15 aa, synthetic construct
  REGION 1..15: note = anti-HIV_CDR
GGYDYGDHYYYYMDV

SEQ ID NO: 6232 - protein, 15 aa, synthetic construct
  REGION 1..15: note = anti-HIV_CDR
GTQSYSAVAPGWFDP

SEQ ID NO: 6233 - protein, 15 aa, synthetic construct
  REGION 1..15: note = anti-HIV_CDR
IKGPPRGNFGVAFYF

SEQ ID NO: 6234 - protein, 15 aa, synthetic construct
  REGION 1..15: note = anti-HIV_CDR
KVYSDGWSPPTGFVY

SEQ ID NO: 6235 - protein, 15 aa, synthetic construct
  REGION 1..15: note = anti-HIV_CDR
RYKYLPGDQHMPWDN

SEQ ID NO: 6236 - protein, 15 aa, synthetic construct
  REGION 1..15: note = anti-HIV_CDR
RYKYLPGDQHMPWDY

SEQ ID NO: 6237 - protein, 15 aa, synthetic construct
  REGION 1..15: note = anti-HIV_CDR
GGGYAVVGPKYGLDV

SEQ ID NO: 6238 - protein, 15 aa, synthetic construct
  REGION 1..15: note = anti-HIV_CDR
LDSSSGWEEVGYFDR

SEQ ID NO: 6239 - protein, 15 aa, synthetic construct
  REGION 1..15: note = anti-HIV_CDR
ENYSDGWEEVGHFDY

SEQ ID NO: 6240 - protein, 15 aa, synthetic construct
  REGION 1..15: note = anti-HIV_CDR
ENYSDGWEEVGHFDS

SEQ ID NO: 6241 - protein, 15 aa, synthetic construct
  REGION 1..15: note = anti-HIV_CDR
ENYSDGWNEVGHFDF

SEQ ID NO: 6242 - protein, 15 aa, synthetic construct
  REGION 1..15: note = anti-HIV_CDR
ENYSDGWYEVGHFDL

SEQ ID NO: 6243 - protein, 15 aa, synthetic construct
  REGION 1..15: note = anti-HIV_CDR
DRRRFLEWSLYGMDV

SEQ ID NO: 6244 - protein, 15 aa, synthetic construct
  REGION 1..15: note = anti-HIV_CDR
GPRVFFESSGYYFRD

SEQ ID NO: 6245 - protein, 15 aa, synthetic construct
  REGION 1..15: note = anti-HIV_CDR
GPRVLFESSGHYLRD

SEQ ID NO: 6246 - protein, 15 aa, synthetic construct
  REGION 1..15: note = anti-HIV_CDR
GPRVFFESSGYYFRN

SEQ ID NO: 6247 - protein, 15 aa, synthetic construct
  REGION 1..15: note = anti-HIV_CDR
EGGSLWFGGANWLDP

SEQ ID NO: 6248 - protein, 15 aa, synthetic construct
  REGION 1..15: note = anti-HIV_CDR
ADYDNIWDSRGGFDL

SEQ ID NO: 6249 - protein, 15 aa, synthetic construct
  REGION 1..15: note = anti-HIV_CDR
VGGTVWSGYSNYLDY

SEQ ID NO: 6250 - protein, 15 aa, synthetic construct
  REGION 1..15: note = anti-HIV_CDR
DNRDQWLVLRSWFDP

SEQ ID NO: 6251 - protein, 15 aa, synthetic construct
  REGION 1..15: note = anti-HIV_CDR
EKGQWVTLPPYYFDS

SEQ ID NO: 6252 - protein, 16 aa, synthetic construct
  REGION 1..16: note = anti-HIV_CDR
YFSDTDRSEYSPSLRS

SEQ ID NO: 6253 - protein, 16 aa, synthetic construct
  REGION 1..16: note = anti-HIV_CDR
YISDRESATYNPSLNS

SEQ ID NO: 6254 - protein, 16 aa, synthetic construct
  REGION 1..16: note = anti-HIV_CDR
YFSDTEKSNYNPSLRS

SEQ ID NO: 6255 - protein, 16 aa, synthetic construct
  REGION 1..16: note = anti-HIV_CDR
YISDRASATYNPSLNS

SEQ ID NO: 6256 - protein, 16 aa, synthetic construct
  REGION 1..16: note = anti-HIV_CDR
YVHHSGDTNYNPSLKR

SEQ ID NO: 6257 - protein, 16 aa, synthetic construct
  REGION 1..16: note = anti-HIV_CDR
YVHKSGDTNYSPSLKS

SEQ ID NO: 6258 - protein, 16 aa, synthetic construct
  REGION 1..16: note = anti-HIV_CDR
YVHDSGDTNYNPSLKS

SEQ ID NO: 6259 - protein, 16 aa, synthetic construct
  REGION 1..16: note = anti-HIV_CDR
YISKSESANYNPSLNS

SEQ ID NO: 6260 - protein, 16 aa, synthetic construct
  REGION 1..16: note = anti-HIV_CDR
YIYYSGSTNYNPSLKS

SEQ ID NO: 6261 - protein, 16 aa, synthetic construct
  REGION 1..16: note = anti-HIV_CDR
YVHDSGDINYNPSLKN

SEQ ID NO: 6262 - protein, 16 aa, synthetic construct
  REGION 1..16: note = anti-HIV_CDR
SYYDFSIGDGNDAFDV

SEQ ID NO: 6263 - protein, 16 aa, synthetic construct
  REGION 1..16: note = anti-HIV_CDR
GFRGSPFSSGSLYFDS

SEQ ID NO: 6264 - protein, 16 aa, synthetic construct
  REGION 1..16: note = anti-HIV_CDR
VISGRITIFYYNYIDV

SEQ ID NO: 6265 - protein, 16 aa, synthetic construct
  REGION 1..16: note = anti-HIV_CDR
DGLGEVAPDYRYGIDV

SEQ ID NO: 6266 - protein, 16 aa, synthetic construct
  REGION 1..16: note = anti-HIV_CDR
DGLGELAPAYQYGIDV

SEQ ID NO: 6267 - protein, 16 aa, synthetic construct
  REGION 1..16: note = anti-HIV_CDR
DGLGELAPAYHYGIDV

SEQ ID NO: 6268 - protein, 16 aa, synthetic construct
  REGION 1..16: note = anti-HIV_CDR
DGLGEVAPAYLYGIDA

SEQ ID NO: 6269 - protein, 16 aa, synthetic construct
  REGION 1..16: note = anti-HIV_CDR
AVKGFWFDEVYNWFGP

SEQ ID NO: 6270 - protein, 16 aa, synthetic construct
  REGION 1..16: note = anti-HIV_CDR
AVKGFWFDDPYTWFGP

SEQ ID NO: 6271 - protein, 16 aa, synthetic construct
  REGION 1..16: note = anti-HIV_CDR
AVKGFWFDEPSTWFGP

SEQ ID NO: 6272 - protein, 16 aa, synthetic construct
  REGION 1..16: note = anti-HIV_CDR
AVKGLWFDETYTWFGP

SEQ ID NO: 6273 - protein, 16 aa, synthetic construct
  REGION 1..16: note = anti-HIV_CDR
AVAGLWFEDAYNWFGP

SEQ ID NO: 6274 - protein, 16 aa, synthetic construct
  REGION 1..16: note = anti-HIV_CDR
AEAESQSHSRPIMFDY

SEQ ID NO: 6275 - protein, 16 aa, synthetic construct
  REGION 1..16: note = anti-HIV_CDR
AEAASDSHSRPIMFDH

SEQ ID NO: 6276 - protein, 16 aa, synthetic construct
  REGION 1..16: note = anti-HIV_CDR
LEAESDSHSRPIMFDH

SEQ ID NO: 6277 - protein, 16 aa, synthetic construct
  REGION 1..16: note = anti-HIV_CDR
AEAESQSHSRPIMFDS

SEQ ID NO: 6278 - protein, 16 aa, synthetic construct
  REGION 1..16: note = anti-HIV_CDR
AEAESQSHSRPIMFDF

SEQ ID NO: 6279 - protein, 16 aa, synthetic construct
  REGION 1..16: note = anti-HIV_CDR
DNPLLQSGEFSSSLEN

SEQ ID NO: 6280 - protein, 16 aa, synthetic construct
  REGION 1..16: note = anti-HIV_CDR
DNPLLQSGEFSSSLDN

SEQ ID NO: 6281 - protein, 16 aa, synthetic construct
  REGION 1..16: note = anti-HIV_CDR
GRDYNFWGGGGKINFP

SEQ ID NO: 6282 - protein, 16 aa, synthetic construct
  REGION 1..16: note = anti-HIV_CDR
TNWANDFVTGYYRFDF

SEQ ID NO: 6283 - protein, 16 aa, synthetic construct
  REGION 1..16: note = anti-HIV_CDR
AGHCSSTSSVYCPFDM

SEQ ID NO: 6284 - protein, 16 aa, synthetic construct
  REGION 1..16: note = anti-HIV_CDR
QVSSYSSSGYRREFDY

SEQ ID NO: 6285 - protein, 16 aa, synthetic construct
  REGION 1..16: note = anti-HIV_CDR
RMATLTGGYYYYYMDV

SEQ ID NO: 6286 - protein, 16 aa, synthetic construct
  REGION 1..16: note = anti-HIV_CDR
EGGYSDFWSGYSGFDY

SEQ ID NO: 6287 - protein, 16 aa, synthetic construct
  REGION 1..16: note = anti-HIV_CDR
LYYNFGSGYDTGIGDH

SEQ ID NO: 6288 - protein, 16 aa, synthetic construct
  REGION 1..16: note = anti-HIV_CDR
AREGRWFSDNYYAMDV

SEQ ID NO: 6289 - protein, 16 aa, synthetic construct
  REGION 1..16: note = anti-HIV_CDR
DRVGRRLGELSAGFDY

SEQ ID NO: 6290 - protein, 16 aa, synthetic construct
  REGION 1..16: note = anti-HIV_CDR
ARPRSPWDSTGWSVGY

SEQ ID NO: 6291 - protein, 16 aa, synthetic construct
  REGION 1..16: note = anti-HIV_CDR
SYYDFRSDSGNDAFDI

SEQ ID NO: 6292 - protein, 16 aa, synthetic construct
  REGION 1..16: note = anti-HIV_CDR
SYYDFQTDSGNDAFDV

SEQ ID NO: 6293 - protein, 16 aa, synthetic construct
  REGION 1..16: note = anti-HIV_CDR
DNPVLQLGELSSSLDY

SEQ ID NO: 6294 - protein, 16 aa, synthetic construct
  REGION 1..16: note = anti-HIV_CDR
GFRGSPFSSGSMYFDS

SEQ ID NO: 6295 - protein, 16 aa, synthetic construct
  REGION 1..16: note = anti-HIV_CDR
GFRGSPLSSGSLYFDS

SEQ ID NO: 6296 - protein, 16 aa, synthetic construct
  REGION 1..16: note = anti-HIV_CDR
GFRGNVFSTGWFYLDF

SEQ ID NO: 6297 - protein, 16 aa, synthetic construct
  REGION 1..16: note = anti-HIV_CDR
DRLSFSVQVEQGVLDY

SEQ ID NO: 6298 - protein, 16 aa, synthetic construct
  REGION 1..16: note = anti-HIV_CDR
DRLSFSVQVEQGVLQF

SEQ ID NO: 6299 - protein, 16 aa, synthetic construct
  REGION 1..16: note = anti-HIV_CDR
VLSGRITIFYYYYMDV

SEQ ID NO: 6300 - protein, 17 aa, synthetic construct
  REGION 1..17: note = anti-HIV_CDR
YISSGSSTLHYADTVKG

SEQ ID NO: 6301 - protein, 17 aa, synthetic construct
  REGION 1..17: note = anti-HIV_CDR
RYLDWSPIGRDTYGTDV

SEQ ID NO: 6302 - protein, 17 aa, synthetic construct
  REGION 1..17: note = anti-HIV_CDR
RYFDWSPFRRDTYGTDV

SEQ ID NO: 6303 - protein, 17 aa, synthetic construct
  REGION 1..17: note = anti-HIV_CDR
GRDYNFWSGGGRYYFDF

SEQ ID NO: 6304 - protein, 17 aa, synthetic construct
  REGION 1..17: note = anti-HIV_CDR
GIQEDYDFWREYRELDY

SEQ ID NO: 6305 - protein, 17 aa, synthetic construct
  REGION 1..17: note = anti-HIV_CDR
VLNNNTRKSINIGPGRA

SEQ ID NO: 6306 - protein, 17 aa, synthetic construct
  REGION 1..17: note = anti-HIV_CDR
DLNFGVVTPYYYYYLDV

SEQ ID NO: 6307 - protein, 17 aa, synthetic construct
  REGION 1..17: note = anti-HIV_CDR
HGRTVFGVVRNYYYMDV

SEQ ID NO: 6308 - protein, 17 aa, synthetic construct
  REGION 1..17: note = anti-HIV_CDR
HYYGSGLTKDYYEYIDV

SEQ ID NO: 6309 - protein, 17 aa, synthetic construct
  REGION 1..17: note = anti-HIV_CDR
TYYNFWSDQSQGLDFDY

SEQ ID NO: 6310 - protein, 17 aa, synthetic construct
  REGION 1..17: note = anti-HIV_CDR
GVWEAPDGSSYYYYMAD

SEQ ID NO: 6311 - protein, 17 aa, synthetic construct
  REGION 1..17: note = anti-HIV_CDR
DQGGYPVSPVGPKWFDP

SEQ ID NO: 6312 - protein, 17 aa, synthetic construct
  REGION 1..17: note = anti-HIV_CDR
RDKYQYIDSSGDYPFDR

SEQ ID NO: 6313 - protein, 17 aa, synthetic construct
  REGION 1..17: note = anti-HIV_CDR
QLRAPTTRFRHGGYFEN

SEQ ID NO: 6314 - protein, 17 aa, synthetic construct
  REGION 1..17: note = anti-HIV_CDR
QVRAPTLRFRHGGYFET

SEQ ID NO: 6315 - protein, 17 aa, synthetic construct
  REGION 1..17: note = anti-HIV_CDR
VSITYAGLIVVPGAFDV

SEQ ID NO: 6316 - protein, 17 aa, synthetic construct
  REGION 1..17: note = anti-HIV_CDR
VAISYAGLIVVPGPFDV

SEQ ID NO: 6317 - protein, 17 aa, synthetic construct
  REGION 1..17: note = anti-HIV_CDR
SLTGRLHLGELSSGIGP

SEQ ID NO: 6318 - protein, 17 aa, synthetic construct
  REGION 1..17: note = anti-HIV_CDR
GGSALITIFGVDPKFDP

SEQ ID NO: 6319 - protein, 17 aa, synthetic construct
  REGION 1..17: note = anti-HIV_CDR
MALTSGPYDVSGYYFDY

SEQ ID NO: 6320 - protein, 17 aa, synthetic construct
  REGION 1..17: note = anti-HIV_CDR
MALASGPYDVSGYYFDY

SEQ ID NO: 6321 - protein, 17 aa, synthetic construct
  REGION 1..17: note = anti-HIV_CDR
MALPSGPLDRSGYYFDD

SEQ ID NO: 6322 - protein, 18 aa, synthetic construct
  REGION 1..18: note = anti-HIV_CDR
VVPMFSIFGVVKANYFDY

SEQ ID NO: 6323 - protein, 18 aa, synthetic construct
  REGION 1..18: note = anti-HIV_CDR
NRRVAMPEAMILSFYMDV

SEQ ID NO: 6324 - protein, 18 aa, synthetic construct
  REGION 1..18: note = anti-HIV_CDR
GLCRGGNCRLGPSGWLDP

SEQ ID NO: 6325 - protein, 18 aa, synthetic construct
  REGION 1..18: note = anti-HIV_CDR
TPPHYDVLTGYPSSVLEF

SEQ ID NO: 6326 - protein, 18 aa, synthetic construct
  REGION 1..18: note = anti-HIV_CDR
IPYHSESYYKVVIGGFDV

SEQ ID NO: 6327 - protein, 18 aa, synthetic construct
  REGION 1..18: note = anti-HIV_CDR
ADPFKVAQDEGLFVIFDY

SEQ ID NO: 6328 - protein, 18 aa, synthetic construct
  REGION 1..18: note = anti-HIV_CDR
ADPFKVAQDEGLYVIFDY

SEQ ID NO: 6329 - protein, 18 aa, synthetic construct
  REGION 1..18: note = anti-HIV_CDR
ADRFKVAQDEGLFVIFDY

SEQ ID NO: 6330 - protein, 18 aa, synthetic construct
  REGION 1..18: note = anti-HIV_CDR
GRQTFRAIWSGPPAVFDI

SEQ ID NO: 6331 - protein, 18 aa, synthetic construct
  REGION 1..18: note = anti-HIV_CDR
GRQTFRAIWSGPPVVFDI

SEQ ID NO: 6332 - protein, 18 aa, synthetic construct
  REGION 1..18: note = anti-HIV_CDR
SRGDYNFWSGYPEYHFDR

SEQ ID NO: 6333 - protein, 18 aa, synthetic construct
  REGION 1..18: note = anti-HIV_CDR
LPKSRMVGGDHLPFYPDF

SEQ ID NO: 6334 - protein, 18 aa, synthetic construct
  REGION 1..18: note = anti-HIV_CDR
LTGPSGYCDSSGCYWFDP

SEQ ID NO: 6335 - protein, 18 aa, synthetic construct
  REGION 1..18: note = anti-HIV_CDR
GGSMIRGVPSPFYYGMDV

SEQ ID NO: 6336 - protein, 18 aa, synthetic construct
  REGION 1..18: note = anti-HIV_CDR
LFGAKRLGVAPSGYYMDV

SEQ ID NO: 6337 - protein, 18 aa, synthetic construct
  REGION 1..18: note = anti-HIV_CDR
DRYEAAWFGADKVYGMDV

SEQ ID NO: 6338 - protein, 18 aa, synthetic construct
  REGION 1..18: note = anti-HIV_CDR
EHRLPPPTGRRTRNWFDP

SEQ ID NO: 6339 - protein, 18 aa, synthetic construct
  REGION 1..18: note = anti-HIV_CDR
GRGSFQGFQQYEYYGMDV

SEQ ID NO: 6340 - protein, 18 aa, synthetic construct
  REGION 1..18: note = anti-HIV_CDR
GRGYSHGFQQYNYYGMDV

SEQ ID NO: 6341 - protein, 18 aa, synthetic construct
  REGION 1..18: note = anti-HIV_CDR
GRGSFTGFDQYHYYGMDV

SEQ ID NO: 6342 - protein, 18 aa, synthetic construct
  REGION 1..18: note = anti-HIV_CDR
GRGSTFPSAQFSYFGLDV

SEQ ID NO: 6343 - protein, 18 aa, synthetic construct
  REGION 1..18: note = anti-HIV_CDR
DLARYGVTSIVPEFGFDF

SEQ ID NO: 6344 - protein, 18 aa, synthetic construct
  REGION 1..18: note = anti-HIV_CDR
RGRLNIPSPSAILTAFDV

SEQ ID NO: 6345 - protein, 18 aa, synthetic construct
  REGION 1..18: note = anti-HIV_CDR
GPGSMVRGLIVTSYGMDV

SEQ ID NO: 6346 - protein, 18 aa, synthetic construct
  REGION 1..18: note = anti-HIV_CDR
KRVTIFGVVDTPRGYFDY

SEQ ID NO: 6347 - protein, 18 aa, synthetic construct
  REGION 1..18: note = anti-HIV_CDR
GQRNVLHFLERKNDAFDI

SEQ ID NO: 6348 - protein, 18 aa, synthetic construct
  REGION 1..18: note = anti-HIV_CDR
EQKDYDFWNGLYKYGMDV

SEQ ID NO: 6349 - protein, 19 aa, synthetic construct
  REGION 1..19: note = anti-HIV_CDR
DTTTFTTFGGGPNMGGFDP

SEQ ID NO: 6350 - protein, 19 aa, synthetic construct
  REGION 1..19: note = anti-HIV_CDR
AGLDYNFWNGKGRKGAFDV

SEQ ID NO: 6351 - protein, 19 aa, synthetic construct
  REGION 1..19: note = anti-HIV_CDR
NEADYHDGNGHSLRGMFDY

SEQ ID NO: 6352 - protein, 19 aa, synthetic construct
  REGION 1..19: note = anti-HIV_CDR
NEPQYHDGNGHSLPGMFDS

SEQ ID NO: 6353 - protein, 19 aa, synthetic construct
  REGION 1..19: note = anti-HIV_CDR
NEPQYHDDNGHSLPGMIDY

SEQ ID NO: 6354 - protein, 19 aa, synthetic construct
  REGION 1..19: note = anti-HIV_CDR
NEPQYHDGNGHSLPGMFDF

SEQ ID NO: 6355 - protein, 19 aa, synthetic construct
  REGION 1..19: note = anti-HIV_CDR
NEPQYFDGSGHSLPGMFDY

SEQ ID NO: 6356 - protein, 19 aa, synthetic construct
  REGION 1..19: note = anti-HIV_CDR
READYHDGNGHTLPGMFDF

SEQ ID NO: 6357 - protein, 19 aa, synthetic construct
  REGION 1..19: note = anti-HIV_CDR
NEPQYYDGSGHSLPGMFDY

SEQ ID NO: 6358 - protein, 19 aa, synthetic construct
  REGION 1..19: note = anti-HIV_CDR
NEPQYHDGNGHSLPGMFDY

SEQ ID NO: 6359 - protein, 19 aa, synthetic construct
  REGION 1..19: note = anti-HIV_CDR
QDSDFHDGHGHTLRGMFDS

SEQ ID NO: 6360 - protein, 19 aa, synthetic construct
  REGION 1..19: note = anti-HIV_CDR
LDWVRGVMNLVENHYAMDV

SEQ ID NO: 6361 - protein, 19 aa, synthetic construct
  REGION 1..19: note = anti-HIV_CDR
TNGTEIFRPGGGDMRDNWR

SEQ ID NO: 6362 - protein, 19 aa, synthetic construct
  REGION 1..19: note = anti-HIV_CDR
DGRYSGDDQYYYHYYYMDV

SEQ ID NO: 6363 - protein, 19 aa, synthetic construct
  REGION 1..19: note = anti-HIV_CDR
LTKNPSQDFWGSYLYYFED

SEQ ID NO: 6364 - protein, 19 aa, synthetic construct
  REGION 1..19: note = anti-HIV_CDR
GATYYYDSSGHQSRRAFDI

SEQ ID NO: 6365 - protein, 19 aa, synthetic construct
  REGION 1..19: note = anti-HIV_CDR
AFQASMVRGVIVDPYGMDV

SEQ ID NO: 6366 - protein, 19 aa, synthetic construct
  REGION 1..19: note = anti-HIV_CDR
HRADYDFWNGSNLRGYFDP

SEQ ID NO: 6367 - protein, 19 aa, synthetic construct
  REGION 1..19: note = anti-HIV_CDR
HRANYDFWGGSNLRGYFDP

SEQ ID NO: 6368 - protein, 19 aa, synthetic construct
  REGION 1..19: note = anti-HIV_CDR
GFHFWSGTGTRPRNWYFDL

SEQ ID NO: 6369 - protein, 19 aa, synthetic construct
  REGION 1..19: note = anti-HIV_CDR
NYLIESRYDEKDYYYAMDV

SEQ ID NO: 6370 - protein, 19 aa, synthetic construct
  REGION 1..19: note = anti-HIV_CDR
SRGYAYDSGGHYFPTWFDP

SEQ ID NO: 6371 - protein, 19 aa, synthetic construct
  REGION 1..19: note = anti-HIV_CDR
DTTTFGAFGGSPNMGGLDP

SEQ ID NO: 6372 - protein, 19 aa, synthetic construct
  REGION 1..19: note = anti-HIV_CDR
HLVVAVAAGPDYFSYGMDV

SEQ ID NO: 6373 - protein, 19 aa, synthetic construct
  REGION 1..19: note = anti-HIV_CDR
DTTTFSSFGSPPNMGGLDP

SEQ ID NO: 6374 - protein, 19 aa, synthetic construct
  REGION 1..19: note = anti-HIV_CDR
DTTTFGAFGGGANMGGLDP

SEQ ID NO: 6375 - protein, 19 aa, synthetic construct
  REGION 1..19: note = anti-HIV_CDR
DTTTFTSFGSPPRMGGLDP

SEQ ID NO: 6376 - protein, 19 aa, synthetic construct
  REGION 1..19: note = anti-HIV_CDR
DTTTFSSFGSPPHMGGLDP

SEQ ID NO: 6377 - protein, 19 aa, synthetic construct
  REGION 1..19: note = anti-HIV_CDR
DRVSDYDFWSGKRGYGMDV

SEQ ID NO: 6378 - protein, 19 aa, synthetic construct
  REGION 1..19: note = anti-HIV_CDR
ELSGEYHFWSGTYRYGVDV

SEQ ID NO: 6379 - protein, 19 aa, synthetic construct
  REGION 1..19: note = anti-HIV_CDR
HGASENYGPGSYSAEHFQH

SEQ ID NO: 6380 - protein, 19 aa, synthetic construct
  REGION 1..19: note = anti-HIV_CDR
HGASANYGPGSYSAEHFQH

SEQ ID NO: 6381 - protein, 20 aa, synthetic construct
  REGION 1..20: note = anti-HIV_CDR
HEAPRYSYAFRRYYHYGLDV

SEQ ID NO: 6382 - protein, 20 aa, synthetic construct
  REGION 1..20: note = anti-HIV_CDR
TSTYDQWSGLHHDGVMAFSS

SEQ ID NO: 6383 - protein, 20 aa, synthetic construct
  REGION 1..20: note = anti-HIV_CDR
GEFDSSGFDYESWYPYYMDV

SEQ ID NO: 6384 - protein, 20 aa, synthetic construct
  REGION 1..20: note = anti-HIV_CDR
GQTDLNDDFWSEYSTPGFDY

SEQ ID NO: 6385 - protein, 20 aa, synthetic construct
  REGION 1..20: note = anti-HIV_CDR
GQTDLNDDLWSDYSTPGFDY

SEQ ID NO: 6386 - protein, 20 aa, synthetic construct
  REGION 1..20: note = anti-HIV_CDR
NLIEESQTQQEINERDLLAL

SEQ ID NO: 6387 - protein, 20 aa, synthetic construct
  REGION 1..20: note = anti-HIV_CDR
NLIEESQIQQEKNEKELLEL

SEQ ID NO: 6388 - protein, 20 aa, synthetic construct
  REGION 1..20: note = anti-HIV_CDR
SLIENSQIQQEKNEQDLLQL

SEQ ID NO: 6389 - protein, 20 aa, synthetic construct
  REGION 1..20: note = anti-HIV_CDR
SLIEESQIQQEKNEKELLEL

SEQ ID NO: 6390 - protein, 20 aa, synthetic construct
  REGION 1..20: note = anti-HIV_CDR
RLIEESQTQQEKNEQELLEL

SEQ ID NO: 6391 - protein, 20 aa, synthetic construct
  REGION 1..20: note = anti-HIV_CDR
SLIEESQTQQEKNEKELLEL

SEQ ID NO: 6392 - protein, 20 aa, synthetic construct
  REGION 1..20: note = anti-HIV_CDR
NLLEESQNQQEKNEQELLEL

SEQ ID NO: 6393 - protein, 20 aa, synthetic construct
  REGION 1..20: note = anti-HIV_CDR
TLIEESQNQQEKNELELLEL

SEQ ID NO: 6394 - protein, 20 aa, synthetic construct
  REGION 1..20: note = anti-HIV_CDR
TLQEESQNQQEKNEQELLEL

SEQ ID NO: 6395 - protein, 20 aa, synthetic construct
  REGION 1..20: note = anti-HIV_CDR
SLLEESQNQQEKNEQELLEL

SEQ ID NO: 6396 - protein, 20 aa, synthetic construct
  REGION 1..20: note = anti-HIV_CDR
TLIEESQNQQEKNQQELLQL

SEQ ID NO: 6397 - protein, 20 aa, synthetic construct
  REGION 1..20: note = anti-HIV_CDR
TLIEESQNQQEKNEQELLGL

SEQ ID NO: 6398 - protein, 20 aa, synthetic construct
  REGION 1..20: note = anti-HIV_CDR
TLIEESQNQQEKNEQELLEL

SEQ ID NO: 6399 - protein, 20 aa, synthetic construct
  REGION 1..20: note = anti-HIV_CDR
SLIEDSQIQQEKNEKELLEL

SEQ ID NO: 6400 - protein, 20 aa, synthetic construct
  REGION 1..20: note = anti-HIV_CDR
SLLEKSQTQQEKNEQELLEL

SEQ ID NO: 6401 - protein, 20 aa, synthetic construct
  REGION 1..20: note = anti-HIV_CDR
SLIEESQNQQEKNEQELLEL

SEQ ID NO: 6402 - protein, 20 aa, synthetic construct
  REGION 1..20: note = anti-HIV_CDR
GDLLGYTDSWYEFDYYYMDV

SEQ ID NO: 6403 - protein, 20 aa, synthetic construct
  REGION 1..20: note = anti-HIV_CDR
DTNGTEIFRPGGGDMRDNWR

SEQ ID NO: 6404 - protein, 20 aa, synthetic construct
  REGION 1..20: note = anti-HIV_CDR
DVVERPGFGDFRYDYYGMDV

SEQ ID NO: 6405 - protein, 20 aa, synthetic construct
  REGION 1..20: note = anti-HIV_CDR
DQRDCSTNRCFGVFGYYMDV

SEQ ID NO: 6406 - protein, 20 aa, synthetic construct
  REGION 1..20: note = anti-HIV_CDR
DRWVRPQFPSMDFQYNGLDV

SEQ ID NO: 6407 - protein, 20 aa, synthetic construct
  REGION 1..20: note = anti-HIV_CDR
DSGFDLDYYDTNELYFGFDY

SEQ ID NO: 6408 - protein, 20 aa, synthetic construct
  REGION 1..20: note = anti-HIV_CDR
KYPAYYDILTANYRSYYFDY

SEQ ID NO: 6409 - protein, 20 aa, synthetic construct
  REGION 1..20: note = anti-HIV_CDR
KYPAYYDILTGYYRNYYFDY

SEQ ID NO: 6410 - protein, 20 aa, synthetic construct
  REGION 1..20: note = anti-HIV_CDR
RVKFPLWFGETTYYYYGMDV

SEQ ID NO: 6411 - protein, 20 aa, synthetic construct
  REGION 1..20: note = anti-HIV_CDR
ERSTKYSFWSAVMRPDAFDL

SEQ ID NO: 6412 - protein, 20 aa, synthetic construct
  REGION 1..20: note = anti-HIV_CDR
HEAPRYSYAFRNYYHYGLDV

SEQ ID NO: 6413 - protein, 20 aa, synthetic construct
  REGION 1..20: note = anti-HIV_CDR
ENVLMESDDYNDYYYYYMDV

SEQ ID NO: 6414 - protein, 20 aa, synthetic construct
  REGION 1..20: note = anti-HIV_CDR
ERVLVFPDQDADYYYYFFDV

SEQ ID NO: 6415 - protein, 20 aa, synthetic construct
  REGION 1..20: note = anti-HIV_CDR
ERVLVVPDQDADYYYYFFDV

SEQ ID NO: 6416 - protein, 21 aa, synthetic construct
  REGION 1..21: note = anti-HIV_CDR
DRSSAIGYCSSISCYKGSFDI

SEQ ID NO: 6417 - protein, 21 aa, synthetic construct
  REGION 1..21: note = anti-HIV_CDR
VVKIEPLGVAPTKAKRVAREK

SEQ ID NO: 6418 - protein, 21 aa, synthetic construct
  REGION 1..21: note = anti-HIV_CDR
VVRIEPLGVAPTKAKRVEREK

SEQ ID NO: 6419 - protein, 21 aa, synthetic construct
  REGION 1..21: note = anti-HIV_CDR
VVRIEPLGIAPTRAKRVEREK

SEQ ID NO: 6420 - protein, 21 aa, synthetic construct
  REGION 1..21: note = anti-HIV_CDR
VVKIEPIGVAPTKARRVEREK

SEQ ID NO: 6421 - protein, 21 aa, synthetic construct
  REGION 1..21: note = anti-HIV_CDR
VVKIEPLGVAPTRAKRVEREK

SEQ ID NO: 6422 - protein, 21 aa, synthetic construct
  REGION 1..21: note = anti-HIV_CDR
VVQIEPLGVAPTRAKRVEREK

SEQ ID NO: 6423 - protein, 21 aa, synthetic construct
  REGION 1..21: note = anti-HIV_CDR
VVRIEPLGVAPTKAKRVQREK

SEQ ID NO: 6424 - protein, 21 aa, synthetic construct
  REGION 1..21: note = anti-HIV_CDR
VVKIEPLGVAPTKAKRVQRKK

SEQ ID NO: 6425 - protein, 21 aa, synthetic construct
  REGION 1..21: note = anti-HIV_CDR
VIKIEPLIVAPTKAKRVQREK

SEQ ID NO: 6426 - protein, 21 aa, synthetic construct
  REGION 1..21: note = anti-HIV_CDR
VVKIEPLGVAPTKARRVQREK

SEQ ID NO: 6427 - protein, 21 aa, synthetic construct
  REGION 1..21: note = anti-HIV_CDR
VVKIELLGVAPTKAKRVQREK

SEQ ID NO: 6428 - protein, 21 aa, synthetic construct
  REGION 1..21: note = anti-HIV_CDR
VVTIEPLGVAPTKAKRVQREK

SEQ ID NO: 6429 - protein, 21 aa, synthetic construct
  REGION 1..21: note = anti-HIV_CDR
VVKIEPLGVAPTKAKRVQREK

SEQ ID NO: 6430 - protein, 21 aa, synthetic construct
  REGION 1..21: note = anti-HIV_CDR
DLVSVSPPYGNYGPDNNWFDF

SEQ ID NO: 6431 - protein, 21 aa, synthetic construct
  REGION 1..21: note = anti-HIV_CDR
MNPPWFRGGSNNPYSYYYMDV

SEQ ID NO: 6432 - protein, 21 aa, synthetic construct
  REGION 1..21: note = anti-HIV_CDR
DWIGYDYDGSGSHLRDESFDI

SEQ ID NO: 6433 - protein, 21 aa, synthetic construct
  REGION 1..21: note = anti-HIV_CDR
CSIVGNGDFLEEDSHYPAMDV

SEQ ID NO: 6434 - protein, 21 aa, synthetic construct
  REGION 1..21: note = anti-HIV_CDR
DFVSIYGVAYFTGGGPSSPDI

SEQ ID NO: 6435 - protein, 22 aa, synthetic construct
  REGION 1..22: note = anti-HIV_CDR
KAKDYYYESSDYSPYYYYYMDV

SEQ ID NO: 6436 - protein, 22 aa, synthetic construct
  REGION 1..22: note = anti-HIV_CDR
DHGIKPDNYYDISGYNLDYFDY

SEQ ID NO: 6437 - protein, 22 aa, synthetic construct
  REGION 1..22: note = anti-HIV_CDR
GSLYDYRDNADLKPSYYYAMDV

SEQ ID NO: 6438 - protein, 22 aa, synthetic construct
  REGION 1..22: note = anti-HIV_CDR
DEASWVEAADEWDEHLFREMAV

SEQ ID NO: 6439 - protein, 22 aa, synthetic construct
  REGION 1..22: note = anti-HIV_CDR
DEVSWVEAADEWDEHLFREMAV

SEQ ID NO: 6440 - protein, 22 aa, synthetic construct
  REGION 1..22: note = anti-HIV_CDR
DEGSWVEAADEWDEHLFREMAV

SEQ ID NO: 6441 - protein, 22 aa, synthetic construct
  REGION 1..22: note = anti-HIV_CDR
DQRGRYSFGFVTGQTKVSAISD

SEQ ID NO: 6442 - protein, 22 aa, synthetic construct
  REGION 1..22: note = anti-HIV_CDR
DQLGRYSFGFVTGQNKVSAISD

SEQ ID NO: 6443 - protein, 22 aa, synthetic construct
  REGION 1..22: note = anti-HIV_CDR
DQVGRYSFGFATGQQRVSAISD

SEQ ID NO: 6444 - protein, 23 aa, synthetic construct
  REGION 1..23: note = anti-HIV_CDR
VVKIEPLGVAPTKAKRRVVQREK

SEQ ID NO: 6445 - protein, 23 aa, synthetic construct
  REGION 1..23: note = anti-HIV_CDR
RISSSSWYMVDNSHTLHFYYMDV

SEQ ID NO: 6446 - protein, 23 aa, synthetic construct
  REGION 1..23: note = anti-HIV_CDR
DKPAYDEYAEETIAPHNYHAMDL

SEQ ID NO: 6447 - protein, 23 aa, synthetic construct
  REGION 1..23: note = anti-HIV_CDR
QNIAARAAEKLYENDYYFYGMDV

SEQ ID NO: 6448 - protein, 23 aa, synthetic construct
  REGION 1..23: note = anti-HIV_CDR
QNIAARTAERLYENDYYFYGMDV

SEQ ID NO: 6449 - protein, 24 aa, synthetic construct
  REGION 1..24: note = anti-HIV_CDR
AQQGKRIYGIVSFGEFFYYYYMDA

SEQ ID NO: 6450 - protein, 24 aa, synthetic construct
  REGION 1..24: note = anti-HIV_CDR
TQQGKRIYGVVSFGEFFHYYYMDA

SEQ ID NO: 6451 - protein, 24 aa, synthetic construct
  REGION 1..24: note = anti-HIV_CDR
ARRGQRIYGVVSFGEFFYYYSMDV

SEQ ID NO: 6452 - protein, 24 aa, synthetic construct
  REGION 1..24: note = anti-HIV_CDR
TLHGRRIYGIVAFNEWFTYFYMDV

SEQ ID NO: 6453 - protein, 24 aa, synthetic construct
  REGION 1..24: note = anti-HIV_CDR
TKHGRRIYGIVAFNEWFTYFYMDV

SEQ ID NO: 6454 - protein, 24 aa, synthetic construct
  REGION 1..24: note = anti-HIV_CDR
ARHGQRIYGVVSFGEFFTYYSMDV

SEQ ID NO: 6455 - protein, 24 aa, synthetic construct
  REGION 1..24: note = anti-HIV_CDR
TQQGKRIYGVVSFGDYYYYYYMDV

SEQ ID NO: 6456 - protein, 24 aa, synthetic construct
  REGION 1..24: note = anti-HIV_CDR
TKHGRRIYGVVAFGEWFTYFYMDV

SEQ ID NO: 6457 - protein, 24 aa, synthetic construct
  REGION 1..24: note = anti-HIV_CDR
AVITDLHTFGDYELEDPSYYYMDV

SEQ ID NO: 6458 - protein, 24 aa, synthetic construct
  REGION 1..24: note = anti-HIV_CDR
DRGDTRLLDYGDYEDERYYYGMDV

SEQ ID NO: 6459 - protein, 24 aa, synthetic construct
  REGION 1..24: note = anti-HIV_CDR
GTRYDFWSGFSNRDGRALAGYFDY

SEQ ID NO: 6460 - protein, 24 aa, synthetic construct
  REGION 1..24: note = anti-HIV_CDR
DGKGKAYYDFWSGYRNQKYYGLDV

SEQ ID NO: 6461 - protein, 24 aa, synthetic construct
  REGION 1..24: note = anti-HIV_CDR
AVITDLHTFADYELGDPSYFYMDV

SEQ ID NO: 6462 - protein, 24 aa, synthetic construct
  REGION 1..24: note = anti-HIV_CDR
SVITDLHTFGDYESGDPSYYYMDV

SEQ ID NO: 6463 - protein, 27 aa, synthetic construct
  REGION 1..27: note = anti-HIV_CDR
DFPRFHRLVGNYDFWRGTLDRFSYMDL

SEQ ID NO: 6464 - protein, 35 aa, synthetic construct
  REGION 1..35: note = anti-HIV_CDR
RILAVERYLKDQQLLGIWGCSGKIICPTMVPWNSS

SEQ ID NO: 6465 - protein, 35 aa, synthetic construct
  REGION 1..35: note = anti-HIV_CDR
RVLAVERYLQDQRLLGMWGCSGKHICTTFVPWNSS

SEQ ID NO: 6466 - protein, 35 aa, synthetic construct
  REGION 1..35: note = anti-HIV_CDR
RVLAVESYLKDQQLLGIWGCSGKHICTTTVPWNSS

SEQ ID NO: 6467 - protein, 35 aa, synthetic construct
  REGION 1..35: note = anti-HIV_CDR
RVLAVERYLRDQQLLGIWGCSGRHICTTNVPWNSS

SEQ ID NO: 6468 - protein, 35 aa, synthetic construct
  REGION 1..35: note = anti-HIV_CDR
RILAVERYLKDQQLLGIWGCSGKLICTTTVPWNSS

SEQ ID NO: 6469 - protein, 35 aa, synthetic construct
  REGION 1..35: note = anti-HIV_CDR
RILAVERYLKDQQLLGIWGCSGKHICTTNVPWNSS

SEQ ID NO: 6470 - protein, 35 aa, synthetic construct
  REGION 1..35: note = anti-HIV_CDR
RVLAVERYLRDQQLLGIWGCSGKLICTTTVPWNAS

SEQ ID NO: 6471 - protein, 35 aa, synthetic construct
  REGION 1..35: note = anti-HIV_CDR
RVLAVERYLRDQQLLGIWGCSGKLICTTAVPWNAS

SEQ ID NO: 6472 - protein, 35 aa, synthetic construct
  REGION 1..35: note = anti-HIV_CDR
RVLAVERYLKDQQLLGIWGCSGKLICTTTVPWNAS

SEQ ID NO: 6473 - protein, 35 aa, synthetic construct
  REGION 1..35: note = anti-HIV_CDR
RILAVERYLKDQQLLGFWGCSGKLICTTAVPWNAS

SEQ ID NO: 6474 - protein, 35 aa, synthetic construct
  REGION 1..35: note = anti-HIV_CDR
RVLAVERYLRDQQLLGIWGCSGKLICTTTVPWNTS

SEQ ID NO: 6475 - protein, 35 aa, synthetic construct
  REGION 1..35: note = anti-HIV_CDR
RVLAVERYLKDQQLLGIWGCSGKLICTTAVPWNAS

SEQ ID NO: 6476 - protein, 35 aa, synthetic construct
  REGION 1..35: note = anti-HIV_CDR
RVLAVERYLKDQQLLGFWGCSGKLICTTTVPWNAS

SEQ ID NO: 6477 - protein, 35 aa, synthetic construct
  REGION 1..35: note = anti-HIV_CDR
RILAVERYLKDQQLLGIWGCSGKLICTTAVPWNAS

SEQ ID NO: 6478-6503 - skipped (26 entries)

SEQ ID NO: 6504 - protein, 4 aa, synthetic construct
  REGION 1..4: note = anti-influenza_CDR
DVPD

SEQ ID NO: 6505 - protein, 4 aa, synthetic construct
  REGION 1..4: note = anti-influenza_CDR
RLSG

SEQ ID NO: 6506 - protein, 4 aa, synthetic construct
  REGION 1..4: note = anti-influenza_CDR
FWDL

SEQ ID NO: 6507 - protein, 5 aa, synthetic construct
  REGION 1..5: note = anti-influenza_CDR
TGLRN

SEQ ID NO: 6508 - protein, 5 aa, synthetic construct
  REGION 1..5: note = anti-influenza_CDR
QQSRT

SEQ ID NO: 6509 - protein, 5 aa, synthetic construct
  REGION 1..5: note = anti-influenza_CDR
QLSRT

SEQ ID NO: 6510 - protein, 5 aa, synthetic construct
  REGION 1..5: note = anti-influenza_CDR
SNYIT

SEQ ID NO: 6511 - protein, 5 aa, synthetic construct
  REGION 1..5: note = anti-influenza_CDR
DYSWN

SEQ ID NO: 6512 - protein, 5 aa, synthetic construct
  REGION 1..5: note = anti-influenza_CDR
NYAFS

SEQ ID NO: 6513 - protein, 5 aa, synthetic construct
  REGION 1..5: note = anti-influenza_CDR
KNAIS

SEQ ID NO: 6514 - protein, 5 aa, synthetic construct
  REGION 1..5: note = anti-influenza_CDR
SHWMT

SEQ ID NO: 6515 - protein, 5 aa, synthetic construct
  REGION 1..5: note = anti-influenza_CDR
NYDIN

SEQ ID NO: 6516 - protein, 5 aa, synthetic construct
  REGION 1..5: note = anti-influenza_CDR
DYGVT

SEQ ID NO: 6517 - protein, 5 aa, synthetic construct
  REGION 1..5: note = anti-influenza_CDR
NYGIN

SEQ ID NO: 6518 - protein, 5 aa, synthetic construct
  REGION 1..5: note = anti-influenza_CDR
GYTIT

SEQ ID NO: 6519 - protein, 5 aa, synthetic construct
  REGION 1..5: note = anti-influenza_CDR
NYGIS

SEQ ID NO: 6520 - protein, 5 aa, synthetic construct
  REGION 1..5: note = anti-influenza_CDR
DDYWT

SEQ ID NO: 6521 - protein, 5 aa, synthetic construct
  REGION 1..5: note = anti-influenza_CDR
TYAMH

SEQ ID NO: 6522 - protein, 5 aa, synthetic construct
  REGION 1..5: note = anti-influenza_CDR
SYAMH

SEQ ID NO: 6523 - protein, 5 aa, synthetic construct
  REGION 1..5: note = anti-influenza_CDR
SYYWN

SEQ ID NO: 6524 - protein, 5 aa, synthetic construct
  REGION 1..5: note = anti-influenza_CDR
TYPVA

SEQ ID NO: 6525 - protein, 5 aa, synthetic construct
  REGION 1..5: note = anti-influenza_CDR
HYFWS

SEQ ID NO: 6526 - protein, 5 aa, synthetic construct
  REGION 1..5: note = anti-influenza_CDR
DYYWT

SEQ ID NO: 6527 - protein, 5 aa, synthetic construct
  REGION 1..5: note = anti-influenza_CDR
DYYWS

SEQ ID NO: 6528 - protein, 5 aa, synthetic construct
  REGION 1..5: note = anti-influenza_CDR
GYYMH

SEQ ID NO: 6529 - protein, 5 aa, synthetic construct
  REGION 1..5: note = anti-influenza_CDR
SHYWS

SEQ ID NO: 6530 - protein, 5 aa, synthetic construct
  REGION 1..5: note = anti-influenza_CDR
NYWIG

SEQ ID NO: 6531 - protein, 5 aa, synthetic construct
  REGION 1..5: note = anti-influenza_CDR
NYAII

SEQ ID NO: 6532 - protein, 5 aa, synthetic construct
  REGION 1..5: note = anti-influenza_CDR
DYYIH

SEQ ID NO: 6533 - protein, 5 aa, synthetic construct
  REGION 1..5: note = anti-influenza_CDR
GYDMH

SEQ ID NO: 6534 - protein, 5 aa, synthetic construct
  REGION 1..5: note = anti-influenza_CDR
GYYIH

SEQ ID NO: 6535 - protein, 5 aa, synthetic construct
  REGION 1..5: note = anti-influenza_CDR
GYYVH

SEQ ID NO: 6536 - protein, 5 aa, synthetic construct
  REGION 1..5: note = anti-influenza_CDR
NYWMS

SEQ ID NO: 6537 - protein, 5 aa, synthetic construct
  REGION 1..5: note = anti-influenza_CDR
GESTL

SEQ ID NO: 6538 - protein, 5 aa, synthetic construct
  REGION 1..5: note = anti-influenza_CDR
NYYWS

SEQ ID NO: 6539 - protein, 5 aa, synthetic construct
  REGION 1..5: note = anti-influenza_CDR
SNYMS

SEQ ID NO: 6540 - protein, 5 aa, synthetic construct
  REGION 1..5: note = anti-influenza_CDR
SDYWS

SEQ ID NO: 6541 - protein, 5 aa, synthetic construct
  REGION 1..5: note = anti-influenza_CDR
SYNWI

SEQ ID NO: 6542 - protein, 5 aa, synthetic construct
  REGION 1..5: note = anti-influenza_CDR
STYMN

SEQ ID NO: 6543 - protein, 5 aa, synthetic construct
  REGION 1..5: note = anti-influenza_CDR
NYAMS

SEQ ID NO: 6544 - protein, 5 aa, synthetic construct
  REGION 1..5: note = anti-influenza_CDR
SDFWS

SEQ ID NO: 6545 - protein, 5 aa, synthetic construct
  REGION 1..5: note = anti-influenza_CDR
YYAMS

SEQ ID NO: 6546 - protein, 5 aa, synthetic construct
  REGION 1..5: note = anti-influenza_CDR
GYYVY

SEQ ID NO: 6547 - protein, 5 aa, synthetic construct
  REGION 1..5: note = anti-influenza_CDR
SYAIS

SEQ ID NO: 6548 - protein, 5 aa, synthetic construct
  REGION 1..5: note = anti-influenza_CDR
SYSWS

SEQ ID NO: 6549 - protein, 5 aa, synthetic construct
  REGION 1..5: note = anti-influenza_CDR
NSFWG

SEQ ID NO: 6550 - protein, 5 aa, synthetic construct
  REGION 1..5: note = anti-influenza_CDR
AYHWS

SEQ ID NO: 6551 - protein, 5 aa, synthetic construct
  REGION 1..5: note = anti-influenza_CDR
DNYIN

SEQ ID NO: 6552 - protein, 5 aa, synthetic construct
  REGION 1..5: note = anti-influenza_CDR
SGFSV

SEQ ID NO: 6553 - protein, 5 aa, synthetic construct
  REGION 1..5: note = anti-influenza_CDR
AYAFT

SEQ ID NO: 6554 - protein, 5 aa, synthetic construct
  REGION 1..5: note = anti-influenza_CDR
GSAIS

SEQ ID NO: 6555 - protein, 5 aa, synthetic construct
  REGION 1..5: note = anti-influenza_CDR
SYAIT

SEQ ID NO: 6556 - protein, 5 aa, synthetic construct
  REGION 1..5: note = anti-influenza_CDR
SYYMH

SEQ ID NO: 6557 - protein, 5 aa, synthetic construct
  REGION 1..5: note = anti-influenza_CDR
IYAMS

SEQ ID NO: 6558 - protein, 5 aa, synthetic construct
  REGION 1..5: note = anti-influenza_CDR
SYSMN

SEQ ID NO: 6559 - protein, 5 aa, synthetic construct
  REGION 1..5: note = anti-influenza_CDR
SYGIS

SEQ ID NO: 6560 - protein, 5 aa, synthetic construct
  REGION 1..5: note = anti-influenza_CDR
FYSMS

SEQ ID NO: 6561 - protein, 5 aa, synthetic construct
  REGION 1..5: note = anti-influenza_CDR
THAIS

SEQ ID NO: 6562 - protein, 5 aa, synthetic construct
  REGION 1..5: note = anti-influenza_CDR
GYAIS

SEQ ID NO: 6563 - protein, 5 aa, synthetic construct
  REGION 1..5: note = anti-influenza_CDR
SNSIS

SEQ ID NO: 6564 - protein, 5 aa, synthetic construct
  REGION 1..5: note = anti-influenza_CDR
NFAIN

SEQ ID NO: 6565 - protein, 5 aa, synthetic construct
  REGION 1..5: note = anti-influenza_CDR
SNAVS

SEQ ID NO: 6566 - protein, 5 aa, synthetic construct
  REGION 1..5: note = anti-influenza_CDR
DNAIS

SEQ ID NO: 6567 - protein, 5 aa, synthetic construct
  REGION 1..5: note = anti-influenza_CDR
FSEVE

SEQ ID NO: 6568 - protein, 5 aa, synthetic construct
  REGION 1..5: note = anti-influenza_CDR
AHHMH

SEQ ID NO: 6569 - protein, 5 aa, synthetic construct
  REGION 1..5: note = anti-influenza_CDR
SQWIG

SEQ ID NO: 6570 - protein, 5 aa, synthetic construct
  REGION 1..5: note = anti-influenza_CDR
DYAMN

SEQ ID NO: 6571 - protein, 5 aa, synthetic construct
  REGION 1..5: note = anti-influenza_CDR
NAWMS

SEQ ID NO: 6572 - protein, 5 aa, synthetic construct
  REGION 1..5: note = anti-influenza_CDR
DYAIN

SEQ ID NO: 6573 - protein, 5 aa, synthetic construct
  REGION 1..5: note = anti-influenza_CDR
RHGIS

SEQ ID NO: 6574 - protein, 5 aa, synthetic construct
  REGION 1..5: note = anti-influenza_CDR
ELSIH

SEQ ID NO: 6575 - protein, 5 aa, synthetic construct
  REGION 1..5: note = anti-influenza_CDR
SSNYY

SEQ ID NO: 6576 - protein, 5 aa, synthetic construct
  REGION 1..5: note = anti-influenza_CDR
TYAMS

SEQ ID NO: 6577 - protein, 5 aa, synthetic construct
  REGION 1..5: note = anti-influenza_CDR
NYAIS

SEQ ID NO: 6578 - protein, 6 aa, synthetic construct
  REGION 1..6: note = anti-influenza_CDR
FGAIAG

SEQ ID NO: 6579 - protein, 6 aa, synthetic construct
  REGION 1..6: note = anti-influenza_CDR
QDISRY

SEQ ID NO: 6580 - protein, 6 aa, synthetic construct
  REGION 1..6: note = anti-influenza_CDR
QNIGPW

SEQ ID NO: 6581 - protein, 6 aa, synthetic construct
  REGION 1..6: note = anti-influenza_CDR
QSVNRR

SEQ ID NO: 6582 - protein, 6 aa, synthetic construct
  REGION 1..6: note = anti-influenza_CDR
QSISTY

SEQ ID NO: 6583 - protein, 6 aa, synthetic construct
  REGION 1..6: note = anti-influenza_CDR
QGIITY

SEQ ID NO: 6584 - protein, 6 aa, synthetic construct
  REGION 1..6: note = anti-influenza_CDR
QGISSY

SEQ ID NO: 6585 - protein, 6 aa, synthetic construct
  REGION 1..6: note = anti-influenza_CDR
QDVSTW

SEQ ID NO: 6586 - protein, 6 aa, synthetic construct
  REGION 1..6: note = anti-influenza_CDR
QDIYIY

SEQ ID NO: 6587 - protein, 6 aa, synthetic construct
  REGION 1..6: note = anti-influenza_CDR
ENIWNN

SEQ ID NO: 6588 - protein, 6 aa, synthetic construct
  REGION 1..6: note = anti-influenza_CDR
GFTVTS

SEQ ID NO: 6589 - protein, 6 aa, synthetic construct
  REGION 1..6: note = anti-influenza_CDR
QDISGH

SEQ ID NO: 6590 - protein, 6 aa, synthetic construct
  REGION 1..6: note = anti-influenza_CDR
SLLTEV

SEQ ID NO: 6591 - protein, 6 aa, synthetic construct
  REGION 1..6: note = anti-influenza_CDR
GSSISN

SEQ ID NO: 6592 - protein, 6 aa, synthetic construct
  REGION 1..6: note = anti-influenza_CDR
GGSITS

SEQ ID NO: 6593 - protein, 6 aa, synthetic construct
  REGION 1..6: note = anti-influenza_CDR
GGSISS

SEQ ID NO: 6594 - protein, 6 aa, synthetic construct
  REGION 1..6: note = anti-influenza_CDR
GLSVSS

SEQ ID NO: 6595 - protein, 6 aa, synthetic construct
  REGION 1..6: note = anti-influenza_CDR
GASISS

SEQ ID NO: 6596 - protein, 6 aa, synthetic construct
  REGION 1..6: note = anti-influenza_CDR
GDSISS

SEQ ID NO: 6597 - protein, 6 aa, synthetic construct
  REGION 1..6: note = anti-influenza_CDR
GGSISN

SEQ ID NO: 6598 - protein, 6 aa, synthetic construct
  REGION 1..6: note = anti-influenza_CDR
GGSISA

SEQ ID NO: 6599 - protein, 6 aa, synthetic construct
  REGION 1..6: note = anti-influenza_CDR
GFSVSD

SEQ ID NO: 6600 - protein, 6 aa, synthetic construct
  REGION 1..6: note = anti-influenza_CDR
SRSLDV

SEQ ID NO: 6601 - protein, 6 aa, synthetic construct
  REGION 1..6: note = anti-influenza_CDR
RSQQTV

SEQ ID NO: 6602 - protein, 6 aa, synthetic construct
  REGION 1..6: note = anti-influenza_CDR
QTINNY

SEQ ID NO: 6603 - protein, 6 aa, synthetic construct
  REGION 1..6: note = anti-influenza_CDR
NMGPTS

SEQ ID NO: 6604 - protein, 6 aa, synthetic construct
  REGION 1..6: note = anti-influenza_CDR
QVVGTN

SEQ ID NO: 6605 - protein, 6 aa, synthetic construct
  REGION 1..6: note = anti-influenza_CDR
QGINTH

SEQ ID NO: 6606 - protein, 6 aa, synthetic construct
  REGION 1..6: note = anti-influenza_CDR
QDIRNR

SEQ ID NO: 6607 - protein, 6 aa, synthetic construct
  REGION 1..6: note = anti-influenza_CDR
QGIGSN

SEQ ID NO: 6608 - protein, 6 aa, synthetic construct
  REGION 1..6: note = anti-influenza_CDR
QTIYRW

SEQ ID NO: 6609 - protein, 6 aa, synthetic construct
  REGION 1..6: note = anti-influenza_CDR
QTITRF

SEQ ID NO: 6610 - protein, 6 aa, synthetic construct
  REGION 1..6: note = anti-influenza_CDR
RLGEKF

SEQ ID NO: 6611 - protein, 6 aa, synthetic construct
  REGION 1..6: note = anti-influenza_CDR
KLGDKF

SEQ ID NO: 6612 - protein, 6 aa, synthetic construct
  REGION 1..6: note = anti-influenza_CDR
QGLGSN

SEQ ID NO: 6613 - protein, 6 aa, synthetic construct
  REGION 1..6: note = anti-influenza_CDR
YIGSKS

SEQ ID NO: 6614 - protein, 6 aa, synthetic construct
  REGION 1..6: note = anti-influenza_CDR
QLISSY

SEQ ID NO: 6615 - protein, 6 aa, synthetic construct
  REGION 1..6: note = anti-influenza_CDR
QSVSSN

SEQ ID NO: 6616 - protein, 6 aa, synthetic construct
  REGION 1..6: note = anti-influenza_CDR
QVISSY

SEQ ID NO: 6617 - protein, 6 aa, synthetic construct
  REGION 1..6: note = anti-influenza_CDR
QSVNRN

SEQ ID NO: 6618 - protein, 6 aa, synthetic construct
  REGION 1..6: note = anti-influenza_CDR
DIGSKS

SEQ ID NO: 6619 - protein, 6 aa, synthetic construct
  REGION 1..6: note = anti-influenza_CDR
QSVSTN

SEQ ID NO: 6620 - protein, 6 aa, synthetic construct
  REGION 1..6: note = anti-influenza_CDR
MIAGWH

SEQ ID NO: 6621 - protein, 6 aa, synthetic construct
  REGION 1..6: note = anti-influenza_CDR
QDISTW

SEQ ID NO: 6622 - protein, 6 aa, synthetic construct
  REGION 1..6: note = anti-influenza_CDR
EKIYSN

SEQ ID NO: 6623 - protein, 7 aa, synthetic construct
  REGION 1..7: note = anti-influenza_CDR
IYYNYNI

SEQ ID NO: 6624 - protein, 7 aa, synthetic construct
  REGION 1..7: note = anti-influenza_CDR
QSISSGY

SEQ ID NO: 6625 - protein, 7 aa, synthetic construct
  REGION 1..7: note = anti-influenza_CDR
QSVSSSY

SEQ ID NO: 6626 - protein, 7 aa, synthetic construct
  REGION 1..7: note = anti-influenza_CDR
QTVSSSY

SEQ ID NO: 6627 - protein, 7 aa, synthetic construct
  REGION 1..7: note = anti-influenza_CDR
SNNAVWN

SEQ ID NO: 6628 - protein, 7 aa, synthetic construct
  REGION 1..7: note = anti-influenza_CDR
SNSAVWN

SEQ ID NO: 6629 - protein, 7 aa, synthetic construct
  REGION 1..7: note = anti-influenza_CDR
AATTLQS

SEQ ID NO: 6630 - protein, 7 aa, synthetic construct
  REGION 1..7: note = anti-influenza_CDR
SNRATWN

SEQ ID NO: 6631 - protein, 7 aa, synthetic construct
  REGION 1..7: note = anti-influenza_CDR
ATSTLQS

SEQ ID NO: 6632 - protein, 7 aa, synthetic construct
  REGION 1..7: note = anti-influenza_CDR
SNSATWN

SEQ ID NO: 6633 - protein, 7 aa, synthetic construct
  REGION 1..7: note = anti-influenza_CDR
ASSTLQS

SEQ ID NO: 6634 - protein, 7 aa, synthetic construct
  REGION 1..7: note = anti-influenza_CDR
SYNAVWN

SEQ ID NO: 6635 - protein, 7 aa, synthetic construct
  REGION 1..7: note = anti-influenza_CDR
AASSRLS

SEQ ID NO: 6636 - protein, 7 aa, synthetic construct
  REGION 1..7: note = anti-influenza_CDR
AASSRGS

SEQ ID NO: 6637 - protein, 7 aa, synthetic construct
  REGION 1..7: note = anti-influenza_CDR
IYHSGSA

SEQ ID NO: 6638 - protein, 7 aa, synthetic construct
  REGION 1..7: note = anti-influenza_CDR
IYYSGVT

SEQ ID NO: 6639 - protein, 7 aa, synthetic construct
  REGION 1..7: note = anti-influenza_CDR
SSYLAWY

SEQ ID NO: 6640 - protein, 7 aa, synthetic construct
  REGION 1..7: note = anti-influenza_CDR
QSLSSSS

SEQ ID NO: 6641 - protein, 7 aa, synthetic construct
  REGION 1..7: note = anti-influenza_CDR
QSVSISY

SEQ ID NO: 6642 - protein, 7 aa, synthetic construct
  REGION 1..7: note = anti-influenza_CDR
DVTERPS

SEQ ID NO: 6643 - protein, 7 aa, synthetic construct
  REGION 1..7: note = anti-influenza_CDR
AASTLLD

SEQ ID NO: 6644 - protein, 7 aa, synthetic construct
  REGION 1..7: note = anti-influenza_CDR
AASTLHS

SEQ ID NO: 6645 - protein, 7 aa, synthetic construct
  REGION 1..7: note = anti-influenza_CDR
GASSLQG

SEQ ID NO: 6646 - protein, 7 aa, synthetic construct
  REGION 1..7: note = anti-influenza_CDR
TNGVNVG

SEQ ID NO: 6647 - protein, 7 aa, synthetic construct
  REGION 1..7: note = anti-influenza_CDR
DASTRAT

SEQ ID NO: 6648 - protein, 7 aa, synthetic construct
  REGION 1..7: note = anti-influenza_CDR
SETYYWS

SEQ ID NO: 6649 - protein, 7 aa, synthetic construct
  REGION 1..7: note = anti-influenza_CDR
EAVNLES

SEQ ID NO: 6650 - protein, 7 aa, synthetic construct
  REGION 1..7: note = anti-influenza_CDR
GASTRAT

SEQ ID NO: 6651 - protein, 7 aa, synthetic construct
  REGION 1..7: note = anti-influenza_CDR
VSGYYWS

SEQ ID NO: 6652 - protein, 7 aa, synthetic construct
  REGION 1..7: note = anti-influenza_CDR
ITGVRVG

SEQ ID NO: 6653 - protein, 7 aa, synthetic construct
  REGION 1..7: note = anti-influenza_CDR
DASNRAT

SEQ ID NO: 6654 - protein, 7 aa, synthetic construct
  REGION 1..7: note = anti-influenza_CDR
EVTNWPS

SEQ ID NO: 6655 - protein, 7 aa, synthetic construct
  REGION 1..7: note = anti-influenza_CDR
KDSERPS

SEQ ID NO: 6656 - protein, 7 aa, synthetic construct
  REGION 1..7: note = anti-influenza_CDR
SGNYYWN

SEQ ID NO: 6657 - protein, 7 aa, synthetic construct
  REGION 1..7: note = anti-influenza_CDR
STTIRHS

SEQ ID NO: 6658 - protein, 7 aa, synthetic construct
  REGION 1..7: note = anti-influenza_CDR
DDSGRPS

SEQ ID NO: 6659 - protein, 7 aa, synthetic construct
  REGION 1..7: note = anti-influenza_CDR
RNDLRPS

SEQ ID NO: 6660 - protein, 7 aa, synthetic construct
  REGION 1..7: note = anti-influenza_CDR
SVDHYWS

SEQ ID NO: 6661 - protein, 7 aa, synthetic construct
  REGION 1..7: note = anti-influenza_CDR
AVSILQS

SEQ ID NO: 6662 - protein, 7 aa, synthetic construct
  REGION 1..7: note = anti-influenza_CDR
DDTDRPS

SEQ ID NO: 6663 - protein, 7 aa, synthetic construct
  REGION 1..7: note = anti-influenza_CDR
ENNKRPS

SEQ ID NO: 6664 - protein, 7 aa, synthetic construct
  REGION 1..7: note = anti-influenza_CDR
DSSNRAP

SEQ ID NO: 6665 - protein, 7 aa, synthetic construct
  REGION 1..7: note = anti-influenza_CDR
EVTKRPS

SEQ ID NO: 6666 - protein, 7 aa, synthetic construct
  REGION 1..7: note = anti-influenza_CDR
ATSNTHS

SEQ ID NO: 6667 - protein, 7 aa, synthetic construct
  REGION 1..7: note = anti-influenza_CDR
AASNLEN

SEQ ID NO: 6668 - protein, 7 aa, synthetic construct
  REGION 1..7: note = anti-influenza_CDR
AASGLQS

SEQ ID NO: 6669 - protein, 7 aa, synthetic construct
  REGION 1..7: note = anti-influenza_CDR
GFTVSSN

SEQ ID NO: 6670 - protein, 7 aa, synthetic construct
  REGION 1..7: note = anti-influenza_CDR
GGGYSWN

SEQ ID NO: 6671 - protein, 7 aa, synthetic construct
  REGION 1..7: note = anti-influenza_CDR
GASNLQS

SEQ ID NO: 6672 - protein, 7 aa, synthetic construct
  REGION 1..7: note = anti-influenza_CDR
GATNLQS

SEQ ID NO: 6673 - protein, 7 aa, synthetic construct
  REGION 1..7: note = anti-influenza_CDR
GASNLHS

SEQ ID NO: 6674 - protein, 7 aa, synthetic construct
  REGION 1..7: note = anti-influenza_CDR
GASTLQS

SEQ ID NO: 6675 - protein, 7 aa, synthetic construct
  REGION 1..7: note = anti-influenza_CDR
DNSDRPS

SEQ ID NO: 6676 - protein, 7 aa, synthetic construct
  REGION 1..7: note = anti-influenza_CDR
GASSLQS

SEQ ID NO: 6677 - protein, 7 aa, synthetic construct
  REGION 1..7: note = anti-influenza_CDR
GNSNRPS

SEQ ID NO: 6678 - protein, 7 aa, synthetic construct
  REGION 1..7: note = anti-influenza_CDR
AASSLQS

SEQ ID NO: 6679 - protein, 7 aa, synthetic construct
  REGION 1..7: note = anti-influenza_CDR
AASSLHS

SEQ ID NO: 6680 - protein, 7 aa, synthetic construct
  REGION 1..7: note = anti-influenza_CDR
GASTLQN

SEQ ID NO: 6681 - protein, 7 aa, synthetic construct
  REGION 1..7: note = anti-influenza_CDR
GATDLQS

SEQ ID NO: 6682 - protein, 7 aa, synthetic construct
  REGION 1..7: note = anti-influenza_CDR
SGAYYWT

SEQ ID NO: 6683 - protein, 7 aa, synthetic construct
  REGION 1..7: note = anti-influenza_CDR
VSDNYIN

SEQ ID NO: 6684 - protein, 7 aa, synthetic construct
  REGION 1..7: note = anti-influenza_CDR
WASTRES

SEQ ID NO: 6685 - protein, 7 aa, synthetic construct
  REGION 1..7: note = anti-influenza_CDR
SNNQRPS

SEQ ID NO: 6686 - protein, 7 aa, synthetic construct
  REGION 1..7: note = anti-influenza_CDR
EVSNRPS

SEQ ID NO: 6687 - protein, 7 aa, synthetic construct
  REGION 1..7: note = anti-influenza_CDR
KNTQRPS

SEQ ID NO: 6688 - protein, 7 aa, synthetic construct
  REGION 1..7: note = anti-influenza_CDR
DNNKRPS

SEQ ID NO: 6689 - protein, 7 aa, synthetic construct
  REGION 1..7: note = anti-influenza_CDR
DASTLRS

SEQ ID NO: 6690 - protein, 7 aa, synthetic construct
  REGION 1..7: note = anti-influenza_CDR
QDNRRPS

SEQ ID NO: 6691 - protein, 7 aa, synthetic construct
  REGION 1..7: note = anti-influenza_CDR
DVSKRPS

SEQ ID NO: 6692 - protein, 7 aa, synthetic construct
  REGION 1..7: note = anti-influenza_CDR
DASSRAT

SEQ ID NO: 6693 - protein, 7 aa, synthetic construct
  REGION 1..7: note = anti-influenza_CDR
LGSNRAS

SEQ ID NO: 6694 - protein, 7 aa, synthetic construct
  REGION 1..7: note = anti-influenza_CDR
GASTRAA

SEQ ID NO: 6695 - protein, 7 aa, synthetic construct
  REGION 1..7: note = anti-influenza_CDR
DDSDRPS

SEQ ID NO: 6696 - protein, 7 aa, synthetic construct
  REGION 1..7: note = anti-influenza_CDR
RDGQRPS

SEQ ID NO: 6697 - protein, 7 aa, synthetic construct
  REGION 1..7: note = anti-influenza_CDR
GASSRAT

SEQ ID NO: 6698 - protein, 7 aa, synthetic construct
  REGION 1..7: note = anti-influenza_CDR
GASSRAS

SEQ ID NO: 6699 - protein, 7 aa, synthetic construct
  REGION 1..7: note = anti-influenza_CDR
AASTLQS

SEQ ID NO: 6700 - protein, 7 aa, synthetic construct
  REGION 1..7: note = anti-influenza_CDR
LVSKRAS

SEQ ID NO: 6701 - protein, 7 aa, synthetic construct
  REGION 1..7: note = anti-influenza_CDR
DVTYRPS

SEQ ID NO: 6702 - protein, 7 aa, synthetic construct
  REGION 1..7: note = anti-influenza_CDR
MQALETP

SEQ ID NO: 6703 - protein, 7 aa, synthetic construct
  REGION 1..7: note = anti-influenza_CDR
QNYGSPF

SEQ ID NO: 6704 - protein, 7 aa, synthetic construct
  REGION 1..7: note = anti-influenza_CDR
QQYGSLP

SEQ ID NO: 6705 - protein, 7 aa, synthetic construct
  REGION 1..7: note = anti-influenza_CDR
WGSYLES

SEQ ID NO: 6706 - protein, 7 aa, synthetic construct
  REGION 1..7: note = anti-influenza_CDR
SASTRAT

SEQ ID NO: 6707 - protein, 7 aa, synthetic construct
  REGION 1..7: note = anti-influenza_CDR
GASTRAS

SEQ ID NO: 6708 - protein, 7 aa, synthetic construct
  REGION 1..7: note = anti-influenza_CDR
GASTRDT

SEQ ID NO: 6709 - protein, 7 aa, synthetic construct
  REGION 1..7: note = anti-influenza_CDR
KVSTLES

SEQ ID NO: 6710 - protein, 7 aa, synthetic construct
  REGION 1..7: note = anti-influenza_CDR
SNTERPS

SEQ ID NO: 6711 - protein, 7 aa, synthetic construct
  REGION 1..7: note = anti-influenza_CDR
KISNRDS

SEQ ID NO: 6712 - protein, 7 aa, synthetic construct
  REGION 1..7: note = anti-influenza_CDR
SASHRYS

SEQ ID NO: 6713 - protein, 7 aa, synthetic construct
  REGION 1..7: note = anti-influenza_CDR
QSVRSNN

SEQ ID NO: 6714 - protein, 7 aa, synthetic construct
  REGION 1..7: note = anti-influenza_CDR
QSVRSGY

SEQ ID NO: 6715 - protein, 7 aa, synthetic construct
  REGION 1..7: note = anti-influenza_CDR
IYYRGST

SEQ ID NO: 6716 - protein, 7 aa, synthetic construct
  REGION 1..7: note = anti-influenza_CDR
VYYSGIT

SEQ ID NO: 6717 - protein, 7 aa, synthetic construct
  REGION 1..7: note = anti-influenza_CDR
SHFANLK

SEQ ID NO: 6718 - protein, 7 aa, synthetic construct
  REGION 1..7: note = anti-influenza_CDR
LNKSKPY

SEQ ID NO: 6719 - protein, 7 aa, synthetic construct
  REGION 1..7: note = anti-influenza_CDR
KLANTGT

SEQ ID NO: 6720 - protein, 7 aa, synthetic construct
  REGION 1..7: note = anti-influenza_CDR
AASTLTS

SEQ ID NO: 6721 - protein, 7 aa, synthetic construct
  REGION 1..7: note = anti-influenza_CDR
DASKLAS

SEQ ID NO: 6722 - protein, 7 aa, synthetic construct
  REGION 1..7: note = anti-influenza_CDR
FASRLAS

SEQ ID NO: 6723 - protein, 7 aa, synthetic construct
  REGION 1..7: note = anti-influenza_CDR
SASTLAS

SEQ ID NO: 6724 - protein, 7 aa, synthetic construct
  REGION 1..7: note = anti-influenza_CDR
EVSQRPS

SEQ ID NO: 6725 - protein, 7 aa, synthetic construct
  REGION 1..7: note = anti-influenza_CDR
GGTLNNY

SEQ ID NO: 6726 - protein, 7 aa, synthetic construct
  REGION 1..7: note = anti-influenza_CDR
DIVMTQS

SEQ ID NO: 6727 - protein, 8 aa, synthetic construct
  REGION 1..8: note = anti-influenza_CDR
GFTFSNYA

SEQ ID NO: 6728 - protein, 8 aa, synthetic construct
  REGION 1..8: note = anti-influenza_CDR
GFTFSNYG

SEQ ID NO: 6729 - protein, 8 aa, synthetic construct
  REGION 1..8: note = anti-influenza_CDR
GFTFSSYA

SEQ ID NO: 6730 - protein, 8 aa, synthetic construct
  REGION 1..8: note = anti-influenza_CDR
GFTFSTYA

SEQ ID NO: 6731 - protein, 8 aa, synthetic construct
  REGION 1..8: note = anti-influenza_CDR
GGIFISQA

SEQ ID NO: 6732 - protein, 8 aa, synthetic construct
  REGION 1..8: note = anti-influenza_CDR
GGIFSPYA

SEQ ID NO: 6733 - protein, 8 aa, synthetic construct
  REGION 1..8: note = anti-influenza_CDR
GGPFSGFA

SEQ ID NO: 6734 - protein, 8 aa, synthetic construct
  REGION 1..8: note = anti-influenza_CDR
GGTFNSHA

SEQ ID NO: 6735 - protein, 8 aa, synthetic construct
  REGION 1..8: note = anti-influenza_CDR
GSNIGSNT

SEQ ID NO: 6736 - protein, 8 aa, synthetic construct
  REGION 1..8: note = anti-influenza_CDR
GVTFSMYA

SEQ ID NO: 6737 - protein, 8 aa, synthetic construct
  REGION 1..8: note = anti-influenza_CDR
GVTFSMYT

SEQ ID NO: 6738 - protein, 8 aa, synthetic construct
  REGION 1..8: note = anti-influenza_CDR
GVTSSNYP

SEQ ID NO: 6739 - protein, 8 aa, synthetic construct
  REGION 1..8: note = anti-influenza_CDR
IIAIFGTT

SEQ ID NO: 6740 - protein, 8 aa, synthetic construct
  REGION 1..8: note = anti-influenza_CDR
IIPLFGTA

SEQ ID NO: 6741 - protein, 8 aa, synthetic construct
  REGION 1..8: note = anti-influenza_CDR
IIPLFGTT

SEQ ID NO: 6742 - protein, 8 aa, synthetic construct
  REGION 1..8: note = anti-influenza_CDR
IIPMFGAT

SEQ ID NO: 6743 - protein, 8 aa, synthetic construct
  REGION 1..8: note = anti-influenza_CDR
IIPMFGTT

SEQ ID NO: 6744 - protein, 8 aa, synthetic construct
  REGION 1..8: note = anti-influenza_CDR
INSGGGAT

SEQ ID NO: 6745 - protein, 8 aa, synthetic construct
  REGION 1..8: note = anti-influenza_CDR
ISAVFGTA

SEQ ID NO: 6746 - protein, 8 aa, synthetic construct
  REGION 1..8: note = anti-influenza_CDR
ISYDANYK

SEQ ID NO: 6747 - protein, 8 aa, synthetic construct
  REGION 1..8: note = anti-influenza_CDR
ISYDGNYK

SEQ ID NO: 6748 - protein, 8 aa, synthetic construct
  REGION 1..8: note = anti-influenza_CDR
ISYDGSNK

SEQ ID NO: 6749 - protein, 8 aa, synthetic construct
  REGION 1..8: note = anti-influenza_CDR
ISYDGSNQ

SEQ ID NO: 6750 - protein, 8 aa, synthetic construct
  REGION 1..8: note = anti-influenza_CDR
QQYYRSPS

SEQ ID NO: 6751 - protein, 8 aa, synthetic construct
  REGION 1..8: note = anti-influenza_CDR
VLPLFGVT

SEQ ID NO: 6752 - protein, 8 aa, synthetic construct
  REGION 1..8: note = anti-influenza_CDR
GGTFSSDA

SEQ ID NO: 6753 - protein, 8 aa, synthetic construct
  REGION 1..8: note = anti-influenza_CDR
IIPVFQTA

SEQ ID NO: 6754 - protein, 8 aa, synthetic construct
  REGION 1..8: note = anti-influenza_CDR
TSNIGSNA

SEQ ID NO: 6755 - protein, 8 aa, synthetic construct
  REGION 1..8: note = anti-influenza_CDR
GYSFTSRW

SEQ ID NO: 6756 - protein, 8 aa, synthetic construct
  REGION 1..8: note = anti-influenza_CDR
IYPSDSDV

SEQ ID NO: 6757 - protein, 8 aa, synthetic construct
  REGION 1..8: note = anti-influenza_CDR
QQYDNWLS

SEQ ID NO: 6758 - protein, 8 aa, synthetic construct
  REGION 1..8: note = anti-influenza_CDR
GGTFSNYG

SEQ ID NO: 6759 - protein, 8 aa, synthetic construct
  REGION 1..8: note = anti-influenza_CDR
GASISSSY

SEQ ID NO: 6760 - protein, 8 aa, synthetic construct
  REGION 1..8: note = anti-influenza_CDR
GGTFSSYD

SEQ ID NO: 6761 - protein, 8 aa, synthetic construct
  REGION 1..8: note = anti-influenza_CDR
IIPIYGTA

SEQ ID NO: 6762 - protein, 8 aa, synthetic construct
  REGION 1..8: note = anti-influenza_CDR
GYTSTTYG

SEQ ID NO: 6763 - protein, 8 aa, synthetic construct
  REGION 1..8: note = anti-influenza_CDR
INPYNGNP

SEQ ID NO: 6764 - protein, 8 aa, synthetic construct
  REGION 1..8: note = anti-influenza_CDR
IWYDGDNK

SEQ ID NO: 6765 - protein, 8 aa, synthetic construct
  REGION 1..8: note = anti-influenza_CDR
GFTFSDFW

SEQ ID NO: 6766 - protein, 8 aa, synthetic construct
  REGION 1..8: note = anti-influenza_CDR
IDQDGNER

SEQ ID NO: 6767 - protein, 8 aa, synthetic construct
  REGION 1..8: note = anti-influenza_CDR
SSNIGKNY

SEQ ID NO: 6768 - protein, 8 aa, synthetic construct
  REGION 1..8: note = anti-influenza_CDR
GYTFTNYW

SEQ ID NO: 6769 - protein, 8 aa, synthetic construct
  REGION 1..8: note = anti-influenza_CDR
IFPPDSQT

SEQ ID NO: 6770 - protein, 8 aa, synthetic construct
  REGION 1..8: note = anti-influenza_CDR
GYSFSDYW

SEQ ID NO: 6771 - protein, 8 aa, synthetic construct
  REGION 1..8: note = anti-influenza_CDR
IYPASSEI

SEQ ID NO: 6772 - protein, 8 aa, synthetic construct
  REGION 1..8: note = anti-influenza_CDR
SGDSGTWN

SEQ ID NO: 6773 - protein, 8 aa, synthetic construct
  REGION 1..8: note = anti-influenza_CDR
GGTLNNYA

SEQ ID NO: 6774 - protein, 8 aa, synthetic construct
  REGION 1..8: note = anti-influenza_CDR
ISPIFGTL

SEQ ID NO: 6775 - protein, 8 aa, synthetic construct
  REGION 1..8: note = anti-influenza_CDR
GVFFSSHA

SEQ ID NO: 6776 - protein, 8 aa, synthetic construct
  REGION 1..8: note = anti-influenza_CDR
ISPMFGTT

SEQ ID NO: 6777 - protein, 8 aa, synthetic construct
  REGION 1..8: note = anti-influenza_CDR
GFTFSRFG

SEQ ID NO: 6778 - protein, 8 aa, synthetic construct
  REGION 1..8: note = anti-influenza_CDR
IWYDGSNK

SEQ ID NO: 6779 - protein, 8 aa, synthetic construct
  REGION 1..8: note = anti-influenza_CDR
QTYGGVST

SEQ ID NO: 6780 - protein, 8 aa, synthetic construct
  REGION 1..8: note = anti-influenza_CDR
DSAGNRHS

SEQ ID NO: 6781 - protein, 8 aa, synthetic construct
  REGION 1..8: note = anti-influenza_CDR
FRGGNSLS

SEQ ID NO: 6782 - protein, 8 aa, synthetic construct
  REGION 1..8: note = anti-influenza_CDR
GYTFTTYW

SEQ ID NO: 6783 - protein, 8 aa, synthetic construct
  REGION 1..8: note = anti-influenza_CDR
IDPYDSET

SEQ ID NO: 6784 - protein, 8 aa, synthetic construct
  REGION 1..8: note = anti-influenza_CDR
IRKFLNWY

SEQ ID NO: 6785 - protein, 8 aa, synthetic construct
  REGION 1..8: note = anti-influenza_CDR
QQYDGLPF

SEQ ID NO: 6786 - protein, 8 aa, synthetic construct
  REGION 1..8: note = anti-influenza_CDR
IRNSLNWY

SEQ ID NO: 6787 - protein, 8 aa, synthetic construct
  REGION 1..8: note = anti-influenza_CDR
QQANSFPL

SEQ ID NO: 6788 - protein, 8 aa, synthetic construct
  REGION 1..8: note = anti-influenza_CDR
SLLTEVET

SEQ ID NO: 6789 - protein, 8 aa, synthetic construct
  REGION 1..8: note = anti-influenza_CDR
QQSYSMPA

SEQ ID NO: 6790 - protein, 8 aa, synthetic construct
  REGION 1..8: note = anti-influenza_CDR
GGPVSGGG

SEQ ID NO: 6791 - protein, 8 aa, synthetic construct
  REGION 1..8: note = anti-influenza_CDR
QQSFSVPA

SEQ ID NO: 6792 - protein, 8 aa, synthetic construct
  REGION 1..8: note = anti-influenza_CDR
QQTYSIPL

SEQ ID NO: 6793 - protein, 8 aa, synthetic construct
  REGION 1..8: note = anti-influenza_CDR
QQSYSVPA

SEQ ID NO: 6794 - protein, 8 aa, synthetic construct
  REGION 1..8: note = anti-influenza_CDR
QQTFSIPL

SEQ ID NO: 6795 - protein, 8 aa, synthetic construct
  REGION 1..8: note = anti-influenza_CDR
GDSITSGA

SEQ ID NO: 6796 - protein, 8 aa, synthetic construct
  REGION 1..8: note = anti-influenza_CDR
QAWDSSTA

SEQ ID NO: 6797 - protein, 8 aa, synthetic construct
  REGION 1..8: note = anti-influenza_CDR
QQYGSSLW

SEQ ID NO: 6798 - protein, 8 aa, synthetic construct
  REGION 1..8: note = anti-influenza_CDR
AYGYTFDP

SEQ ID NO: 6799 - protein, 8 aa, synthetic construct
  REGION 1..8: note = anti-influenza_CDR
MQALQTPL

SEQ ID NO: 6800 - protein, 8 aa, synthetic construct
  REGION 1..8: note = anti-influenza_CDR
QQYGSSLT

SEQ ID NO: 6801 - protein, 8 aa, synthetic construct
  REGION 1..8: note = anti-influenza_CDR
QKYNSAPS

SEQ ID NO: 6802 - protein, 8 aa, synthetic construct
  REGION 1..8: note = anti-influenza_CDR
QQRSNWLK

SEQ ID NO: 6803 - protein, 8 aa, synthetic construct
  REGION 1..8: note = anti-influenza_CDR
SSQSRSST

SEQ ID NO: 6804 - protein, 8 aa, synthetic construct
  REGION 1..8: note = anti-influenza_CDR
PYDVPDYE

SEQ ID NO: 6805 - protein, 8 aa, synthetic construct
  REGION 1..8: note = anti-influenza_CDR
PYDVPDYA

SEQ ID NO: 6806 - protein, 8 aa, synthetic construct
  REGION 1..8: note = anti-influenza_CDR
PGDFNDYE

SEQ ID NO: 6807 - protein, 8 aa, synthetic construct
  REGION 1..8: note = anti-influenza_CDR
PKVRDQES

SEQ ID NO: 6808 - protein, 8 aa, synthetic construct
  REGION 1..8: note = anti-influenza_CDR
TSYTSSNT

SEQ ID NO: 6809 - protein, 8 aa, synthetic construct
  REGION 1..8: note = anti-influenza_CDR
GGNFNNYA

SEQ ID NO: 6810 - protein, 8 aa, synthetic construct
  REGION 1..8: note = anti-influenza_CDR
ISPIFGST

SEQ ID NO: 6811 - protein, 8 aa, synthetic construct
  REGION 1..8: note = anti-influenza_CDR
SSYTSSNT

SEQ ID NO: 6812 - protein, 8 aa, synthetic construct
  REGION 1..8: note = anti-influenza_CDR
GGTFNNYA

SEQ ID NO: 6813 - protein, 8 aa, synthetic construct
  REGION 1..8: note = anti-influenza_CDR
ISPIFGSV

SEQ ID NO: 6814 - protein, 8 aa, synthetic construct
  REGION 1..8: note = anti-influenza_CDR
SSNIGHNF

SEQ ID NO: 6815 - protein, 8 aa, synthetic construct
  REGION 1..8: note = anti-influenza_CDR
GTWDSSLS

SEQ ID NO: 6816 - protein, 8 aa, synthetic construct
  REGION 1..8: note = anti-influenza_CDR
GGIIRKYA

SEQ ID NO: 6817 - protein, 8 aa, synthetic construct
  REGION 1..8: note = anti-influenza_CDR
IIAIFNTA

SEQ ID NO: 6818 - protein, 8 aa, synthetic construct
  REGION 1..8: note = anti-influenza_CDR
GYTFTAYT

SEQ ID NO: 6819 - protein, 8 aa, synthetic construct
  REGION 1..8: note = anti-influenza_CDR
INAGNGHT

SEQ ID NO: 6820 - protein, 8 aa, synthetic construct
  REGION 1..8: note = anti-influenza_CDR
GGTFINYA

SEQ ID NO: 6821 - protein, 8 aa, synthetic construct
  REGION 1..8: note = anti-influenza_CDR
IIPVYGTS

SEQ ID NO: 6822 - protein, 8 aa, synthetic construct
  REGION 1..8: note = anti-influenza_CDR
GFTFRSHA

SEQ ID NO: 6823 - protein, 8 aa, synthetic construct
  REGION 1..8: note = anti-influenza_CDR
ISYDEVNK

SEQ ID NO: 6824 - protein, 8 aa, synthetic construct
  REGION 1..8: note = anti-influenza_CDR
GYNFAAYY

SEQ ID NO: 6825 - protein, 8 aa, synthetic construct
  REGION 1..8: note = anti-influenza_CDR
SNPNTGGA

SEQ ID NO: 6826 - protein, 8 aa, synthetic construct
  REGION 1..8: note = anti-influenza_CDR
GYTLIDYY

SEQ ID NO: 6827 - protein, 8 aa, synthetic construct
  REGION 1..8: note = anti-influenza_CDR
INPINGGT

SEQ ID NO: 6828 - protein, 8 aa, synthetic construct
  REGION 1..8: note = anti-influenza_CDR
GFTFSAYA

SEQ ID NO: 6829 - protein, 8 aa, synthetic construct
  REGION 1..8: note = anti-influenza_CDR
TSYDGRDS

SEQ ID NO: 6830 - protein, 8 aa, synthetic construct
  REGION 1..8: note = anti-influenza_CDR
GFTFTNYA

SEQ ID NO: 6831 - protein, 8 aa, synthetic construct
  REGION 1..8: note = anti-influenza_CDR
ISFDEDNK

SEQ ID NO: 6832 - protein, 8 aa, synthetic construct
  REGION 1..8: note = anti-influenza_CDR
GFNFSSYG

SEQ ID NO: 6833 - protein, 8 aa, synthetic construct
  REGION 1..8: note = anti-influenza_CDR
IWSGGSNK

SEQ ID NO: 6834 - protein, 8 aa, synthetic construct
  REGION 1..8: note = anti-influenza_CDR
GFIFGDFA

SEQ ID NO: 6835 - protein, 8 aa, synthetic construct
  REGION 1..8: note = anti-influenza_CDR
GFNFDEYV

SEQ ID NO: 6836 - protein, 8 aa, synthetic construct
  REGION 1..8: note = anti-influenza_CDR
IGADGRGT

SEQ ID NO: 6837 - protein, 8 aa, synthetic construct
  REGION 1..8: note = anti-influenza_CDR
GGSVSNYY

SEQ ID NO: 6838 - protein, 8 aa, synthetic construct
  REGION 1..8: note = anti-influenza_CDR
GGTFSYYA

SEQ ID NO: 6839 - protein, 8 aa, synthetic construct
  REGION 1..8: note = anti-influenza_CDR
IIPIVGTA

SEQ ID NO: 6840 - protein, 8 aa, synthetic construct
  REGION 1..8: note = anti-influenza_CDR
TSNIGSNT

SEQ ID NO: 6841 - protein, 8 aa, synthetic construct
  REGION 1..8: note = anti-influenza_CDR
GYNFPKYW

SEQ ID NO: 6842 - protein, 8 aa, synthetic construct
  REGION 1..8: note = anti-influenza_CDR
IYPGDSDV

SEQ ID NO: 6843 - protein, 8 aa, synthetic construct
  REGION 1..8: note = anti-influenza_CDR
GHTFISYA

SEQ ID NO: 6844 - protein, 8 aa, synthetic construct
  REGION 1..8: note = anti-influenza_CDR
IVPIFGTV

SEQ ID NO: 6845 - protein, 8 aa, synthetic construct
  REGION 1..8: note = anti-influenza_CDR
GFTFRTYG

SEQ ID NO: 6846 - protein, 8 aa, synthetic construct
  REGION 1..8: note = anti-influenza_CDR
ISYDGTNK

SEQ ID NO: 6847 - protein, 8 aa, synthetic construct
  REGION 1..8: note = anti-influenza_CDR
GFTFSSYG

SEQ ID NO: 6848 - protein, 8 aa, synthetic construct
  REGION 1..8: note = anti-influenza_CDR
ISYDEINK

SEQ ID NO: 6849 - protein, 8 aa, synthetic construct
  REGION 1..8: note = anti-influenza_CDR
GFSLWTSG

SEQ ID NO: 6850 - protein, 8 aa, synthetic construct
  REGION 1..8: note = anti-influenza_CDR
MSYDETKK

SEQ ID NO: 6851 - protein, 8 aa, synthetic construct
  REGION 1..8: note = anti-influenza_CDR
GFTFSRYS

SEQ ID NO: 6852 - protein, 8 aa, synthetic construct
  REGION 1..8: note = anti-influenza_CDR
ISDTSRTI

SEQ ID NO: 6853 - protein, 8 aa, synthetic construct
  REGION 1..8: note = anti-influenza_CDR
GFTFNSYA

SEQ ID NO: 6854 - protein, 8 aa, synthetic construct
  REGION 1..8: note = anti-influenza_CDR
IRGSGENT

SEQ ID NO: 6855 - protein, 8 aa, synthetic construct
  REGION 1..8: note = anti-influenza_CDR
GFTFSRFS

SEQ ID NO: 6856 - protein, 8 aa, synthetic construct
  REGION 1..8: note = anti-influenza_CDR
ISDTGRTI

SEQ ID NO: 6857 - protein, 8 aa, synthetic construct
  REGION 1..8: note = anti-influenza_CDR
GDSFTSYW

SEQ ID NO: 6858 - protein, 8 aa, synthetic construct
  REGION 1..8: note = anti-influenza_CDR
IYPRDSET

SEQ ID NO: 6859 - protein, 8 aa, synthetic construct
  REGION 1..8: note = anti-influenza_CDR
GYTFTAYH

SEQ ID NO: 6860 - protein, 8 aa, synthetic construct
  REGION 1..8: note = anti-influenza_CDR
INPNSGAT

SEQ ID NO: 6861 - protein, 8 aa, synthetic construct
  REGION 1..8: note = anti-influenza_CDR
GFTFSDYW

SEQ ID NO: 6862 - protein, 8 aa, synthetic construct
  REGION 1..8: note = anti-influenza_CDR
ISSDGSTT

SEQ ID NO: 6863 - protein, 8 aa, synthetic construct
  REGION 1..8: note = anti-influenza_CDR
GFSFSNAW

SEQ ID NO: 6864 - protein, 8 aa, synthetic construct
  REGION 1..8: note = anti-influenza_CDR
GLTFSNAW

SEQ ID NO: 6865 - protein, 8 aa, synthetic construct
  REGION 1..8: note = anti-influenza_CDR
GFTFSNAW

SEQ ID NO: 6866 - protein, 8 aa, synthetic construct
  REGION 1..8: note = anti-influenza_CDR
GLSFLNAW

SEQ ID NO: 6867 - protein, 8 aa, synthetic construct
  REGION 1..8: note = anti-influenza_CDR
GFSFLNAW

SEQ ID NO: 6868 - protein, 8 aa, synthetic construct
  REGION 1..8: note = anti-influenza_CDR
GLTFLNAW

SEQ ID NO: 6869 - protein, 8 aa, synthetic construct
  REGION 1..8: note = anti-influenza_CDR
GFTFLNAW

SEQ ID NO: 6870 - protein, 8 aa, synthetic construct
  REGION 1..8: note = anti-influenza_CDR
GYTFTDYY

SEQ ID NO: 6871 - protein, 8 aa, synthetic construct
  REGION 1..8: note = anti-influenza_CDR
VNPYSGGT

SEQ ID NO: 6872 - protein, 8 aa, synthetic construct
  REGION 1..8: note = anti-influenza_CDR
GYTFTDYN

SEQ ID NO: 6873 - protein, 8 aa, synthetic construct
  REGION 1..8: note = anti-influenza_CDR
IYPNNGGT

SEQ ID NO: 6874 - protein, 8 aa, synthetic construct
  REGION 1..8: note = anti-influenza_CDR
GYTFTGYN

SEQ ID NO: 6875 - protein, 8 aa, synthetic construct
  REGION 1..8: note = anti-influenza_CDR
IYPNNGVT

SEQ ID NO: 6876 - protein, 8 aa, synthetic construct
  REGION 1..8: note = anti-influenza_CDR
METDTLLL

SEQ ID NO: 6877 - protein, 9 aa, synthetic construct
  REGION 1..9: note = anti-influenza_CDR
DGVTNKVNS

SEQ ID NO: 6878 - protein, 9 aa, synthetic construct
  REGION 1..9: note = anti-influenza_CDR
GSDVGSSNL

SEQ ID NO: 6879 - protein, 9 aa, synthetic construct
  REGION 1..9: note = anti-influenza_CDR
MQNILLPLT

SEQ ID NO: 6880 - protein, 9 aa, synthetic construct
  REGION 1..9: note = anti-influenza_CDR
MQSLQLPLT

SEQ ID NO: 6881 - protein, 9 aa, synthetic construct
  REGION 1..9: note = anti-influenza_CDR
QQHYRTPPT

SEQ ID NO: 6882 - protein, 9 aa, synthetic construct
  REGION 1..9: note = anti-influenza_CDR
QQYGNSPYT

SEQ ID NO: 6883 - protein, 9 aa, synthetic construct
  REGION 1..9: note = anti-influenza_CDR
QQYGSSPYT

SEQ ID NO: 6884 - protein, 9 aa, synthetic construct
  REGION 1..9: note = anti-influenza_CDR
QQYGTSPQT

SEQ ID NO: 6885 - protein, 9 aa, synthetic construct
  REGION 1..9: note = anti-influenza_CDR
QQYGYLPLT

SEQ ID NO: 6886 - protein, 9 aa, synthetic construct
  REGION 1..9: note = anti-influenza_CDR
QAWDSSTAV

SEQ ID NO: 6887 - protein, 9 aa, synthetic construct
  REGION 1..9: note = anti-influenza_CDR
QHYNAYWGT

SEQ ID NO: 6888 - protein, 9 aa, synthetic construct
  REGION 1..9: note = anti-influenza_CDR
QQTYSSPPT

SEQ ID NO: 6889 - protein, 9 aa, synthetic construct
  REGION 1..9: note = anti-influenza_CDR
QQYYSFPYT

SEQ ID NO: 6890 - protein, 9 aa, synthetic construct
  REGION 1..9: note = anti-influenza_CDR
MQALQLPLA

SEQ ID NO: 6891 - protein, 9 aa, synthetic construct
  REGION 1..9: note = anti-influenza_CDR
QQANSFPFT

SEQ ID NO: 6892 - protein, 9 aa, synthetic construct
  REGION 1..9: note = anti-influenza_CDR
QQLNGYPLT

SEQ ID NO: 6893 - protein, 9 aa, synthetic construct
  REGION 1..9: note = anti-influenza_CDR
MQALQTPLT

SEQ ID NO: 6894 - protein, 9 aa, synthetic construct
  REGION 1..9: note = anti-influenza_CDR
QQNYNWPLT

SEQ ID NO: 6895 - protein, 9 aa, synthetic construct
  REGION 1..9: note = anti-influenza_CDR
QQYDTSSGL

SEQ ID NO: 6896 - protein, 9 aa, synthetic construct
  REGION 1..9: note = anti-influenza_CDR
QQYNSWPRT

SEQ ID NO: 6897 - protein, 9 aa, synthetic construct
  REGION 1..9: note = anti-influenza_CDR
VIYSHGRAY

SEQ ID NO: 6898 - protein, 9 aa, synthetic construct
  REGION 1..9: note = anti-influenza_CDR
QQYGDSRYT

SEQ ID NO: 6899 - protein, 9 aa, synthetic construct
  REGION 1..9: note = anti-influenza_CDR
LQHNSYPYT

SEQ ID NO: 6900 - protein, 9 aa, synthetic construct
  REGION 1..9: note = anti-influenza_CDR
RKMTTAFDS

SEQ ID NO: 6901 - protein, 9 aa, synthetic construct
  REGION 1..9: note = anti-influenza_CDR
QRNHSPSWT

SEQ ID NO: 6902 - protein, 9 aa, synthetic construct
  REGION 1..9: note = anti-influenza_CDR
QQSYDNPQT

SEQ ID NO: 6903 - protein, 9 aa, synthetic construct
  REGION 1..9: note = anti-influenza_CDR
QQSRRLPYT

SEQ ID NO: 6904 - protein, 9 aa, synthetic construct
  REGION 1..9: note = anti-influenza_CDR
RKMTTAIDY

SEQ ID NO: 6905 - protein, 9 aa, synthetic construct
  REGION 1..9: note = anti-influenza_CDR
IRYTGQQLL

SEQ ID NO: 6906 - protein, 9 aa, synthetic construct
  REGION 1..9: note = anti-influenza_CDR
QHYGTISQT

SEQ ID NO: 6907 - protein, 9 aa, synthetic construct
  REGION 1..9: note = anti-influenza_CDR
QQYSTSPPT

SEQ ID NO: 6908 - protein, 9 aa, synthetic construct
  REGION 1..9: note = anti-influenza_CDR
QQYGNSPIT

SEQ ID NO: 6909 - protein, 9 aa, synthetic construct
  REGION 1..9: note = anti-influenza_CDR
QQYYSRPYT

SEQ ID NO: 6910 - protein, 9 aa, synthetic construct
  REGION 1..9: note = anti-influenza_CDR
QVWDNFGGV

SEQ ID NO: 6911 - protein, 9 aa, synthetic construct
  REGION 1..9: note = anti-influenza_CDR
QQSYSSPLT

SEQ ID NO: 6912 - protein, 9 aa, synthetic construct
  REGION 1..9: note = anti-influenza_CDR
QQYFATPRT

SEQ ID NO: 6913 - protein, 9 aa, synthetic construct
  REGION 1..9: note = anti-influenza_CDR
QQYYFSPLT

SEQ ID NO: 6914 - protein, 9 aa, synthetic construct
  REGION 1..9: note = anti-influenza_CDR
QHFGTSVFT

SEQ ID NO: 6915 - protein, 9 aa, synthetic construct
  REGION 1..9: note = anti-influenza_CDR
QQYYNAPLT

SEQ ID NO: 6916 - protein, 9 aa, synthetic construct
  REGION 1..9: note = anti-influenza_CDR
VLFTSPFDF

SEQ ID NO: 6917 - protein, 9 aa, synthetic construct
  REGION 1..9: note = anti-influenza_CDR
LLSYSGVWV

SEQ ID NO: 6918 - protein, 9 aa, synthetic construct
  REGION 1..9: note = anti-influenza_CDR
FLSYSGAWV

SEQ ID NO: 6919 - protein, 9 aa, synthetic construct
  REGION 1..9: note = anti-influenza_CDR
QQSFSKSWT

SEQ ID NO: 6920 - protein, 9 aa, synthetic construct
  REGION 1..9: note = anti-influenza_CDR
VQYVQFPWT

SEQ ID NO: 6921 - protein, 9 aa, synthetic construct
  REGION 1..9: note = anti-influenza_CDR
QQSYSPPLT

SEQ ID NO: 6922 - protein, 9 aa, synthetic construct
  REGION 1..9: note = anti-influenza_CDR
FIYYGGNTK

SEQ ID NO: 6923 - protein, 9 aa, synthetic construct
  REGION 1..9: note = anti-influenza_CDR
VIYSGGSTY

SEQ ID NO: 6924 - protein, 9 aa, synthetic construct
  REGION 1..9: note = anti-influenza_CDR
FMFHSGSPR

SEQ ID NO: 6925 - protein, 9 aa, synthetic construct
  REGION 1..9: note = anti-influenza_CDR
QQTYSTPIT

SEQ ID NO: 6926 - protein, 9 aa, synthetic construct
  REGION 1..9: note = anti-influenza_CDR
FFYNGGSTK

SEQ ID NO: 6927 - protein, 9 aa, synthetic construct
  REGION 1..9: note = anti-influenza_CDR
QQSYNTPLI

SEQ ID NO: 6928 - protein, 9 aa, synthetic construct
  REGION 1..9: note = anti-influenza_CDR
HIYDYGRTF

SEQ ID NO: 6929 - protein, 9 aa, synthetic construct
  REGION 1..9: note = anti-influenza_CDR
VFYSETRTY

SEQ ID NO: 6930 - protein, 9 aa, synthetic construct
  REGION 1..9: note = anti-influenza_CDR
QVWGSSSDH

SEQ ID NO: 6931 - protein, 9 aa, synthetic construct
  REGION 1..9: note = anti-influenza_CDR
YVYNRGSTK

SEQ ID NO: 6932 - protein, 9 aa, synthetic construct
  REGION 1..9: note = anti-influenza_CDR
YIYNRGSTK

SEQ ID NO: 6933 - protein, 9 aa, synthetic construct
  REGION 1..9: note = anti-influenza_CDR
QQSYNTPIT

SEQ ID NO: 6934 - protein, 9 aa, synthetic construct
  REGION 1..9: note = anti-influenza_CDR
QQYYSSPPT

SEQ ID NO: 6935 - protein, 9 aa, synthetic construct
  REGION 1..9: note = anti-influenza_CDR
YLYYSGSTK

SEQ ID NO: 6936 - protein, 9 aa, synthetic construct
  REGION 1..9: note = anti-influenza_CDR
QQSYSPPIT

SEQ ID NO: 6937 - protein, 9 aa, synthetic construct
  REGION 1..9: note = anti-influenza_CDR
YVYNSGNTK

SEQ ID NO: 6938 - protein, 9 aa, synthetic construct
  REGION 1..9: note = anti-influenza_CDR
QQSYNTPLT

SEQ ID NO: 6939 - protein, 9 aa, synthetic construct
  REGION 1..9: note = anti-influenza_CDR
HIFDSGSTY

SEQ ID NO: 6940 - protein, 9 aa, synthetic construct
  REGION 1..9: note = anti-influenza_CDR
VFYSADRTS

SEQ ID NO: 6941 - protein, 9 aa, synthetic construct
  REGION 1..9: note = anti-influenza_CDR
QQYYSTPLT

SEQ ID NO: 6942 - protein, 9 aa, synthetic construct
  REGION 1..9: note = anti-influenza_CDR
YIYYSGNTY

SEQ ID NO: 6943 - protein, 9 aa, synthetic construct
  REGION 1..9: note = anti-influenza_CDR
QQSYSTPLT

SEQ ID NO: 6944 - protein, 9 aa, synthetic construct
  REGION 1..9: note = anti-influenza_CDR
QQYGSSSLT

SEQ ID NO: 6945 - protein, 9 aa, synthetic construct
  REGION 1..9: note = anti-influenza_CDR
SSYTSSSTY

SEQ ID NO: 6946 - protein, 9 aa, synthetic construct
  REGION 1..9: note = anti-influenza_CDR
QRYNSAPPI

SEQ ID NO: 6947 - protein, 9 aa, synthetic construct
  REGION 1..9: note = anti-influenza_CDR
QQYGRTPLT

SEQ ID NO: 6948 - protein, 9 aa, synthetic construct
  REGION 1..9: note = anti-influenza_CDR
QQYGSSPRT

SEQ ID NO: 6949 - protein, 9 aa, synthetic construct
  REGION 1..9: note = anti-influenza_CDR
QQYGSSPLT

SEQ ID NO: 6950 - protein, 9 aa, synthetic construct
  REGION 1..9: note = anti-influenza_CDR
QVWDSSSDH

SEQ ID NO: 6951 - protein, 9 aa, synthetic construct
  REGION 1..9: note = anti-influenza_CDR
KEFSEVEGR

SEQ ID NO: 6952 - protein, 9 aa, synthetic construct
  REGION 1..9: note = anti-influenza_CDR
KEFNNLEKR

SEQ ID NO: 6953 - protein, 9 aa, synthetic construct
  REGION 1..9: note = anti-influenza_CDR
QQHYRTPPS

SEQ ID NO: 6954 - protein, 9 aa, synthetic construct
  REGION 1..9: note = anti-influenza_CDR
MQATHWPLT

SEQ ID NO: 6955 - protein, 9 aa, synthetic construct
  REGION 1..9: note = anti-influenza_CDR
QQYYSYPYT

SEQ ID NO: 6956 - protein, 9 aa, synthetic construct
  REGION 1..9: note = anti-influenza_CDR
SSDVGGYNY

SEQ ID NO: 6957 - protein, 9 aa, synthetic construct
  REGION 1..9: note = anti-influenza_CDR
SSDVGDYNY

SEQ ID NO: 6958 - protein, 9 aa, synthetic construct
  REGION 1..9: note = anti-influenza_CDR
QQYNNWPLS

SEQ ID NO: 6959 - protein, 9 aa, synthetic construct
  REGION 1..9: note = anti-influenza_CDR
QQSYNYPRT

SEQ ID NO: 6960 - protein, 9 aa, synthetic construct
  REGION 1..9: note = anti-influenza_CDR
MQGLQTPYT

SEQ ID NO: 6961 - protein, 9 aa, synthetic construct
  REGION 1..9: note = anti-influenza_CDR
QQHYSIPLT

SEQ ID NO: 6962 - protein, 9 aa, synthetic construct
  REGION 1..9: note = anti-influenza_CDR
LQHNSYPWT

SEQ ID NO: 6963 - protein, 9 aa, synthetic construct
  REGION 1..9: note = anti-influenza_CDR
QQYNTWPLT

SEQ ID NO: 6964 - protein, 9 aa, synthetic construct
  REGION 1..9: note = anti-influenza_CDR
QQYNSFPYR

SEQ ID NO: 6965 - protein, 9 aa, synthetic construct
  REGION 1..9: note = anti-influenza_CDR
QQSYSAPFT

SEQ ID NO: 6966 - protein, 9 aa, synthetic construct
  REGION 1..9: note = anti-influenza_CDR
QAWDSSTVV

SEQ ID NO: 6967 - protein, 9 aa, synthetic construct
  REGION 1..9: note = anti-influenza_CDR
QAWDSTTVV

SEQ ID NO: 6968 - protein, 9 aa, synthetic construct
  REGION 1..9: note = anti-influenza_CDR
LQYGSSPRT

SEQ ID NO: 6969 - protein, 9 aa, synthetic construct
  REGION 1..9: note = anti-influenza_CDR
SSDVGGYDY

SEQ ID NO: 6970 - protein, 9 aa, synthetic construct
  REGION 1..9: note = anti-influenza_CDR
QQYTYWPLT

SEQ ID NO: 6971 - protein, 9 aa, synthetic construct
  REGION 1..9: note = anti-influenza_CDR
QQYDKWPPG

SEQ ID NO: 6972 - protein, 9 aa, synthetic construct
  REGION 1..9: note = anti-influenza_CDR
MQSLQTSIT

SEQ ID NO: 6973 - protein, 9 aa, synthetic construct
  REGION 1..9: note = anti-influenza_CDR
SQIELAVLL

SEQ ID NO: 6974 - protein, 9 aa, synthetic construct
  REGION 1..9: note = anti-influenza_CDR
MQALQTPYT

SEQ ID NO: 6975 - protein, 9 aa, synthetic construct
  REGION 1..9: note = anti-influenza_CDR
QQRSHWPPI

SEQ ID NO: 6976 - protein, 9 aa, synthetic construct
  REGION 1..9: note = anti-influenza_CDR
QHFWGTPLT

SEQ ID NO: 6977 - protein, 9 aa, synthetic construct
  REGION 1..9: note = anti-influenza_CDR
QQNYEDPWT

SEQ ID NO: 6978 - protein, 9 aa, synthetic construct
  REGION 1..9: note = anti-influenza_CDR
QQANSFPPT

SEQ ID NO: 6979 - protein, 9 aa, synthetic construct
  REGION 1..9: note = anti-influenza_CDR
QQRDHWPPI

SEQ ID NO: 6980 - protein, 9 aa, synthetic construct
  REGION 1..9: note = anti-influenza_CDR
MDSRLNLVF

SEQ ID NO: 6981 - protein, 9 aa, synthetic construct
  REGION 1..9: note = anti-influenza_CDR
MKLPVRLLV

SEQ ID NO: 6982 - protein, 10 aa, synthetic construct
  REGION 1..10: note = anti-influenza_CDR
GDSVTRGGFY

SEQ ID NO: 6983 - protein, 10 aa, synthetic construct
  REGION 1..10: note = anti-influenza_CDR
QSVTFNNKNY

SEQ ID NO: 6984 - protein, 10 aa, synthetic construct
  REGION 1..10: note = anti-influenza_CDR
QSVTFNYKNY

SEQ ID NO: 6985 - protein, 10 aa, synthetic construct
  REGION 1..10: note = anti-influenza_CDR
RAQSLSSYLH

SEQ ID NO: 6986 - protein, 10 aa, synthetic construct
  REGION 1..10: note = anti-influenza_CDR
SSYTSSSTYV

SEQ ID NO: 6987 - protein, 10 aa, synthetic construct
  REGION 1..10: note = anti-influenza_CDR
QRYNSAPPIT

SEQ ID NO: 6988 - protein, 10 aa, synthetic construct
  REGION 1..10: note = anti-influenza_CDR
GGSISSGTYY

SEQ ID NO: 6989 - protein, 10 aa, synthetic construct
  REGION 1..10: note = anti-influenza_CDR
QQSYSSLMFT

SEQ ID NO: 6990 - protein, 10 aa, synthetic construct
  REGION 1..10: note = anti-influenza_CDR
LLIYGASTRA

SEQ ID NO: 6991 - protein, 10 aa, synthetic construct
  REGION 1..10: note = anti-influenza_CDR
CAYGGKYLVV

SEQ ID NO: 6992 - protein, 10 aa, synthetic construct
  REGION 1..10: note = anti-influenza_CDR
RPDFYGDFEY

SEQ ID NO: 6993 - protein, 10 aa, synthetic construct
  REGION 1..10: note = anti-influenza_CDR
QHYGYSPRYA

SEQ ID NO: 6994 - protein, 10 aa, synthetic construct
  REGION 1..10: note = anti-influenza_CDR
QQRSHWPPIT

SEQ ID NO: 6995 - protein, 10 aa, synthetic construct
  REGION 1..10: note = anti-influenza_CDR
SSYAGSSTWV

SEQ ID NO: 6996 - protein, 10 aa, synthetic construct
  REGION 1..10: note = anti-influenza_CDR
LLYSGGDPVA

SEQ ID NO: 6997 - protein, 10 aa, synthetic construct
  REGION 1..10: note = anti-influenza_CDR
QQYGGSPRYT

SEQ ID NO: 6998 - protein, 10 aa, synthetic construct
  REGION 1..10: note = anti-influenza_CDR
RYGSGYGFDS

SEQ ID NO: 6999 - protein, 10 aa, synthetic construct
  REGION 1..10: note = anti-influenza_CDR
SSYAGNYNHV

SEQ ID NO: 7000 - protein, 10 aa, synthetic construct
  REGION 1..10: note = anti-influenza_CDR
QQYINWRPLS

SEQ ID NO: 7001 - protein, 10 aa, synthetic construct
  REGION 1..10: note = anti-influenza_CDR
IGAGYDVHWY

SEQ ID NO: 7002 - protein, 10 aa, synthetic construct
  REGION 1..10: note = anti-influenza_CDR
LLIYDNNNRP

SEQ ID NO: 7003 - protein, 10 aa, synthetic construct
  REGION 1..10: note = anti-influenza_CDR
QSYDNSLSGS

SEQ ID NO: 7004 - protein, 10 aa, synthetic construct
  REGION 1..10: note = anti-influenza_CDR
LLIYDASNLQ

SEQ ID NO: 7005 - protein, 10 aa, synthetic construct
  REGION 1..10: note = anti-influenza_CDR
LLIHDASNLE

SEQ ID NO: 7006 - protein, 10 aa, synthetic construct
  REGION 1..10: note = anti-influenza_CDR
VQRLSYGMDV

SEQ ID NO: 7007 - protein, 10 aa, synthetic construct
  REGION 1..10: note = anti-influenza_CDR
VQKSYYGMDV

SEQ ID NO: 7008 - protein, 10 aa, synthetic construct
  REGION 1..10: note = anti-influenza_CDR
SSYTSSSTHV

SEQ ID NO: 7009 - protein, 10 aa, synthetic construct
  REGION 1..10: note = anti-influenza_CDR
SSYTSSSTLV

SEQ ID NO: 7010 - protein, 10 aa, synthetic construct
  REGION 1..10: note = anti-influenza_CDR
TKRSQQTVIP

SEQ ID NO: 7011 - protein, 10 aa, synthetic construct
  REGION 1..10: note = anti-influenza_CDR
TSRSQQTVIP

SEQ ID NO: 7012 - protein, 10 aa, synthetic construct
  REGION 1..10: note = anti-influenza_CDR
SSNYNRRFTP

SEQ ID NO: 7013 - protein, 10 aa, synthetic construct
  REGION 1..10: note = anti-influenza_CDR
RPKVRDQESR

SEQ ID NO: 7014 - protein, 10 aa, synthetic construct
  REGION 1..10: note = anti-influenza_CDR
RPWVRGVSSR

SEQ ID NO: 7015 - protein, 10 aa, synthetic construct
  REGION 1..10: note = anti-influenza_CDR
RPWVRGLSSR

SEQ ID NO: 7016 - protein, 10 aa, synthetic construct
  REGION 1..10: note = anti-influenza_CDR
RPKVRGQAGR

SEQ ID NO: 7017 - protein, 10 aa, synthetic construct
  REGION 1..10: note = anti-influenza_CDR
APAVAAQASA

SEQ ID NO: 7018 - protein, 10 aa, synthetic construct
  REGION 1..10: note = anti-influenza_CDR
VHHPGTDNDQ

SEQ ID NO: 7019 - protein, 10 aa, synthetic construct
  REGION 1..10: note = anti-influenza_CDR
FGQGTKVEIK

SEQ ID NO: 7020 - protein, 10 aa, synthetic construct
  REGION 1..10: note = anti-influenza_CDR
GFAFHNRAMH

SEQ ID NO: 7021 - protein, 10 aa, synthetic construct
  REGION 1..10: note = anti-influenza_CDR
GLTFSSYAVH

SEQ ID NO: 7022 - protein, 10 aa, synthetic construct
  REGION 1..10: note = anti-influenza_CDR
GPTFSSYAVH

SEQ ID NO: 7023 - protein, 10 aa, synthetic construct
  REGION 1..10: note = anti-influenza_CDR
GSIFSNYGIS

SEQ ID NO: 7024 - protein, 10 aa, synthetic construct
  REGION 1..10: note = anti-influenza_CDR
GYSFNNYGIN

SEQ ID NO: 7025 - protein, 10 aa, synthetic construct
  REGION 1..10: note = anti-influenza_CDR
GYTFNAYYIH

SEQ ID NO: 7026 - protein, 10 aa, synthetic construct
  REGION 1..10: note = anti-influenza_CDR
GYTFTSFIMY

SEQ ID NO: 7027 - protein, 10 aa, synthetic construct
  REGION 1..10: note = anti-influenza_CDR
RGNYGNGFAY

SEQ ID NO: 7028 - protein, 10 aa, synthetic construct
  REGION 1..10: note = anti-influenza_CDR
QQYGSSPALT

SEQ ID NO: 7029 - protein, 10 aa, synthetic construct
  REGION 1..10: note = anti-influenza_CDR
QEYNNDSPLT

SEQ ID NO: 7030 - protein, 10 aa, synthetic construct
  REGION 1..10: note = anti-influenza_CDR
IRSGLNRFET

SEQ ID NO: 7031 - protein, 10 aa, synthetic construct
  REGION 1..10: note = anti-influenza_CDR
VFYSGSSNYN

SEQ ID NO: 7032 - protein, 10 aa, synthetic construct
  REGION 1..10: note = anti-influenza_CDR
GASISTGGNY

SEQ ID NO: 7033 - protein, 10 aa, synthetic construct
  REGION 1..10: note = anti-influenza_CDR
IFYSGTTKYN

SEQ ID NO: 7034 - protein, 10 aa, synthetic construct
  REGION 1..10: note = anti-influenza_CDR
ASYAGTYIHL

SEQ ID NO: 7035 - protein, 10 aa, synthetic construct
  REGION 1..10: note = anti-influenza_CDR
QQLNSYPPIT

SEQ ID NO: 7036 - protein, 10 aa, synthetic construct
  REGION 1..10: note = anti-influenza_CDR
QQFNDWPFLT

SEQ ID NO: 7037 - protein, 10 aa, synthetic construct
  REGION 1..10: note = anti-influenza_CDR
QQLTTYPPIT

SEQ ID NO: 7038 - protein, 10 aa, synthetic construct
  REGION 1..10: note = anti-influenza_CDR
GGSISNGGYH

SEQ ID NO: 7039 - protein, 10 aa, synthetic construct
  REGION 1..10: note = anti-influenza_CDR
GDSVINSAYY

SEQ ID NO: 7040 - protein, 10 aa, synthetic construct
  REGION 1..10: note = anti-influenza_CDR
QQYDNWLPIT

SEQ ID NO: 7041 - protein, 10 aa, synthetic construct
  REGION 1..10: note = anti-influenza_CDR
AGDYSGGIYA

SEQ ID NO: 7042 - protein, 10 aa, synthetic construct
  REGION 1..10: note = anti-influenza_CDR
AGDYSGSNYA

SEQ ID NO: 7043 - protein, 10 aa, synthetic construct
  REGION 1..10: note = anti-influenza_CDR
AGDYSGANYA

SEQ ID NO: 7044 - protein, 10 aa, synthetic construct
  REGION 1..10: note = anti-influenza_CDR
GLSLYSNEIN

SEQ ID NO: 7045 - protein, 10 aa, synthetic construct
  REGION 1..10: note = anti-influenza_CDR
ASYAGNNIYV

SEQ ID NO: 7046 - protein, 10 aa, synthetic construct
  REGION 1..10: note = anti-influenza_CDR
ASQSVSTFLA

SEQ ID NO: 7047 - protein, 10 aa, synthetic construct
  REGION 1..10: note = anti-influenza_CDR
IKSNTDGGTT

SEQ ID NO: 7048 - protein, 10 aa, synthetic construct
  REGION 1..10: note = anti-influenza_CDR
ESVDIYGNSF

SEQ ID NO: 7049 - protein, 10 aa, synthetic construct
  REGION 1..10: note = anti-influenza_CDR
ESIDIYGNSF

SEQ ID NO: 7050 - protein, 10 aa, synthetic construct
  REGION 1..10: note = anti-influenza_CDR
AGDYSGVNYA

SEQ ID NO: 7051 - protein, 11 aa, synthetic construct
  REGION 1..11: note = anti-influenza_CDR
AAWDDSLNGQL

SEQ ID NO: 7052 - protein, 11 aa, synthetic construct
  REGION 1..11: note = anti-influenza_CDR
CSYAGSSSSRV

SEQ ID NO: 7053 - protein, 11 aa, synthetic construct
  REGION 1..11: note = anti-influenza_CDR
LVLATGLRNSP

SEQ ID NO: 7054 - protein, 11 aa, synthetic construct
  REGION 1..11: note = anti-influenza_CDR
QSLLHSDGKTY

SEQ ID NO: 7055 - protein, 11 aa, synthetic construct
  REGION 1..11: note = anti-influenza_CDR
RTSQSLSSYLH

SEQ ID NO: 7056 - protein, 11 aa, synthetic construct
  REGION 1..11: note = anti-influenza_CDR
RASQRLNSYLH

SEQ ID NO: 7057 - protein, 11 aa, synthetic construct
  REGION 1..11: note = anti-influenza_CDR
RTSQSLRSYLH

SEQ ID NO: 7058 - protein, 11 aa, synthetic construct
  REGION 1..11: note = anti-influenza_CDR
RTSQSLSSYTH

SEQ ID NO: 7059 - protein, 11 aa, synthetic construct
  REGION 1..11: note = anti-influenza_CDR
RTSQSLSSYDH

SEQ ID NO: 7060 - protein, 11 aa, synthetic construct
  REGION 1..11: note = anti-influenza_CDR
QVWDSSSDHYV

SEQ ID NO: 7061 - protein, 11 aa, synthetic construct
  REGION 1..11: note = anti-influenza_CDR
QVWGSSSDHYV

SEQ ID NO: 7062 - protein, 11 aa, synthetic construct
  REGION 1..11: note = anti-influenza_CDR
GTWDSSLSVGM

SEQ ID NO: 7063 - protein, 11 aa, synthetic construct
  REGION 1..11: note = anti-influenza_CDR
QSLLHGNGYNY

SEQ ID NO: 7064 - protein, 11 aa, synthetic construct
  REGION 1..11: note = anti-influenza_CDR
RASQGIRNDLG

SEQ ID NO: 7065 - protein, 11 aa, synthetic construct
  REGION 1..11: note = anti-influenza_CDR
RASQNIRSYLN

SEQ ID NO: 7066 - protein, 11 aa, synthetic construct
  REGION 1..11: note = anti-influenza_CDR
RANQDIGIYLN

SEQ ID NO: 7067 - protein, 11 aa, synthetic construct
  REGION 1..11: note = anti-influenza_CDR
RASQSVSNNLA

SEQ ID NO: 7068 - protein, 11 aa, synthetic construct
  REGION 1..11: note = anti-influenza_CDR
QQYHNWPPSYS

SEQ ID NO: 7069 - protein, 11 aa, synthetic construct
  REGION 1..11: note = anti-influenza_CDR
RASQGILNCLA

SEQ ID NO: 7070 - protein, 11 aa, synthetic construct
  REGION 1..11: note = anti-influenza_CDR
RASQSIASWLA

SEQ ID NO: 7071 - protein, 11 aa, synthetic construct
  REGION 1..11: note = anti-influenza_CDR
APRVYEYYFDQ

SEQ ID NO: 7072 - protein, 11 aa, synthetic construct
  REGION 1..11: note = anti-influenza_CDR
RASQSVSSYLA

SEQ ID NO: 7073 - protein, 11 aa, synthetic construct
  REGION 1..11: note = anti-influenza_CDR
SGDALPKQNAY

SEQ ID NO: 7074 - protein, 11 aa, synthetic construct
  REGION 1..11: note = anti-influenza_CDR
QSADSSGTSWV

SEQ ID NO: 7075 - protein, 11 aa, synthetic construct
  REGION 1..11: note = anti-influenza_CDR
GGSNIGGKSVH

SEQ ID NO: 7076 - protein, 11 aa, synthetic construct
  REGION 1..11: note = anti-influenza_CDR
QHYGSSPRYAF

SEQ ID NO: 7077 - protein, 11 aa, synthetic construct
  REGION 1..11: note = anti-influenza_CDR
RASQSISSYLN

SEQ ID NO: 7078 - protein, 11 aa, synthetic construct
  REGION 1..11: note = anti-influenza_CDR
GGNAIGSKKVH

SEQ ID NO: 7079 - protein, 11 aa, synthetic construct
  REGION 1..11: note = anti-influenza_CDR
QVWDFTIDHVV

SEQ ID NO: 7080 - protein, 11 aa, synthetic construct
  REGION 1..11: note = anti-influenza_CDR
ATWDGSLSAWV

SEQ ID NO: 7081 - protein, 11 aa, synthetic construct
  REGION 1..11: note = anti-influenza_CDR
RASQSVGNYLA

SEQ ID NO: 7082 - protein, 11 aa, synthetic construct
  REGION 1..11: note = anti-influenza_CDR
QQRSKWPPMYS

SEQ ID NO: 7083 - protein, 11 aa, synthetic construct
  REGION 1..11: note = anti-influenza_CDR
DVSTTWSWFAP

SEQ ID NO: 7084 - protein, 11 aa, synthetic construct
  REGION 1..11: note = anti-influenza_CDR
RASQNIKRYFN

SEQ ID NO: 7085 - protein, 11 aa, synthetic construct
  REGION 1..11: note = anti-influenza_CDR
RASQSVGNSLA

SEQ ID NO: 7086 - protein, 11 aa, synthetic construct
  REGION 1..11: note = anti-influenza_CDR
GESTLSYYAVS

SEQ ID NO: 7087 - protein, 11 aa, synthetic construct
  REGION 1..11: note = anti-influenza_CDR
RASQNIYKYLN

SEQ ID NO: 7088 - protein, 11 aa, synthetic construct
  REGION 1..11: note = anti-influenza_CDR
ASCSGGYCILD

SEQ ID NO: 7089 - protein, 11 aa, synthetic construct
  REGION 1..11: note = anti-influenza_CDR
RTSQSISSYLN

SEQ ID NO: 7090 - protein, 11 aa, synthetic construct
  REGION 1..11: note = anti-influenza_CDR
RASQSIGAYVN

SEQ ID NO: 7091 - protein, 11 aa, synthetic construct
  REGION 1..11: note = anti-influenza_CDR
RASQSISTYLN

SEQ ID NO: 7092 - protein, 11 aa, synthetic construct
  REGION 1..11: note = anti-influenza_CDR
RASQSIDKFLN

SEQ ID NO: 7093 - protein, 11 aa, synthetic construct
  REGION 1..11: note = anti-influenza_CDR
GGHNIGSNSVH

SEQ ID NO: 7094 - protein, 11 aa, synthetic construct
  REGION 1..11: note = anti-influenza_CDR
RASQSISTYLH

SEQ ID NO: 7095 - protein, 11 aa, synthetic construct
  REGION 1..11: note = anti-influenza_CDR
HVGGHTYGIDY

SEQ ID NO: 7096 - protein, 11 aa, synthetic construct
  REGION 1..11: note = anti-influenza_CDR
RASQSISNYLN

SEQ ID NO: 7097 - protein, 11 aa, synthetic construct
  REGION 1..11: note = anti-influenza_CDR
HDDASHGYSIS

SEQ ID NO: 7098 - protein, 11 aa, synthetic construct
  REGION 1..11: note = anti-influenza_CDR
RASQTISTYLN

SEQ ID NO: 7099 - protein, 11 aa, synthetic construct
  REGION 1..11: note = anti-influenza_CDR
RASQSISRYLN

SEQ ID NO: 7100 - protein, 11 aa, synthetic construct
  REGION 1..11: note = anti-influenza_CDR
GTWDSSLSAYV

SEQ ID NO: 7101 - protein, 11 aa, synthetic construct
  REGION 1..11: note = anti-influenza_CDR
SSNYYDSVYDY

SEQ ID NO: 7102 - protein, 11 aa, synthetic construct
  REGION 1..11: note = anti-influenza_CDR
AAWDDILNVPV

SEQ ID NO: 7103 - protein, 11 aa, synthetic construct
  REGION 1..11: note = anti-influenza_CDR
VAWDDSVDGYV

SEQ ID NO: 7104 - protein, 11 aa, synthetic construct
  REGION 1..11: note = anti-influenza_CDR
GPKYYSEYMDV

SEQ ID NO: 7105 - protein, 11 aa, synthetic construct
  REGION 1..11: note = anti-influenza_CDR
RASQGISSYLA

SEQ ID NO: 7106 - protein, 11 aa, synthetic construct
  REGION 1..11: note = anti-influenza_CDR
SSGYYPEYFQD

SEQ ID NO: 7107 - protein, 11 aa, synthetic construct
  REGION 1..11: note = anti-influenza_CDR
SGHKLGDKYVS

SEQ ID NO: 7108 - protein, 11 aa, synthetic construct
  REGION 1..11: note = anti-influenza_CDR
STGYYPAYLHH

SEQ ID NO: 7109 - protein, 11 aa, synthetic construct
  REGION 1..11: note = anti-influenza_CDR
RASQRVSSYLA

SEQ ID NO: 7110 - protein, 11 aa, synthetic construct
  REGION 1..11: note = anti-influenza_CDR
GGNNIGSKSVH

SEQ ID NO: 7111 - protein, 11 aa, synthetic construct
  REGION 1..11: note = anti-influenza_CDR
QVWDSSSDHAV

SEQ ID NO: 7112 - protein, 11 aa, synthetic construct
  REGION 1..11: note = anti-influenza_CDR
ATWDDNLSGPV

SEQ ID NO: 7113 - protein, 11 aa, synthetic construct
  REGION 1..11: note = anti-influenza_CDR
SSGYYPAYLPH

SEQ ID NO: 7114 - protein, 11 aa, synthetic construct
  REGION 1..11: note = anti-influenza_CDR
GGNNIGSKGVH

SEQ ID NO: 7115 - protein, 11 aa, synthetic construct
  REGION 1..11: note = anti-influenza_CDR
QVWDSSSDHVV

SEQ ID NO: 7116 - protein, 11 aa, synthetic construct
  REGION 1..11: note = anti-influenza_CDR
GNYYYESSLDY

SEQ ID NO: 7117 - protein, 11 aa, synthetic construct
  REGION 1..11: note = anti-influenza_CDR
GPHYYSSYMDV

SEQ ID NO: 7118 - protein, 11 aa, synthetic construct
  REGION 1..11: note = anti-influenza_CDR
RASQGISTYLA

SEQ ID NO: 7119 - protein, 11 aa, synthetic construct
  REGION 1..11: note = anti-influenza_CDR
GPTYYYSYMDV

SEQ ID NO: 7120 - protein, 11 aa, synthetic construct
  REGION 1..11: note = anti-influenza_CDR
GGNNIGRNSVH

SEQ ID NO: 7121 - protein, 11 aa, synthetic construct
  REGION 1..11: note = anti-influenza_CDR
QVWHSSSDHYV

SEQ ID NO: 7122 - protein, 11 aa, synthetic construct
  REGION 1..11: note = anti-influenza_CDR
SSGYYPQYFQD

SEQ ID NO: 7123 - protein, 11 aa, synthetic construct
  REGION 1..11: note = anti-influenza_CDR
RASQSVSRYLA

SEQ ID NO: 7124 - protein, 11 aa, synthetic construct
  REGION 1..11: note = anti-influenza_CDR
WGQGTTLTVSS

SEQ ID NO: 7125 - protein, 11 aa, synthetic construct
  REGION 1..11: note = anti-influenza_CDR
RASQSVDSNLA

SEQ ID NO: 7126 - protein, 11 aa, synthetic construct
  REGION 1..11: note = anti-influenza_CDR
RASQSVSHNLA

SEQ ID NO: 7127 - protein, 11 aa, synthetic construct
  REGION 1..11: note = anti-influenza_CDR
RASQSVSSNLA

SEQ ID NO: 7128 - protein, 11 aa, synthetic construct
  REGION 1..11: note = anti-influenza_CDR
RASQSVDHNLA

SEQ ID NO: 7129 - protein, 11 aa, synthetic construct
  REGION 1..11: note = anti-influenza_CDR
QHYTNWPPRLT

SEQ ID NO: 7130 - protein, 11 aa, synthetic construct
  REGION 1..11: note = anti-influenza_CDR
QHYTNYPPRLT

SEQ ID NO: 7131 - protein, 11 aa, synthetic construct
  REGION 1..11: note = anti-influenza_CDR
QHYTNFPPRLT

SEQ ID NO: 7132 - protein, 11 aa, synthetic construct
  REGION 1..11: note = anti-influenza_CDR
RASQVISHNLA

SEQ ID NO: 7133 - protein, 11 aa, synthetic construct
  REGION 1..11: note = anti-influenza_CDR
QHYSNWPPRLT

SEQ ID NO: 7134 - protein, 11 aa, synthetic construct
  REGION 1..11: note = anti-influenza_CDR
QHYSNFPPRLT

SEQ ID NO: 7135 - protein, 11 aa, synthetic construct
  REGION 1..11: note = anti-influenza_CDR
QHYSNYPPRLT

SEQ ID NO: 7136 - protein, 11 aa, synthetic construct
  REGION 1..11: note = anti-influenza_CDR
RASQSVANNLA

SEQ ID NO: 7137 - protein, 11 aa, synthetic construct
  REGION 1..11: note = anti-influenza_CDR
QQYNNWPPMYT

SEQ ID NO: 7138 - protein, 11 aa, synthetic construct
  REGION 1..11: note = anti-influenza_CDR
RASQSIGNWLA

SEQ ID NO: 7139 - protein, 11 aa, synthetic construct
  REGION 1..11: note = anti-influenza_CDR
QRYTSNSQGFT

SEQ ID NO: 7140 - protein, 11 aa, synthetic construct
  REGION 1..11: note = anti-influenza_CDR
AAWDDTLNGPV

SEQ ID NO: 7141 - protein, 11 aa, synthetic construct
  REGION 1..11: note = anti-influenza_CDR
KASQNVGSNVA

SEQ ID NO: 7142 - protein, 11 aa, synthetic construct
  REGION 1..11: note = anti-influenza_CDR
QVWDMSSDRRV

SEQ ID NO: 7143 - protein, 11 aa, synthetic construct
  REGION 1..11: note = anti-influenza_CDR
QSLLHSNGYNY

SEQ ID NO: 7144 - protein, 11 aa, synthetic construct
  REGION 1..11: note = anti-influenza_CDR
TYLVGAVGFQH

SEQ ID NO: 7145 - protein, 11 aa, synthetic construct
  REGION 1..11: note = anti-influenza_CDR
AAWDDSLNGWV

SEQ ID NO: 7146 - protein, 11 aa, synthetic construct
  REGION 1..11: note = anti-influenza_CDR
QSLLDSNGYNY

SEQ ID NO: 7147 - protein, 11 aa, synthetic construct
  REGION 1..11: note = anti-influenza_CDR
MQALQTPPMYT

SEQ ID NO: 7148 - protein, 11 aa, synthetic construct
  REGION 1..11: note = anti-influenza_CDR
QSLLHSNGYNH

SEQ ID NO: 7149 - protein, 11 aa, synthetic construct
  REGION 1..11: note = anti-influenza_CDR
QVWDITSDLVV

SEQ ID NO: 7150 - protein, 11 aa, synthetic construct
  REGION 1..11: note = anti-influenza_CDR
RASQDISTWLA

SEQ ID NO: 7151 - protein, 11 aa, synthetic construct
  REGION 1..11: note = anti-influenza_CDR
RASRSITTFLA

SEQ ID NO: 7152 - protein, 11 aa, synthetic construct
  REGION 1..11: note = anti-influenza_CDR
GWGAVTSPFDF

SEQ ID NO: 7153 - protein, 11 aa, synthetic construct
  REGION 1..11: note = anti-influenza_CDR
RASQSVSSSYL

SEQ ID NO: 7154 - protein, 12 aa, synthetic construct
  REGION 1..12: note = anti-influenza_CDR
QSVLYSSNNKNY

SEQ ID NO: 7155 - protein, 12 aa, synthetic construct
  REGION 1..12: note = anti-influenza_CDR
AAWDDSLSGSWV

SEQ ID NO: 7156 - protein, 12 aa, synthetic construct
  REGION 1..12: note = anti-influenza_CDR
VFYSADRTSYAD

SEQ ID NO: 7157 - protein, 12 aa, synthetic construct
  REGION 1..12: note = anti-influenza_CDR
RVGQSVSGSHLA

SEQ ID NO: 7158 - protein, 12 aa, synthetic construct
  REGION 1..12: note = anti-influenza_CDR
TLSSAYSNYKVD

SEQ ID NO: 7159 - protein, 12 aa, synthetic construct
  REGION 1..12: note = anti-influenza_CDR
VGTGGIVGSKGD

SEQ ID NO: 7160 - protein, 12 aa, synthetic construct
  REGION 1..12: note = anti-influenza_CDR
RYSRSSPGTFES

SEQ ID NO: 7161 - protein, 12 aa, synthetic construct
  REGION 1..12: note = anti-influenza_CDR
QSYDSSLSGFHV

SEQ ID NO: 7162 - protein, 12 aa, synthetic construct
  REGION 1..12: note = anti-influenza_CDR
RASQSVSSSQLA

SEQ ID NO: 7163 - protein, 12 aa, synthetic construct
  REGION 1..12: note = anti-influenza_CDR
RASQFVSTRSLA

SEQ ID NO: 7164 - protein, 12 aa, synthetic construct
  REGION 1..12: note = anti-influenza_CDR
ATWDDSLNGFYV

SEQ ID NO: 7165 - protein, 12 aa, synthetic construct
  REGION 1..12: note = anti-influenza_CDR
RASHFVNYRSLA

SEQ ID NO: 7166 - protein, 12 aa, synthetic construct
  REGION 1..12: note = anti-influenza_CDR
RASHFVIGRAVA

SEQ ID NO: 7167 - protein, 12 aa, synthetic construct
  REGION 1..12: note = anti-influenza_CDR
RIYHGGNSGFDF

SEQ ID NO: 7168 - protein, 12 aa, synthetic construct
  REGION 1..12: note = anti-influenza_CDR
TLSSGFDNYQVA

SEQ ID NO: 7169 - protein, 12 aa, synthetic construct
  REGION 1..12: note = anti-influenza_CDR
VGNGGNVASKGD

SEQ ID NO: 7170 - protein, 12 aa, synthetic construct
  REGION 1..12: note = anti-influenza_CDR
VRGGSTVAYFGV

SEQ ID NO: 7171 - protein, 12 aa, synthetic construct
  REGION 1..12: note = anti-influenza_CDR
CLSRMRGYGLDV

SEQ ID NO: 7172 - protein, 12 aa, synthetic construct
  REGION 1..12: note = anti-influenza_CDR
VGQMDKYYAMDV

SEQ ID NO: 7173 - protein, 12 aa, synthetic construct
  REGION 1..12: note = anti-influenza_CDR
GVTNKVNSIIDK

SEQ ID NO: 7174 - protein, 12 aa, synthetic construct
  REGION 1..12: note = anti-influenza_CDR
GVTNKVNRIIDK

SEQ ID NO: 7175 - protein, 12 aa, synthetic construct
  REGION 1..12: note = anti-influenza_CDR
GVTNKENSIIDK

SEQ ID NO: 7176 - protein, 12 aa, synthetic construct
  REGION 1..12: note = anti-influenza_CDR
PLGILHYYAMDL

SEQ ID NO: 7177 - protein, 12 aa, synthetic construct
  REGION 1..12: note = anti-influenza_CDR
KITSKVNNIVDK

SEQ ID NO: 7178 - protein, 12 aa, synthetic construct
  REGION 1..12: note = anti-influenza_CDR
GITNKVNSIIDK

SEQ ID NO: 7179 - protein, 12 aa, synthetic construct
  REGION 1..12: note = anti-influenza_CDR
NGRSSTSWGIDV

SEQ ID NO: 7180 - protein, 12 aa, synthetic construct
  REGION 1..12: note = anti-influenza_CDR
GITNKENSVIEK

SEQ ID NO: 7181 - protein, 12 aa, synthetic construct
  REGION 1..12: note = anti-influenza_CDR
PLGSRYYYGMDV

SEQ ID NO: 7182 - protein, 12 aa, synthetic construct
  REGION 1..12: note = anti-influenza_CDR
GITNKVNSVIEK

SEQ ID NO: 7183 - protein, 12 aa, synthetic construct
  REGION 1..12: note = anti-influenza_CDR
GVTNKVNSIINK

SEQ ID NO: 7184 - protein, 12 aa, synthetic construct
  REGION 1..12: note = anti-influenza_CDR
HMGYQVRETMDV

SEQ ID NO: 7185 - protein, 12 aa, synthetic construct
  REGION 1..12: note = anti-influenza_CDR
ATWDRRPTAYVV

SEQ ID NO: 7186 - protein, 12 aa, synthetic construct
  REGION 1..12: note = anti-influenza_CDR
EGKWGPQAAFDI

SEQ ID NO: 7187 - protein, 12 aa, synthetic construct
  REGION 1..12: note = anti-influenza_CDR
GDKGIYYYYMDV

SEQ ID NO: 7188 - protein, 12 aa, synthetic construct
  REGION 1..12: note = anti-influenza_CDR
GSGYHISTPFDN

SEQ ID NO: 7189 - protein, 12 aa, synthetic construct
  REGION 1..12: note = anti-influenza_CDR
RASQSVSSSYLA

SEQ ID NO: 7190 - protein, 12 aa, synthetic construct
  REGION 1..12: note = anti-influenza_CDR
GSGYTTRNYFDY

SEQ ID NO: 7191 - protein, 12 aa, synthetic construct
  REGION 1..12: note = anti-influenza_CDR
RASQSVSSNYLG

SEQ ID NO: 7192 - protein, 12 aa, synthetic construct
  REGION 1..12: note = anti-influenza_CDR
GSTYDFSSGLDY

SEQ ID NO: 7193 - protein, 12 aa, synthetic construct
  REGION 1..12: note = anti-influenza_CDR
GVHHPGTDNDQI

SEQ ID NO: 7194 - protein, 12 aa, synthetic construct
  REGION 1..12: note = anti-influenza_CDR
GVHHPSTDSDQT

SEQ ID NO: 7195 - protein, 12 aa, synthetic construct
  REGION 1..12: note = anti-influenza_CDR
GVHHPSNETEQR

SEQ ID NO: 7196 - protein, 12 aa, synthetic construct
  REGION 1..12: note = anti-influenza_CDR
QSITFDYKNYLA

SEQ ID NO: 7197 - protein, 12 aa, synthetic construct
  REGION 1..12: note = anti-influenza_CDR
GGLIGTGSYYWG

SEQ ID NO: 7198 - protein, 12 aa, synthetic construct
  REGION 1..12: note = anti-influenza_CDR
ARYNWGIRYFDF

SEQ ID NO: 7199 - protein, 12 aa, synthetic construct
  REGION 1..12: note = anti-influenza_CDR
QSVLSNSKNLNY

SEQ ID NO: 7200 - protein, 12 aa, synthetic construct
  REGION 1..12: note = anti-influenza_CDR
CQVWETSEDLWV

SEQ ID NO: 7201 - protein, 13 aa, synthetic construct
  REGION 1..13: note = anti-influenza_CDR
ARGGRYYVDYFDY

SEQ ID NO: 7202 - protein, 13 aa, synthetic construct
  REGION 1..13: note = anti-influenza_CDR
ARSGDGYNYYFPL

SEQ ID NO: 7203 - protein, 13 aa, synthetic construct
  REGION 1..13: note = anti-influenza_CDR
ARGCGYNCYYFDG

SEQ ID NO: 7204 - protein, 13 aa, synthetic construct
  REGION 1..13: note = anti-influenza_CDR
SGSSSNIGSNTVN

SEQ ID NO: 7205 - protein, 13 aa, synthetic construct
  REGION 1..13: note = anti-influenza_CDR
DSPYSSSWSFFDY

SEQ ID NO: 7206 - protein, 13 aa, synthetic construct
  REGION 1..13: note = anti-influenza_CDR
SGSDSNIGDYFVC

SEQ ID NO: 7207 - protein, 13 aa, synthetic construct
  REGION 1..13: note = anti-influenza_CDR
ARMVVVTGDGFDV

SEQ ID NO: 7208 - protein, 13 aa, synthetic construct
  REGION 1..13: note = anti-influenza_CDR
WLSIINAGGGDID

SEQ ID NO: 7209 - protein, 13 aa, synthetic construct
  REGION 1..13: note = anti-influenza_CDR
AASSLQSGVPSRF

SEQ ID NO: 7210 - protein, 13 aa, synthetic construct
  REGION 1..13: note = anti-influenza_CDR
HDAKFSGSYYVAS

SEQ ID NO: 7211 - protein, 13 aa, synthetic construct
  REGION 1..13: note = anti-influenza_CDR
HDVKFSGSYYVAS

SEQ ID NO: 7212 - protein, 13 aa, synthetic construct
  REGION 1..13: note = anti-influenza_CDR
TGSESTTGYGMDV

SEQ ID NO: 7213 - protein, 13 aa, synthetic construct
  REGION 1..13: note = anti-influenza_CDR
AASTSVLGYGMDV

SEQ ID NO: 7214 - protein, 13 aa, synthetic construct
  REGION 1..13: note = anti-influenza_CDR
SGSTFNIGSNAVD

SEQ ID NO: 7215 - protein, 13 aa, synthetic construct
  REGION 1..13: note = anti-influenza_CDR
SGSRSNVGDNSVY

SEQ ID NO: 7216 - protein, 13 aa, synthetic construct
  REGION 1..13: note = anti-influenza_CDR
SGSSSNIGNDYVS

SEQ ID NO: 7217 - protein, 13 aa, synthetic construct
  REGION 1..13: note = anti-influenza_CDR
GGGSYGAYEGFDY

SEQ ID NO: 7218 - protein, 13 aa, synthetic construct
  REGION 1..13: note = anti-influenza_CDR
SGSSSNIGSNYVY

SEQ ID NO: 7219 - protein, 13 aa, synthetic construct
  REGION 1..13: note = anti-influenza_CDR
ARRQQLYKGYYHH

SEQ ID NO: 7220 - protein, 13 aa, synthetic construct
  REGION 1..13: note = anti-influenza_CDR
SGSTSNIGYNPVS

SEQ ID NO: 7221 - protein, 13 aa, synthetic construct
  REGION 1..13: note = anti-influenza_CDR
ARGMNYYSDYFDY

SEQ ID NO: 7222 - protein, 13 aa, synthetic construct
  REGION 1..13: note = anti-influenza_CDR
ARGHSGSYRLFDF

SEQ ID NO: 7223 - protein, 13 aa, synthetic construct
  REGION 1..13: note = anti-influenza_CDR
AKPLRGSYRYFDL

SEQ ID NO: 7224 - protein, 13 aa, synthetic construct
  REGION 1..13: note = anti-influenza_CDR
PIWVKTPLKLANG

SEQ ID NO: 7225 - protein, 13 aa, synthetic construct
  REGION 1..13: note = anti-influenza_CDR
QASQSVYNKNNLA

SEQ ID NO: 7226 - protein, 13 aa, synthetic construct
  REGION 1..13: note = anti-influenza_CDR
QSSESVYKNNNLA

SEQ ID NO: 7227 - protein, 13 aa, synthetic construct
  REGION 1..13: note = anti-influenza_CDR
QSSQSVDSNNQLS

SEQ ID NO: 7228 - protein, 13 aa, synthetic construct
  REGION 1..13: note = anti-influenza_CDR
QSSQSVDNNKDLA

SEQ ID NO: 7229 - protein, 13 aa, synthetic construct
  REGION 1..13: note = anti-influenza_CDR
QSSQSVYNNNRLS

SEQ ID NO: 7230 - protein, 13 aa, synthetic construct
  REGION 1..13: note = anti-influenza_CDR
QSSQSVYKNNNLA

SEQ ID NO: 7231 - protein, 13 aa, synthetic construct
  REGION 1..13: note = anti-influenza_CDR
GGGFGWSQTYFGY

SEQ ID NO: 7232 - protein, 14 aa, synthetic construct
  REGION 1..14: note = anti-influenza_CDR
WLGRTYYRSKWYND

SEQ ID NO: 7233 - protein, 14 aa, synthetic construct
  REGION 1..14: note = anti-influenza_CDR
GGLVGGYDEYFFDY

SEQ ID NO: 7234 - protein, 14 aa, synthetic construct
  REGION 1..14: note = anti-influenza_CDR
HPKYFYGSGSYPDF

SEQ ID NO: 7235 - protein, 14 aa, synthetic construct
  REGION 1..14: note = anti-influenza_CDR
TGSSSDVGASNSVS

SEQ ID NO: 7236 - protein, 14 aa, synthetic construct
  REGION 1..14: note = anti-influenza_CDR
GAYYDSSGYPAFYI

SEQ ID NO: 7237 - protein, 14 aa, synthetic construct
  REGION 1..14: note = anti-influenza_CDR
TGSSSNIGSDYDVH

SEQ ID NO: 7238 - protein, 14 aa, synthetic construct
  REGION 1..14: note = anti-influenza_CDR
EFETSGYFHGSFDY

SEQ ID NO: 7239 - protein, 14 aa, synthetic construct
  REGION 1..14: note = anti-influenza_CDR
ASSTGAVTSSYFPN

SEQ ID NO: 7240 - protein, 14 aa, synthetic construct
  REGION 1..14: note = anti-influenza_CDR
TGGSSDIGASNSVS

SEQ ID NO: 7241 - protein, 14 aa, synthetic construct
  REGION 1..14: note = anti-influenza_CDR
TGSSSDVGGYDYVS

SEQ ID NO: 7242 - protein, 14 aa, synthetic construct
  REGION 1..14: note = anti-influenza_CDR
GSSTGAVTRGHYPY

SEQ ID NO: 7243 - protein, 14 aa, synthetic construct
  REGION 1..14: note = anti-influenza_CDR
GSSTGPVTSGHYPY

SEQ ID NO: 7244 - protein, 14 aa, synthetic construct
  REGION 1..14: note = anti-influenza_CDR
HYGDSEAINDAFDI

SEQ ID NO: 7245 - protein, 14 aa, synthetic construct
  REGION 1..14: note = anti-influenza_CDR
TGSSSNIGAGYDVH

SEQ ID NO: 7246 - protein, 14 aa, synthetic construct
  REGION 1..14: note = anti-influenza_CDR
IPHYNFGSGSYFDY

SEQ ID NO: 7247 - protein, 14 aa, synthetic construct
  REGION 1..14: note = anti-influenza_CDR
TGTSSDVGGYNYVS

SEQ ID NO: 7248 - protein, 14 aa, synthetic construct
  REGION 1..14: note = anti-influenza_CDR
TGTSSDVGAYNYVS

SEQ ID NO: 7249 - protein, 14 aa, synthetic construct
  REGION 1..14: note = anti-influenza_CDR
AERPKVRGQAGRMN

SEQ ID NO: 7250 - protein, 14 aa, synthetic construct
  REGION 1..14: note = anti-influenza_CDR
GSRPWVRGVSSRIS

SEQ ID NO: 7251 - protein, 14 aa, synthetic construct
  REGION 1..14: note = anti-influenza_CDR
IWGVAAPGTAAAQI

SEQ ID NO: 7252 - protein, 14 aa, synthetic construct
  REGION 1..14: note = anti-influenza_CDR
WVRQPPGKGLEWVA

SEQ ID NO: 7253 - protein, 14 aa, synthetic construct
  REGION 1..14: note = anti-influenza_CDR
ARGPEGVWGRSIDS

SEQ ID NO: 7254 - protein, 14 aa, synthetic construct
  REGION 1..14: note = anti-influenza_CDR
ARDPDTPFVRAFDS

SEQ ID NO: 7255 - protein, 14 aa, synthetic construct
  REGION 1..14: note = anti-influenza_CDR
TGSTSDIGSYNYVS

SEQ ID NO: 7256 - protein, 14 aa, synthetic construct
  REGION 1..14: note = anti-influenza_CDR
WDWNFDLYLGWFDP

SEQ ID NO: 7257 - protein, 14 aa, synthetic construct
  REGION 1..14: note = anti-influenza_CDR
WAWNFDFFLGWFDP

SEQ ID NO: 7258 - protein, 14 aa, synthetic construct
  REGION 1..14: note = anti-influenza_CDR
GPGYSGYHYGWFDT

SEQ ID NO: 7259 - protein, 14 aa, synthetic construct
  REGION 1..14: note = anti-influenza_CDR
ARWDYGVYEGYIDY

SEQ ID NO: 7260 - protein, 15 aa, synthetic construct
  REGION 1..15: note = anti-influenza_CDR
ARAGTTLTRFNWFDP

SEQ ID NO: 7261 - protein, 15 aa, synthetic construct
  REGION 1..15: note = anti-influenza_CDR
ARAGTTVTRFNWFDP

SEQ ID NO: 7262 - protein, 15 aa, synthetic construct
  REGION 1..15: note = anti-influenza_CDR
ARGQRYYYDRDGMDV

SEQ ID NO: 7263 - protein, 15 aa, synthetic construct
  REGION 1..15: note = anti-influenza_CDR
ARSGGYLPQNNWIDP

SEQ ID NO: 7264 - protein, 15 aa, synthetic construct
  REGION 1..15: note = anti-influenza_CDR
MENERTLDFHDSNVK

SEQ ID NO: 7265 - protein, 15 aa, synthetic construct
  REGION 1..15: note = anti-influenza_CDR
GADHGSGSNFVSPYV

SEQ ID NO: 7266 - protein, 15 aa, synthetic construct
  REGION 1..15: note = anti-influenza_CDR
DTRSSLDNYQYGMDV

SEQ ID NO: 7267 - protein, 15 aa, synthetic construct
  REGION 1..15: note = anti-influenza_CDR
EDYDILTGAGPGMEV

SEQ ID NO: 7268 - protein, 15 aa, synthetic construct
  REGION 1..15: note = anti-influenza_CDR
HPYDVLTGSGDWFDP

SEQ ID NO: 7269 - protein, 15 aa, synthetic construct
  REGION 1..15: note = anti-influenza_CDR
GADHGSGNNFVSPYV

SEQ ID NO: 7270 - protein, 15 aa, synthetic construct
  REGION 1..15: note = anti-influenza_CDR
VIYSGGSTYYADSVK

SEQ ID NO: 7271 - protein, 15 aa, synthetic construct
  REGION 1..15: note = anti-influenza_CDR
WYQQKPGKAPKLLIY

SEQ ID NO: 7272 - protein, 15 aa, synthetic construct
  REGION 1..15: note = anti-influenza_CDR
DPYNDGTKYNEKFEG

SEQ ID NO: 7273 - protein, 15 aa, synthetic construct
  REGION 1..15: note = anti-influenza_CDR
ARAHTALTRFRWLDP

SEQ ID NO: 7274 - protein, 15 aa, synthetic construct
  REGION 1..15: note = anti-influenza_CDR
ASLDYDFSYYYHRDV

SEQ ID NO: 7275 - protein, 15 aa, synthetic construct
  REGION 1..15: note = anti-influenza_CDR
ARVATPYYYESGFDY

SEQ ID NO: 7276 - protein, 15 aa, synthetic construct
  REGION 1..15: note = anti-influenza_CDR
ARRGGGWQYYYGMDV

SEQ ID NO: 7277 - protein, 16 aa, synthetic construct
  REGION 1..16: note = anti-influenza_CDR
SGHITVFGVNVDAFDM

SEQ ID NO: 7278 - protein, 16 aa, synthetic construct
  REGION 1..16: note = anti-influenza_CDR
GGHITVFGLNIDAYDI

SEQ ID NO: 7279 - protein, 16 aa, synthetic construct
  REGION 1..16: note = anti-influenza_CDR
GGHITEFGLNIDAYDI

SEQ ID NO: 7280 - protein, 16 aa, synthetic construct
  REGION 1..16: note = anti-influenza_CDR
GGHITVFGVNIDAFDI

SEQ ID NO: 7281 - protein, 16 aa, synthetic construct
  REGION 1..16: note = anti-influenza_CDR
GGHITVFGVNIDAFDV

SEQ ID NO: 7282 - protein, 16 aa, synthetic construct
  REGION 1..16: note = anti-influenza_CDR
ARDGWGQQLVPYYFDY

SEQ ID NO: 7283 - protein, 16 aa, synthetic construct
  REGION 1..16: note = anti-influenza_CDR
DFWVSYYYDSSAPPAI

SEQ ID NO: 7284 - protein, 16 aa, synthetic construct
  REGION 1..16: note = anti-influenza_CDR
ARAGVKIFGLIVGALD

SEQ ID NO: 7285 - protein, 16 aa, synthetic construct
  REGION 1..16: note = anti-influenza_CDR
ARDGAGSYYPLNWFDP

SEQ ID NO: 7286 - protein, 16 aa, synthetic construct
  REGION 1..16: note = anti-influenza_CDR
VIYSHGRAYYSASVNG

SEQ ID NO: 7287 - protein, 16 aa, synthetic construct
  REGION 1..16: note = anti-influenza_CDR
DTLHNGYTNYNPSLRG

SEQ ID NO: 7288 - protein, 16 aa, synthetic construct
  REGION 1..16: note = anti-influenza_CDR
YISYNGRPKYNPSLTS

SEQ ID NO: 7289 - protein, 16 aa, synthetic construct
  REGION 1..16: note = anti-influenza_CDR
ETRFGELLSPYDAFEI

SEQ ID NO: 7290 - protein, 16 aa, synthetic construct
  REGION 1..16: note = anti-influenza_CDR
LIYWDDDKRYSPSLKR

SEQ ID NO: 7291 - protein, 16 aa, synthetic construct
  REGION 1..16: note = anti-influenza_CDR
YIYYIGNTDYRPSLKS

SEQ ID NO: 7292 - protein, 16 aa, synthetic construct
  REGION 1..16: note = anti-influenza_CDR
EISHGGSTNYNPSLKS

SEQ ID NO: 7293 - protein, 16 aa, synthetic construct
  REGION 1..16: note = anti-influenza_CDR
EINHSGRTNYNPSLKS

SEQ ID NO: 7294 - protein, 16 aa, synthetic construct
  REGION 1..16: note = anti-influenza_CDR
LISWDDEKHYSPSLQS

SEQ ID NO: 7295 - protein, 16 aa, synthetic construct
  REGION 1..16: note = anti-influenza_CDR
EGVYFDSGTYRGYFDY

SEQ ID NO: 7296 - protein, 16 aa, synthetic construct
  REGION 1..16: note = anti-influenza_CDR
YIYHSGSTNYNPSLKS

SEQ ID NO: 7297 - protein, 16 aa, synthetic construct
  REGION 1..16: note = anti-influenza_CDR
YIYYRGSTFYNPSLKS

SEQ ID NO: 7298 - protein, 16 aa, synthetic construct
  REGION 1..16: note = anti-influenza_CDR
YISYSGSTKYNPSLRS

SEQ ID NO: 7299 - protein, 16 aa, synthetic construct
  REGION 1..16: note = anti-influenza_CDR
EIKHSGRTNYNPSLES

SEQ ID NO: 7300 - protein, 16 aa, synthetic construct
  REGION 1..16: note = anti-influenza_CDR
EINHSGGTNYNPSLKR

SEQ ID NO: 7301 - protein, 16 aa, synthetic construct
  REGION 1..16: note = anti-influenza_CDR
FMYYSASTYYNPSLKS

SEQ ID NO: 7302 - protein, 16 aa, synthetic construct
  REGION 1..16: note = anti-influenza_CDR
YVYYSGSTTYNPSLKS

SEQ ID NO: 7303 - protein, 16 aa, synthetic construct
  REGION 1..16: note = anti-influenza_CDR
NIYYTGITFYNPSLSS

SEQ ID NO: 7304 - protein, 16 aa, synthetic construct
  REGION 1..16: note = anti-influenza_CDR
FIYYGGNTKYNPSLKS

SEQ ID NO: 7305 - protein, 16 aa, synthetic construct
  REGION 1..16: note = anti-influenza_CDR
FMFHSGSPRYNPTLKS

SEQ ID NO: 7306 - protein, 16 aa, synthetic construct
  REGION 1..16: note = anti-influenza_CDR
FFYNGGSTKYNPSLKS

SEQ ID NO: 7307 - protein, 16 aa, synthetic construct
  REGION 1..16: note = anti-influenza_CDR
HIYDYGRTFYNSSLQS

SEQ ID NO: 7308 - protein, 16 aa, synthetic construct
  REGION 1..16: note = anti-influenza_CDR
VFYSETRTYYADSVKG

SEQ ID NO: 7309 - protein, 16 aa, synthetic construct
  REGION 1..16: note = anti-influenza_CDR
YVYNRGSTKYSPSLKS

SEQ ID NO: 7310 - protein, 16 aa, synthetic construct
  REGION 1..16: note = anti-influenza_CDR
YIYNRGSTKYTPSLKS

SEQ ID NO: 7311 - protein, 16 aa, synthetic construct
  REGION 1..16: note = anti-influenza_CDR
YLYYSGSTKYNPSLKS

SEQ ID NO: 7312 - protein, 16 aa, synthetic construct
  REGION 1..16: note = anti-influenza_CDR
YVYNSGNTKYNPSLKS

SEQ ID NO: 7313 - protein, 16 aa, synthetic construct
  REGION 1..16: note = anti-influenza_CDR
HIFDSGSTYYNPSLKS

SEQ ID NO: 7314 - protein, 16 aa, synthetic construct
  REGION 1..16: note = anti-influenza_CDR
VFYSADRTSYADSVKG

SEQ ID NO: 7315 - protein, 16 aa, synthetic construct
  REGION 1..16: note = anti-influenza_CDR
YIYYSGNTYYNPSLKS

SEQ ID NO: 7316 - protein, 16 aa, synthetic construct
  REGION 1..16: note = anti-influenza_CDR
RSSQSLLHSNGYNYLD

SEQ ID NO: 7317 - protein, 16 aa, synthetic construct
  REGION 1..16: note = anti-influenza_CDR
TIYHSGSTYYNPSLKS

SEQ ID NO: 7318 - protein, 16 aa, synthetic construct
  REGION 1..16: note = anti-influenza_CDR
RSSQSLLHSNGHIYFD

SEQ ID NO: 7319 - protein, 16 aa, synthetic construct
  REGION 1..16: note = anti-influenza_CDR
IWGVAAPSTASAQTSL

SEQ ID NO: 7320 - protein, 16 aa, synthetic construct
  REGION 1..16: note = anti-influenza_CDR
RSSQSLLYTDGFTYLS

SEQ ID NO: 7321 - protein, 16 aa, synthetic construct
  REGION 1..16: note = anti-influenza_CDR
AKPRLDYLDYFHAADS

SEQ ID NO: 7322 - protein, 16 aa, synthetic construct
  REGION 1..16: note = anti-influenza_CDR
ARSPGYSGYLYGWFDP

SEQ ID NO: 7323 - protein, 16 aa, synthetic construct
  REGION 1..16: note = anti-influenza_CDR
AIAGSGSADYASWAKG

SEQ ID NO: 7324 - protein, 16 aa, synthetic construct
  REGION 1..16: note = anti-influenza_CDR
AIAGSGSADYASWAKS

SEQ ID NO: 7325 - protein, 16 aa, synthetic construct
  REGION 1..16: note = anti-influenza_CDR
AIGGGGSADYASWAKS

SEQ ID NO: 7326 - protein, 16 aa, synthetic construct
  REGION 1..16: note = anti-influenza_CDR
RSSQSLLRSNGYNYLD

SEQ ID NO: 7327 - protein, 16 aa, synthetic construct
  REGION 1..16: note = anti-influenza_CDR
QGDHIAWLLRGINFDY

SEQ ID NO: 7328 - protein, 17 aa, synthetic construct
  REGION 1..17: note = anti-influenza_CDR
ARLGSGSYHNGPNWFDP

SEQ ID NO: 7329 - protein, 17 aa, synthetic construct
  REGION 1..17: note = anti-influenza_CDR
ARAENLLSPYLAEGFDP

SEQ ID NO: 7330 - protein, 17 aa, synthetic construct
  REGION 1..17: note = anti-influenza_CDR
VISYDGSNKYYADSVKG

SEQ ID NO: 7331 - protein, 17 aa, synthetic construct
  REGION 1..17: note = anti-influenza_CDR
GTIPLLGTTNYAQKFQG

SEQ ID NO: 7332 - protein, 17 aa, synthetic construct
  REGION 1..17: note = anti-influenza_CDR
GIIAVFNTANYAQKFQG

SEQ ID NO: 7333 - protein, 17 aa, synthetic construct
  REGION 1..17: note = anti-influenza_CDR
NIEDDGGDKYYVDSVKG

SEQ ID NO: 7334 - protein, 17 aa, synthetic construct
  REGION 1..17: note = anti-influenza_CDR
WINPNSGTTGSAQRFQG

SEQ ID NO: 7335 - protein, 17 aa, synthetic construct
  REGION 1..17: note = anti-influenza_CDR
GINPVFGRPHYAQKFQG

SEQ ID NO: 7336 - protein, 17 aa, synthetic construct
  REGION 1..17: note = anti-influenza_CDR
GIIPLINAPNYAPKFQG

SEQ ID NO: 7337 - protein, 17 aa, synthetic construct
  REGION 1..17: note = anti-influenza_CDR
GIIPMMGTVNYAQKLQG

SEQ ID NO: 7338 - protein, 17 aa, synthetic construct
  REGION 1..17: note = anti-influenza_CDR
GIIPLFGAAKYAQKFQG

SEQ ID NO: 7339 - protein, 17 aa, synthetic construct
  REGION 1..17: note = anti-influenza_CDR
KSSQRVLYSSNNKNYLA

SEQ ID NO: 7340 - protein, 17 aa, synthetic construct
  REGION 1..17: note = anti-influenza_CDR
LISDDGSNKFYADSVKG

SEQ ID NO: 7341 - protein, 17 aa, synthetic construct
  REGION 1..17: note = anti-influenza_CDR
IISYDGNDQYYTDSVKG

SEQ ID NO: 7342 - protein, 17 aa, synthetic construct
  REGION 1..17: note = anti-influenza_CDR
WISTYNGNTNFAQNFQG

SEQ ID NO: 7343 - protein, 17 aa, synthetic construct
  REGION 1..17: note = anti-influenza_CDR
VEGSYRDFWNNQNRFDP

SEQ ID NO: 7344 - protein, 17 aa, synthetic construct
  REGION 1..17: note = anti-influenza_CDR
WINPNSGDTNYAQKFQG

SEQ ID NO: 7345 - protein, 17 aa, synthetic construct
  REGION 1..17: note = anti-influenza_CDR
KSSQSVLYSSNNKSHLA

SEQ ID NO: 7346 - protein, 17 aa, synthetic construct
  REGION 1..17: note = anti-influenza_CDR
IIYPGDSDTRYSPSFQG

SEQ ID NO: 7347 - protein, 17 aa, synthetic construct
  REGION 1..17: note = anti-influenza_CDR
GIIPVFPTPNYAQMFQG

SEQ ID NO: 7348 - protein, 17 aa, synthetic construct
  REGION 1..17: note = anti-influenza_CDR
GIVPVFGTANYAQKFQG

SEQ ID NO: 7349 - protein, 17 aa, synthetic construct
  REGION 1..17: note = anti-influenza_CDR
WINPESGDTKYAQKFQG

SEQ ID NO: 7350 - protein, 17 aa, synthetic construct
  REGION 1..17: note = anti-influenza_CDR
RSSQSIFHNSNNENYLA

SEQ ID NO: 7351 - protein, 17 aa, synthetic construct
  REGION 1..17: note = anti-influenza_CDR
WINAKRGGTNYAQKFQG

SEQ ID NO: 7352 - protein, 17 aa, synthetic construct
  REGION 1..17: note = anti-influenza_CDR
WINPDSGATSSAQNFQG

SEQ ID NO: 7353 - protein, 17 aa, synthetic construct
  REGION 1..17: note = anti-influenza_CDR
WISPDSDATKYAQKFQG

SEQ ID NO: 7354 - protein, 17 aa, synthetic construct
  REGION 1..17: note = anti-influenza_CDR
NIKQDGREKYYVDSLRG

SEQ ID NO: 7355 - protein, 17 aa, synthetic construct
  REGION 1..17: note = anti-influenza_CDR
GIIAIFGTPKYAQKFQG

SEQ ID NO: 7356 - protein, 17 aa, synthetic construct
  REGION 1..17: note = anti-influenza_CDR
KSSQSILNSSNNKNYLA

SEQ ID NO: 7357 - protein, 17 aa, synthetic construct
  REGION 1..17: note = anti-influenza_CDR
WISAYNGNTNYAQKFQG

SEQ ID NO: 7358 - protein, 17 aa, synthetic construct
  REGION 1..17: note = anti-influenza_CDR
GVIPIFRTANYAQNFQG

SEQ ID NO: 7359 - protein, 17 aa, synthetic construct
  REGION 1..17: note = anti-influenza_CDR
GIIAIFHTPKYAQKFQG

SEQ ID NO: 7360 - protein, 17 aa, synthetic construct
  REGION 1..17: note = anti-influenza_CDR
GISPMFGTTTYAQKFQG

SEQ ID NO: 7361 - protein, 17 aa, synthetic construct
  REGION 1..17: note = anti-influenza_CDR
KSSQSVLYSSNNKNYLA

SEQ ID NO: 7362 - protein, 17 aa, synthetic construct
  REGION 1..17: note = anti-influenza_CDR
GIIPIFGTTKYAPKFQG

SEQ ID NO: 7363 - protein, 17 aa, synthetic construct
  REGION 1..17: note = anti-influenza_CDR
GISPLFGTTNYAQKFQG

SEQ ID NO: 7364 - protein, 17 aa, synthetic construct
  REGION 1..17: note = anti-influenza_CDR
GIMGMFGTTNYAQKFQG

SEQ ID NO: 7365 - protein, 17 aa, synthetic construct
  REGION 1..17: note = anti-influenza_CDR
GIIGMFGSTNYAQNFQG

SEQ ID NO: 7366 - protein, 17 aa, synthetic construct
  REGION 1..17: note = anti-influenza_CDR
WINPNSGGTNYAQKFQG

SEQ ID NO: 7367 - protein, 17 aa, synthetic construct
  REGION 1..17: note = anti-influenza_CDR
AISSSGDSTYYADSVKG

SEQ ID NO: 7368 - protein, 17 aa, synthetic construct
  REGION 1..17: note = anti-influenza_CDR
SISSSSSYIYYVDSVKG

SEQ ID NO: 7369 - protein, 17 aa, synthetic construct
  REGION 1..17: note = anti-influenza_CDR
DIIGMFGSTNYAQNFQG

SEQ ID NO: 7370 - protein, 17 aa, synthetic construct
  REGION 1..17: note = anti-influenza_CDR
GIIPMFGTTNYAQKFQG

SEQ ID NO: 7371 - protein, 17 aa, synthetic construct
  REGION 1..17: note = anti-influenza_CDR
GIIAIFGTANYAQKFQG

SEQ ID NO: 7372 - protein, 17 aa, synthetic construct
  REGION 1..17: note = anti-influenza_CDR
GIIPIFGTTNYAQKFQG

SEQ ID NO: 7373 - protein, 17 aa, synthetic construct
  REGION 1..17: note = anti-influenza_CDR
GIFALFGTTDYAQKFQG

SEQ ID NO: 7374 - protein, 17 aa, synthetic construct
  REGION 1..17: note = anti-influenza_CDR
GIIGMFGTANYAQKFQG

SEQ ID NO: 7375 - protein, 17 aa, synthetic construct
  REGION 1..17: note = anti-influenza_CDR
GIIAVFGTTKYAHKFQG

SEQ ID NO: 7376 - protein, 17 aa, synthetic construct
  REGION 1..17: note = anti-influenza_CDR
GILGVFGSPSYAQKFQG

SEQ ID NO: 7377 - protein, 17 aa, synthetic construct
  REGION 1..17: note = anti-influenza_CDR
GIFGMFGTANYAQKFQG

SEQ ID NO: 7378 - protein, 17 aa, synthetic construct
  REGION 1..17: note = anti-influenza_CDR
WISAYTGDTDYAQKFQG

SEQ ID NO: 7379 - protein, 17 aa, synthetic construct
  REGION 1..17: note = anti-influenza_CDR
SFDPEDGETIYAQKFQG

SEQ ID NO: 7380 - protein, 17 aa, synthetic construct
  REGION 1..17: note = anti-influenza_CDR
GISGSGESTYYADSVKG

SEQ ID NO: 7381 - protein, 17 aa, synthetic construct
  REGION 1..17: note = anti-influenza_CDR
VVSYDGNYKYYADSVQG

SEQ ID NO: 7382 - protein, 17 aa, synthetic construct
  REGION 1..17: note = anti-influenza_CDR
GSISYSGSTYYHPSLKS

SEQ ID NO: 7383 - protein, 17 aa, synthetic construct
  REGION 1..17: note = anti-influenza_CDR
TRGRPIGRNWEPRDKDY

SEQ ID NO: 7384 - protein, 17 aa, synthetic construct
  REGION 1..17: note = anti-influenza_CDR
AREAGYHSSFSGVYFDY

SEQ ID NO: 7385 - protein, 17 aa, synthetic construct
  REGION 1..17: note = anti-influenza_CDR
RIDPNGSGTTYAQKFQG

SEQ ID NO: 7386 - protein, 17 aa, synthetic construct
  REGION 1..17: note = anti-influenza_CDR
RIDPNGAGTTYAQKFQG

SEQ ID NO: 7387 - protein, 17 aa, synthetic construct
  REGION 1..17: note = anti-influenza_CDR
WIDPNNDGTIYAQKFQG

SEQ ID NO: 7388 - protein, 17 aa, synthetic construct
  REGION 1..17: note = anti-influenza_CDR
MMYPGDSDTIYSPSFQG

SEQ ID NO: 7389 - protein, 17 aa, synthetic construct
  REGION 1..17: note = anti-influenza_CDR
MMYPGDADAIYSPSFQG

SEQ ID NO: 7390 - protein, 17 aa, synthetic construct
  REGION 1..17: note = anti-influenza_CDR
MMYPGESETIYSPSFQG

SEQ ID NO: 7391 - protein, 17 aa, synthetic construct
  REGION 1..17: note = anti-influenza_CDR
MMYPGDADTIYSPSFQG

SEQ ID NO: 7392 - protein, 17 aa, synthetic construct
  REGION 1..17: note = anti-influenza_CDR
MMYPGSSDTIYSPSFQG

SEQ ID NO: 7393 - protein, 17 aa, synthetic construct
  REGION 1..17: note = anti-influenza_CDR
MMYPGDSDAIYSPSFQG

SEQ ID NO: 7394 - protein, 17 aa, synthetic construct
  REGION 1..17: note = anti-influenza_CDR
MMYPGDTDTIYSPSFQG

SEQ ID NO: 7395 - protein, 17 aa, synthetic construct
  REGION 1..17: note = anti-influenza_CDR
MMYPGESDTIYSPSFQG

SEQ ID NO: 7396 - protein, 17 aa, synthetic construct
  REGION 1..17: note = anti-influenza_CDR
VISWDSGRIGYADSVKG

SEQ ID NO: 7397 - protein, 17 aa, synthetic construct
  REGION 1..17: note = anti-influenza_CDR
VRSGAYYFNYLVPYFDY

SEQ ID NO: 7398 - protein, 17 aa, synthetic construct
  REGION 1..17: note = anti-influenza_CDR
VRSGAYYVNYLVPYFDY

SEQ ID NO: 7399 - protein, 17 aa, synthetic construct
  REGION 1..17: note = anti-influenza_CDR
IISWDSGRIGYADSVRG

SEQ ID NO: 7400 - protein, 17 aa, synthetic construct
  REGION 1..17: note = anti-influenza_CDR
HGGVYYYGSASSGWFDP

SEQ ID NO: 7401 - protein, 18 aa, synthetic construct
  REGION 1..18: note = anti-influenza_CDR
RTYYRSKWYNDYAESVKS

SEQ ID NO: 7402 - protein, 18 aa, synthetic construct
  REGION 1..18: note = anti-influenza_CDR
RTYYRSKWYYDYAESVKS

SEQ ID NO: 7403 - protein, 18 aa, synthetic construct
  REGION 1..18: note = anti-influenza_CDR
RTYYRSKWYNDYAVSVKS

SEQ ID NO: 7404 - protein, 18 aa, synthetic construct
  REGION 1..18: note = anti-influenza_CDR
RTYYRSKWYNDYADFLKR

SEQ ID NO: 7405 - protein, 18 aa, synthetic construct
  REGION 1..18: note = anti-influenza_CDR
RTYYRSGWYNDYAESVKS

SEQ ID NO: 7406 - protein, 18 aa, synthetic construct
  REGION 1..18: note = anti-influenza_CDR
ARLGGNKDYGDYLWYFDL

SEQ ID NO: 7407 - protein, 18 aa, synthetic construct
  REGION 1..18: note = anti-influenza_CDR
AKDTADHGDYVDLGFFDA

SEQ ID NO: 7408 - protein, 18 aa, synthetic construct
  REGION 1..18: note = anti-influenza_CDR
ARSGIFDWSAPLVEAFDI

SEQ ID NO: 7409 - protein, 18 aa, synthetic construct
  REGION 1..18: note = anti-influenza_CDR
ARHASCSARSCYWGPVDY

SEQ ID NO: 7410 - protein, 18 aa, synthetic construct
  REGION 1..18: note = anti-influenza_CDR
DAPPNVEVASMTNWYFDL

SEQ ID NO: 7411 - protein, 18 aa, synthetic construct
  REGION 1..18: note = anti-influenza_CDR
LRTDYGDPDSVYYYGMDV

SEQ ID NO: 7412 - protein, 18 aa, synthetic construct
  REGION 1..18: note = anti-influenza_CDR
GTCAGDCSLHYYYYGLDV

SEQ ID NO: 7413 - protein, 18 aa, synthetic construct
  REGION 1..18: note = anti-influenza_CDR
HVSVSHGGRTKSNPSVMS

SEQ ID NO: 7414 - protein, 18 aa, synthetic construct
  REGION 1..18: note = anti-influenza_CDR
ALIYFDGSKQYYADSVKG

SEQ ID NO: 7415 - protein, 18 aa, synthetic construct
  REGION 1..18: note = anti-influenza_CDR
TLISYDGANQYYADSVKG

SEQ ID NO: 7416 - protein, 18 aa, synthetic construct
  REGION 1..18: note = anti-influenza_CDR
AVPGPVFGIFPPWSYFDN

SEQ ID NO: 7417 - protein, 18 aa, synthetic construct
  REGION 1..18: note = anti-influenza_CDR
GGIIPIFGAANYAQKFQG

SEQ ID NO: 7418 - protein, 18 aa, synthetic construct
  REGION 1..18: note = anti-influenza_CDR
GWISAYTGNTHYAKNFEG

SEQ ID NO: 7419 - protein, 18 aa, synthetic construct
  REGION 1..18: note = anti-influenza_CDR
GWINPNFGGTHYARKFQG

SEQ ID NO: 7420 - protein, 18 aa, synthetic construct
  REGION 1..18: note = anti-influenza_CDR
VRWRAAAVIMDQFYKMDV

SEQ ID NO: 7421 - protein, 18 aa, synthetic construct
  REGION 1..18: note = anti-influenza_CDR
AVPGPIFGIFPPWSYFDH

SEQ ID NO: 7422 - protein, 18 aa, synthetic construct
  REGION 1..18: note = anti-influenza_CDR
AASTATSGTYYAMRPFDF

SEQ ID NO: 7423 - protein, 19 aa, synthetic construct
  REGION 1..19: note = anti-influenza_CDR
ARGKRPGYCSGGVCSSDYW

SEQ ID NO: 7424 - protein, 19 aa, synthetic construct
  REGION 1..19: note = anti-influenza_CDR
ARHYPYYDLPTGFYSQFDF

SEQ ID NO: 7425 - protein, 19 aa, synthetic construct
  REGION 1..19: note = anti-influenza_CDR
GSGGYGGFDYFGKLRTWDF

SEQ ID NO: 7426 - protein, 19 aa, synthetic construct
  REGION 1..19: note = anti-influenza_CDR
FIRTRPWGGTADTAASVKG

SEQ ID NO: 7427 - protein, 19 aa, synthetic construct
  REGION 1..19: note = anti-influenza_CDR
LNYHDSGTYYNAPRGWFDP

SEQ ID NO: 7428 - protein, 19 aa, synthetic construct
  REGION 1..19: note = anti-influenza_CDR
VKDGYCTLTSCPVGWYFDL

SEQ ID NO: 7429 - protein, 19 aa, synthetic construct
  REGION 1..19: note = anti-influenza_CDR
AVPGPIFGIFPPWSYFDHW

SEQ ID NO: 7430 - protein, 19 aa, synthetic construct
  REGION 1..19: note = anti-influenza_CDR
ARAMIQGVVTLYLRPGDYW

SEQ ID NO: 7431 - protein, 19 aa, synthetic construct
  REGION 1..19: note = anti-influenza_CDR
AKVGPYTGYDDYNYYGMDV

SEQ ID NO: 7432 - protein, 19 aa, synthetic construct
  REGION 1..19: note = anti-influenza_CDR
AKVERSFYDGSGYGDALEI

SEQ ID NO: 7433 - protein, 19 aa, synthetic construct
  REGION 1..19: note = anti-influenza_CDR
YCARGRVNSGYDWGPNFDS

SEQ ID NO: 7434 - protein, 19 aa, synthetic construct
  REGION 1..19: note = anti-influenza_CDR
FCARGSPNSGYDWGPHFDY

SEQ ID NO: 7435 - protein, 19 aa, synthetic construct
  REGION 1..19: note = anti-influenza_CDR
RIKSNTDGGTTDYAAPVKG

SEQ ID NO: 7436 - protein, 19 aa, synthetic construct
  REGION 1..19: note = anti-influenza_CDR
LRLQGEVVVPPSQSNWFDP

SEQ ID NO: 7437 - protein, 20 aa, synthetic construct
  REGION 1..20: note = anti-influenza_CDR
AKEGGNTIFGLVTMAYYFDS

SEQ ID NO: 7438 - protein, 20 aa, synthetic construct
  REGION 1..20: note = anti-influenza_CDR
ARAGGDSSGYYGALGRFFQH

SEQ ID NO: 7439 - protein, 20 aa, synthetic construct
  REGION 1..20: note = anti-influenza_CDR
AKDSRGYCSSIICFEGGLDN

SEQ ID NO: 7440 - protein, 20 aa, synthetic construct
  REGION 1..20: note = anti-influenza_CDR
GSGSSDRSDYDPHYYYYLDV

SEQ ID NO: 7441 - protein, 20 aa, synthetic construct
  REGION 1..20: note = anti-influenza_CDR
GTDPDTEVYCRVGNCAAFDY

SEQ ID NO: 7442 - protein, 20 aa, synthetic construct
  REGION 1..20: note = anti-influenza_CDR
GTSHVSRYFDWLPPTNWFDP

SEQ ID NO: 7443 - protein, 20 aa, synthetic construct
  REGION 1..20: note = anti-influenza_CDR
GTDPDTEGYCRSGSCSAFDF

SEQ ID NO: 7444 - protein, 20 aa, synthetic construct
  REGION 1..20: note = anti-influenza_CDR
GTDPDTEVYCRAGNCAAFDF

SEQ ID NO: 7445 - protein, 20 aa, synthetic construct
  REGION 1..20: note = anti-influenza_CDR
RGGHSFGYGSGGDTHSEFDS

SEQ ID NO: 7446 - protein, 20 aa, synthetic construct
  REGION 1..20: note = anti-influenza_CDR
HMSMQQVVSAGWERADLVGD

SEQ ID NO: 7447 - protein, 20 aa, synthetic construct
  REGION 1..20: note = anti-influenza_CDR
DSRLRSLLYFEWLSQGYFNP

SEQ ID NO: 7448 - protein, 20 aa, synthetic construct
  REGION 1..20: note = anti-influenza_CDR
ARHLGQQLVSNTYYYYGMDV

SEQ ID NO: 7449 - protein, 21 aa, synthetic construct
  REGION 1..21: note = anti-influenza_CDR
TTGGTTTCTAAGCGGGCCTCC

SEQ ID NO: 7450 - protein, 21 aa, synthetic construct
  REGION 1..21: note = anti-influenza_CDR
ARAADESVESLTIKAFRTNYH

SEQ ID NO: 7451 - protein, 21 aa, synthetic construct
  REGION 1..21: note = anti-influenza_CDR
ARMPLANYDLLTGLYIGAFDL

SEQ ID NO: 7452 - protein, 21 aa, synthetic construct
  REGION 1..21: note = anti-influenza_CDR
DMLAYYSDNSGKKYNVYGMDV

SEQ ID NO: 7453 - protein, 21 aa, synthetic construct
  REGION 1..21: note = anti-influenza_CDR
DMLAYYYDGSGIRYNLYGMDV

SEQ ID NO: 7454 - protein, 22 aa, synthetic construct
  REGION 1..22: note = anti-influenza_CDR
AKDPRLRHLLYFPFTSMIYFDY

SEQ ID NO: 7455 - protein, 22 aa, synthetic construct
  REGION 1..22: note = anti-influenza_CDR
AKDSQLRSLLYFEWLSQGYFDP

SEQ ID NO: 7456 - protein, 22 aa, synthetic construct
  REGION 1..22: note = anti-influenza_CDR
AKDSQLRSLLYFEWLSQGYFDY

SEQ ID NO: 7457 - protein, 22 aa, synthetic construct
  REGION 1..22: note = anti-influenza_CDR
AKDSQLRSLLYFEWLSQGYFEP

SEQ ID NO: 7458 - protein, 22 aa, synthetic construct
  REGION 1..22: note = anti-influenza_CDR
AKERPLRLLRYFDWLSGGANDY

SEQ ID NO: 7459 - protein, 22 aa, synthetic construct
  REGION 1..22: note = anti-influenza_CDR
ARDVHNYDFLTGYPLHLYGMDV

SEQ ID NO: 7460 - protein, 22 aa, synthetic construct
  REGION 1..22: note = anti-influenza_CDR
ARDGREGYFYGSGSFYNLKGLN

SEQ ID NO: 7461 - protein, 22 aa, synthetic construct
  REGION 1..22: note = anti-influenza_CDR
STDRGHVLRYFGWMLPGDAFDV

SEQ ID NO: 7462 - protein, 22 aa, synthetic construct
  REGION 1..22: note = anti-influenza_CDR
LNYYDRSGYHSPDGPSNNWFDP

SEQ ID NO: 7463 - protein, 22 aa, synthetic construct
  REGION 1..22: note = anti-influenza_CDR
ARVPRDRLLTLYYESSTYGFDY

SEQ ID NO: 7464 - protein, 22 aa, synthetic construct
  REGION 1..22: note = anti-influenza_CDR
ARKWGRMTVFGVATDQLYYFDY

SEQ ID NO: 7465 - protein, 22 aa, synthetic construct
  REGION 1..22: note = anti-influenza_CDR
ATDIVVERDASLGGFNSYGMDV

SEQ ID NO: 7466 - protein, 23 aa, synthetic construct
  REGION 1..23: note = anti-influenza_CDR
ARNLPDIAVVTAVQDATPVWFDP

SEQ ID NO: 7467 - protein, 23 aa, synthetic construct
  REGION 1..23: note = anti-influenza_CDR
DGPYSDDFRSGYAARYRYFGMDV

SEQ ID NO: 7468 - protein, 24 aa, synthetic construct
  REGION 1..24: note = anti-influenza_CDR
GRELLRLQHFLTDSQSERRDCFDP

SEQ ID NO: 7469 - protein, 24 aa, synthetic construct
  REGION 1..24: note = anti-influenza_CDR
MSLLTEVETPTRNEWGCRCNDSSD

SEQ ID NO: 7470 - protein, 24 aa, synthetic construct
  REGION 1..24: note = anti-influenza_CDR
MSLLTEVETPTKNEWECRCNDSSD

SEQ ID NO: 7471 - protein, 24 aa, synthetic construct
  REGION 1..24: note = anti-influenza_CDR
MSLLTEVETPIRNEWECRCNDSSD

SEQ ID NO: 7472 - protein, 24 aa, synthetic construct
  REGION 1..24: note = anti-influenza_CDR
MSLLTEVETPIRNGWECKCNDSSD

SEQ ID NO: 7473 - protein, 24 aa, synthetic construct
  REGION 1..24: note = anti-influenza_CDR
MSLLTEVETPIRSEWGCRCNDSSD

SEQ ID NO: 7474 - protein, 24 aa, synthetic construct
  REGION 1..24: note = anti-influenza_CDR
MSFLPEVETPIRNEWGCRCNDSSD

SEQ ID NO: 7475 - protein, 24 aa, synthetic construct
  REGION 1..24: note = anti-influenza_CDR
MSLLTEVETPIRNEWGCRCNDSSN

SEQ ID NO: 7476 - protein, 24 aa, synthetic construct
  REGION 1..24: note = anti-influenza_CDR
MSLLTEVETPIRKEWGCRCNDSSD

SEQ ID NO: 7477 - protein, 24 aa, synthetic construct
  REGION 1..24: note = anti-influenza_CDR
MSFLTEVETPIRNEWGCRCNDSSD

SEQ ID NO: 7478 - protein, 24 aa, synthetic construct
  REGION 1..24: note = anti-influenza_CDR
MSLPTEVETPIRSEWGCRCNDSSD

SEQ ID NO: 7479 - protein, 24 aa, synthetic construct
  REGION 1..24: note = anti-influenza_CDR
MSLLPEVETPIRNEWGCRCNDSSD

SEQ ID NO: 7480 - protein, 24 aa, synthetic construct
  REGION 1..24: note = anti-influenza_CDR
MSLLPEVETPIRNGWGCRCNDSSD

SEQ ID NO: 7481 - protein, 24 aa, synthetic construct
  REGION 1..24: note = anti-influenza_CDR
MSLLTEVETPTRNGWECRCSGSSD

SEQ ID NO: 7482 - protein, 24 aa, synthetic construct
  REGION 1..24: note = anti-influenza_CDR
MSLLTEVETPIRNEWEYRCNDSSD

SEQ ID NO: 7483 - protein, 24 aa, synthetic construct
  REGION 1..24: note = anti-influenza_CDR
MSLLTEVETPIRNEWEYRCSDSSD

SEQ ID NO: 7484 - protein, 24 aa, synthetic construct
  REGION 1..24: note = anti-influenza_CDR
MSLLTEVETPTRNGWECRYSDSSD

SEQ ID NO: 7485 - protein, 24 aa, synthetic construct
  REGION 1..24: note = anti-influenza_CDR
MSFLTEVETLTRNGWECRCSDSSD

SEQ ID NO: 7486 - protein, 24 aa, synthetic construct
  REGION 1..24: note = anti-influenza_CDR
MSLLTEVETLTRNGWECKCRDSSD

SEQ ID NO: 7487 - protein, 24 aa, synthetic construct
  REGION 1..24: note = anti-influenza_CDR
MSLLTEVETPIRNEWGCRCNDSSD

SEQ ID NO: 7488 - protein, 24 aa, synthetic construct
  REGION 1..24: note = anti-influenza_CDR
MSLLTEVETPIRSEWGCRCNDSGD

SEQ ID NO: 7489 - protein, 24 aa, synthetic construct
  REGION 1..24: note = anti-influenza_CDR
MSLLTEVETPIRNEWECRCNGSSD

SEQ ID NO: 7490 - protein, 24 aa, synthetic construct
  REGION 1..24: note = anti-influenza_CDR
MSLPTEVETPIRNEWGCRCNDSSD

SEQ ID NO: 7491 - protein, 24 aa, synthetic construct
  REGION 1..24: note = anti-influenza_CDR
MSLLTEVETPIRNEWGCRCNGSSD

SEQ ID NO: 7492 - protein, 24 aa, synthetic construct
  REGION 1..24: note = anti-influenza_CDR
MSLLTEVDTLTRNGWGCRCSDSSD

SEQ ID NO: 7493 - protein, 24 aa, synthetic construct
  REGION 1..24: note = anti-influenza_CDR
MSLLTEVETLTKNGWGCRCSDSSD

SEQ ID NO: 7494 - protein, 24 aa, synthetic construct
  REGION 1..24: note = anti-influenza_CDR
MSLLTEVETPTRNGWECKCSDSSD

SEQ ID NO: 7495 - protein, 24 aa, synthetic construct
  REGION 1..24: note = anti-influenza_CDR
MSLLTEVETHTRNGWECKCSDSSD

SEQ ID NO: 7496 - protein, 24 aa, synthetic construct
  REGION 1..24: note = anti-influenza_CDR
MSLLTEVKTPTRNGWECKCSDSSD

SEQ ID NO: 7497 - protein, 24 aa, synthetic construct
  REGION 1..24: note = anti-influenza_CDR
MSLLTEVETLTRNGWGCRCSDSSD

SEQ ID NO: 7498 - protein, 24 aa, synthetic construct
  REGION 1..24: note = anti-influenza_CDR
MSLLTEVETPTRDGWECKCSDSSD

SEQ ID NO: 7499 - protein, 24 aa, synthetic construct
  REGION 1..24: note = anti-influenza_CDR
MSLLTEVETPTRNGWGCRCSDSSD

SEQ ID NO: 7500 - protein, 24 aa, synthetic construct
  REGION 1..24: note = anti-influenza_CDR
MSLLTEVETPTRNGWECKCNDSSD

SEQ ID NO: 7501 - protein, 24 aa, synthetic construct
  REGION 1..24: note = anti-influenza_CDR
MSLLTEVETLTRNGWECKCSDSSD

SEQ ID NO: 7502 - protein, 24 aa, synthetic construct
  REGION 1..24: note = anti-influenza_CDR
MSLLTEVETPIRNEWGCKCNDSSD

SEQ ID NO: 7503 - protein, 24 aa, synthetic construct
  REGION 1..24: note = anti-influenza_CDR
MSFLTEVETPIRNEWGCRCNGSSD

SEQ ID NO: 7504 - protein, 24 aa, synthetic construct
  REGION 1..24: note = anti-influenza_CDR
MSLLTEVETPTRNGWECRCNDSSD

SEQ ID NO: 7505 - protein, 24 aa, synthetic construct
  REGION 1..24: note = anti-influenza_CDR
MSLLTEVETPIRKGWECNCSDSSD

SEQ ID NO: 7506 - protein, 24 aa, synthetic construct
  REGION 1..24: note = anti-influenza_CDR
MSLLTEVETPTRNEWECRCSDSSD

SEQ ID NO: 7507 - protein, 24 aa, synthetic construct
  REGION 1..24: note = anti-influenza_CDR
MSLLTGVETHTRNGWGCKCSDSSD

SEQ ID NO: 7508 - protein, 24 aa, synthetic construct
  REGION 1..24: note = anti-influenza_CDR
MSLLPEVETHTRNGWGCRCSDSSD

SEQ ID NO: 7509 - protein, 24 aa, synthetic construct
  REGION 1..24: note = anti-influenza_CDR
TDGPYSDDFRSGYAARYRYFGMDV

SEQ ID NO: 7510 - protein, 25 aa, synthetic construct
  REGION 1..25: note = anti-influenza_CDR
AKHMSLQQVVSAGWERADLVGDAFD

SEQ ID NO: 7511 - protein, 25 aa, synthetic construct
  REGION 1..25: note = anti-influenza_CDR
AKHLSMQQVVSAGWERADLVGDAFD

SEQ ID NO: 7512 - protein, 25 aa, synthetic construct
  REGION 1..25: note = anti-influenza_CDR
AKHASLQQVVSAGWERADLVGDAFD

SEQ ID NO: 7513 - protein, 25 aa, synthetic construct
  REGION 1..25: note = anti-influenza_CDR
AKHSSLQQVVSAGWERADLVGDAFD

SEQ ID NO: 7514 - protein, 25 aa, synthetic construct
  REGION 1..25: note = anti-influenza_CDR
AKHLSLQQVVSAGWERADLVGDAFD

SEQ ID NO: 7515 - protein, 25 aa, synthetic construct
  REGION 1..25: note = anti-influenza_CDR
AKHMSMQQVVSAGWERADLVGDAFD

SEQ ID NO: 7516 - protein, 25 aa, synthetic construct
  REGION 1..25: note = anti-influenza_CDR
ARGPETYYYDKTNWLNSHPDEYFQH

SEQ ID NO: 7517 - protein, 25 aa, synthetic construct
  REGION 1..25: note = anti-influenza_CDR
TTDGPYSDDFRSGYAARYRYFGMDV

SEQ ID NO: 7518 - protein, 25 aa, synthetic construct
  REGION 1..25: note = anti-influenza_CDR
TDGPYSDDFRSGYAARYRYFGMDVW

SEQ ID NO: 7519 - protein, 26 aa, synthetic construct [sequence omitted]

SEQ ID NO: 7520 - protein, 26 aa, synthetic construct
  REGION 1..26: note = anti-influenza_CDR
ATGRAATGSASCTGGGTYWTYCTCTT

SEQ ID NO: 7521 - protein, 27 aa, synthetic construct
  REGION 1..27: note = anti-influenza_CDR
GYIPEAPRDGQAYVRKDGEWVLLSTFL

SEQ ID NO: 7522 - protein, 30 aa, synthetic construct
  REGION 1..30: note = anti-influenza_CDR
QVQLLETGGGLVKPGQSLKLSCAASGFTFT

SEQ ID NO: 7523 - protein, 32 aa, synthetic construct
  REGION 1..32: note = anti-influenza_CDR
RFTISRDNSKNTLYLQMNSLRAEDTAVYYCAK

SEQ ID NO: 7524 - protein, 32 aa, synthetic construct
  REGION 1..32: note = anti-influenza_CDR
GVPSRFSGSGSGTDFTLTISSLQPEDFATYYC

SEQ ID NO: 7525 - protein, 5 aa, synthetic construct
  REGION 1..5: note = anti-OX40_HeavyChain_CDR1
SYSMN

SEQ ID NO: 7526 - protein, 5 aa, synthetic construct
  REGION 1..5: note = anti-OX40_HeavyChain_CDR1
DYAMH

SEQ ID NO: 7527 - protein, 5 aa, synthetic construct
  REGION 1..5: note = anti-OX40_HeavyChain_CDR1
DSYMS

SEQ ID NO: 7528 - protein, 5 aa, synthetic construct
  REGION 1..5: note = anti-OX40_HeavyChain_CDR1
DAYMS

SEQ ID NO: 7529 - protein, 5 aa, synthetic construct
  REGION 1..5: note = anti-OX40_HeavyChain_CDR1
ESYMS

SEQ ID NO: 7530 - protein, 5 aa, synthetic construct
  REGION 1..5: note = anti-OX40_HeavyChain_CDR1
SGYWN

SEQ ID NO: 7531 - protein, 7 aa, synthetic construct
  REGION 1..7: note = anti-OX40_LightChain_CDR2
YTSRLHS

SEQ ID NO: 7532 - protein, 7 aa, synthetic construct
  REGION 1..7: note = anti-OX40_LightChain_CDR2
AASSLQS

SEQ ID NO: 7533 - protein, 7 aa, synthetic construct
  REGION 1..7: note = anti-OX40_LightChain_CDR2
DASNRAT

SEQ ID NO: 7534 - protein, 7 aa, synthetic construct
  REGION 1..7: note = anti-OX40_LightChain_CDR2
YTSRLRS

SEQ ID NO: 7535 - protein, 8 aa, synthetic construct
  REGION 1..8: note = anti-OX40_LightChain_CDR3
QQRSNWPT

SEQ ID NO: 7536 - protein, 8 aa, synthetic construct
  REGION 1..8: note = anti-OX40_HeavyChain_CDR3
APRWYFSV

SEQ ID NO: 7537 - protein, 8 aa, synthetic construct
  REGION 1..8: note = anti-OX40_HeavyChain_CDR3
APRWYFSA

SEQ ID NO: 7538 - protein, 8 aa, synthetic construct
  REGION 1..8: note = anti-OX40_HeavyChain_CDR3
APRWYFAV

SEQ ID NO: 7539 - protein, 9 aa, synthetic construct
  REGION 1..9: note = anti-OX40_LightChain_CDR3
QQGNTLPWT

SEQ ID NO: 7540 - protein, 9 aa, synthetic construct
  REGION 1..9: note = anti-OX40_HeavyChain_CDR3
ESGWYLFDY

SEQ ID NO: 7541 - protein, 9 aa, synthetic construct
  REGION 1..9: note = anti-OX40_LightChain_CDR3
QQYNSYPPT

SEQ ID NO: 7542 - protein, 9 aa, synthetic construct
  REGION 1..9: note = anti-OX40_LightChain_CDR3
QQGHTLPPT

SEQ ID NO: 7543 - protein, 9 aa, synthetic construct
  REGION 1..9: note = anti-OX40_LightChain_CDR3
QQGHTLPAT

SEQ ID NO: 7544 - protein, 9 aa, synthetic construct
  REGION 1..9: note = anti-OX40_LightChain_CDR3
QQGHTAPPT

SEQ ID NO: 7545 - protein, 9 aa, synthetic construct
  REGION 1..9: note = anti-OX40_LightChain_CDR3
QQGATLPPT

SEQ ID NO: 7546 - protein, 9 aa, synthetic construct
  REGION 1..9: note = anti-OX40_LightChain_CDR3
QQGHALPPT

SEQ ID NO: 7547 - protein, 9 aa, synthetic construct
  REGION 1..9: note = anti-OX40_LightChain_CDR3
QQAHTLPPT

SEQ ID NO: 7548 - protein, 9 aa, synthetic construct
  REGION 1..9: note = anti-OX40_LightChain_CDR3
QQGHTLAPT

SEQ ID NO: 7549 - protein, 9 aa, synthetic construct
  REGION 1..9: note = anti-OX40_LightChain_CDR3
QAGHTLPPT

SEQ ID NO: 7550 - protein, 10 aa, synthetic construct
  REGION 1..10: note = anti-OX40_HeavyChain_CDR1
GYTFTSYVMH

SEQ ID NO: 7551 - protein, 10 aa, synthetic construct
  REGION 1..10: note = anti-OX40_HeavyChain_CDR3
YYGSSLSMDY

SEQ ID NO: 7552 - protein, 11 aa, synthetic construct
  REGION 1..11: note = anti-OX40_LightChain_CDR1
RASQDISNYLN

SEQ ID NO: 7553 - protein, 11 aa, synthetic construct
  REGION 1..11: note = anti-OX40_LightChain_CDR1
RASQGISSWLA

SEQ ID NO: 7554 - protein, 11 aa, synthetic construct
  REGION 1..11: note = anti-OX40_LightChain_CDR1
RASQSVSSYLA

SEQ ID NO: 7555 - protein, 13 aa, synthetic construct
  REGION 1..13: note = anti-OX40_HeavyChain_CDR3
YRYDYDGGHAMDY

SEQ ID NO: 7556 - protein, 13 aa, synthetic construct
  REGION 1..13: note = anti-OX40_HeavyChain_CDR3
YKYDYDAGHAMDY

SEQ ID NO: 7557 - protein, 13 aa, synthetic construct
  REGION 1..13: note = anti-OX40_HeavyChain_CDR3
YKYDYDGGHAMDY

SEQ ID NO: 7558 - protein, 15 aa, synthetic construct
  REGION 1..15: note = anti-OX40_HeavyChain_CDR3
DQSTADYYFYYGMDV

SEQ ID NO: 7559 - protein, 16 aa, synthetic construct
  REGION 1..16: note = anti-OX40_HeavyChain_CDR2
YISYNGITYHNPSLKS

SEQ ID NO: 7560 - protein, 16 aa, synthetic construct
  REGION 1..16: note = anti-OX40_HeavyChain_CDR2
YISYNAITYHNPSLKS

SEQ ID NO: 7561 - protein, 16 aa, synthetic construct
  REGION 1..16: note = anti-OX40_HeavyChain_CDR2
YISYSGITYHNPSLKS

SEQ ID NO: 7562 - protein, 17 aa, synthetic construct
  REGION 1..17: note = anti-OX40_HeavyChain_CDR2
YINPYNDGTKYNEKFKG

SEQ ID NO: 7563 - protein, 17 aa, synthetic construct
  REGION 1..17: note = anti-OX40_HeavyChain_CDR2
YISSSSSTIDYADSVKG

SEQ ID NO: 7564 - protein, 17 aa, synthetic construct
  REGION 1..17: note = anti-OX40_HeavyChain_CDR2
GISWNSGSIGYADSVKG

SEQ ID NO: 7565 - protein, 17 aa, synthetic construct
  REGION 1..17: note = anti-OX40_HeavyChain_CDR2
DMYPDNGDSSYNQKFRE

SEQ ID NO: 7566 - protein, 17 aa, synthetic construct
  REGION 1..17: note = anti-OX40_HeavyChain_CDR2
DMYPDNADSSYNQKFRE

SEQ ID NO: 7567 - protein, 17 aa, synthetic construct
  REGION 1..17: note = anti-OX40_HeavyChain_CDR2
DMYPDNADASYNQKFRE

SEQ ID NO: 7568 - protein, 17 aa, synthetic construct
  REGION 1..17: note = anti-OX40_HeavyChain_CDR2
DMYPDNGDASYNQKFRE

SEQ ID NO: 7569 - protein, 17 aa, synthetic construct
  REGION 1..17: note = anti-OX40_HeavyChain_CDR2
DMYPDSGDSSYNQKFRE

SEQ ID NO: 7570 - protein, 17 aa, synthetic construct
  REGION 1..17: note = anti-OX40_HeavyChain_CDR2
DMYPDNGSSSYNQKFRE

SEQ ID NO: 7571 - protein, 103 aa, synthetic construct
  REGION 1..103: note = Ig_LightChain_kappa_constant_domain
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 7572 - protein, 103 aa, synthetic construct
  REGION 1..103: note = Ig_LightChain_kappa_constant_domain
TVAAPSVFIFPPSDEQLKSGTASVVCLLNNFYPREAKVQWKVDNALQSGNSQESVTEQDSKDSTYSLSNTLTLSKADYEKHKVYACEVTHQGLSSPVTKSFNR

SEQ ID NO: 7573 - protein, 104 aa, synthetic construct
  REGION 1..104: note = Ig_LightChain_lambda_constant_domain
PKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7574 - protein, 104 aa, synthetic construct
  REGION 1..104: note = Ig_LightChain_lambda_constant_domain
PKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPAECS

SEQ ID NO: 7575 - protein, 104 aa, synthetic construct
  REGION 1..104: note = Ig_LightChain_lambda_constant_domain
PKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 7576 - protein, 104 aa, synthetic construct
  REGION 1..104: note = Ig_LightChain_lambda_constant_domain
PKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPAECS

SEQ ID NO: 7577 - protein, 94 aa, synthetic construct
  REGION 1..94: note = IgG1_HeavyChain_CH1_constant_domain
SASTKGPSVFPLAPSSKSTSGGTAALGCLVKDYFPEPVTVSWNSGVHTFPAVLQSSGLYSLSSVVTVPSSSLGTQTYICNVNHKPSNTKVDKKV

SEQ ID NO: 7578 - protein, 90 aa, synthetic construct
  REGION 1..90: note = IgG1_HeavyChain_CH1_constant_domain
SGPSVFPLAPSSKSTSGGTAALGCLVKDYFPEPVTVSWNSGVHTFPAVLQSSGLYSLSSVVTVPSSSLGTQTYICNVNHKPSNTKVDKKV

SEQ ID NO: 7579 - protein, 90 aa, synthetic construct
  REGION 1..90: note = IgG1_HeavyChain_CH1_constant_domain
SGPSVFPLAPSSKSTSGGTAALGCLVKDYFPEPVTVSWNSGVHTFPAVLQSSGLYSLSSVVTVPSSSLGTQTYICNVNHKPSNTKVDKKA

SEQ ID NO: 7580 - protein, 90 aa, synthetic construct
  REGION 1..90: note = IgG1_HeavyChain_CH1_constant_domain
SGPSVFPLAPSSKSTSGGTAALGCLVKDYFPEPVTVSWNSGVHTFPAVLQSSGLYSLSSVVTVPSSSLGTQTYICNVNHKPSNTKVDKRV

SEQ ID NO: 7581 - protein, 90 aa, synthetic construct
  REGION 1..90: note = IgG1_HeavyChain_CH1_constant_domain
SGPSVFPLAPSSKSTSGGTAALGCLVKDYFPEPVTVSWNSGVHTFPAVLQSSGLYSLSSVVTVPSSSLGTQTYICNVNHKPSNTKVDKRA

SEQ ID NO: 7582 - protein, 90 aa, synthetic construct
  REGION 1..90: note = IgG1_HeavyChain_CH1_constant_domain
SGPSVLPLAPSSKSTSGGTAALGCLVKDYFPEPVTVSWNSGVHTFPAVLQSSGLYSLSSVVTVPSSSLGTQTYICNVNHKPSNTKVDKKV

SEQ ID NO: 7583 - protein, 90 aa, synthetic construct
  REGION 1..90: note = IgG1_HeavyChain_CH1_constant_domain
SGPSVLPLAPSSKSTSGGTAALGCLVKDYFPEPVTVSWNSGVHTFPAVLQSSGLYSLSSVVTVPSSSLGTQTYICNVNHKPSNTKVDKKA

SEQ ID NO: 7584 - protein, 90 aa, synthetic construct
  REGION 1..90: note = IgG1_HeavyChain_CH1_constant_domain
SGPSVLPLAPSSKSTSGGTAALGCLVKDYFPEPVTVSWNSGVHTFPAVLQSSGLYSLSSVVTVPSSSLGTQTYICNVNHKPSNTKVDKRV

SEQ ID NO: 7585 - protein, 90 aa, synthetic construct
  REGION 1..90: note = IgG1_HeavyChain_CH1_constant_domain
SGPSVLPLAPSSKSTSGGTAALGCLVKDYFPEPVTVSWNSGVHTFPAVLQSSGLYSLSSVVTVPSSSLGTQTYICNVNHKPSNTKVDKRA

SEQ ID NO: 7586 - protein, 94 aa, synthetic construct
  REGION 1..94: note = IgG1_HeavyChain_CH1_constant_domain
SASTKGPSVFPLAPSSKSTSGGTAALGCLVKDYFPEPVTVSWNSGVHTFPAVLQSSGLYSLSSVVTVPSSSLGTQTYICNVNHKPSNTKVDKKA

SEQ ID NO: 7587 - protein, 94 aa, synthetic construct
  REGION 1..94: note = IgG1_HeavyChain_CH1_constant_domain
SASTKGPSVFPLAPSSKSTSGGTAALGCLVKDYFPEPVTVSWNSGVHTFPAVLQSSGLYSLSSVVTVPSSSLGTQTYICNVNHKPSNTKVDKRV

SEQ ID NO: 7588 - protein, 94 aa, synthetic construct
  REGION 1..94: note = IgG1_HeavyChain_CH1_constant_domain
SASTKGPSVFPLAPSSKSTSGGTAALGCLVKDYFPEPVTVSWNSGVHTFPAVLQSSGLYSLSSVVTVPSSSLGTQTYICNVNHKPSNTKVDKRA

SEQ ID NO: 7589 - protein, 94 aa, synthetic construct
  REGION 1..94: note = IgG1_HeavyChain_CH1_constant_domain
SASTKGPSVLPLAPSSKSTSGGTAALGCLVKDYFPEPVTVSWNSGVHTFPAVLQSSGLYSLSSVVTVPSSSLGTQTYICNVNHKPSNTKVDKKV

SEQ ID NO: 7590 - protein, 94 aa, synthetic construct
  REGION 1..94: note = IgG1_HeavyChain_CH1_constant_domain
SASTKGPSVLPLAPSSKSTSGGTAALGCLVKDYFPEPVTVSWNSGVHTFPAVLQSSGLYSLSSVVTVPSSSLGTQTYICNVNHKPSNTKVDKKA

SEQ ID NO: 7591 - protein, 94 aa, synthetic construct
  REGION 1..94: note = IgG1_HeavyChain_CH1_constant_domain
SASTKGPSVLPLAPSSKSTSGGTAALGCLVKDYFPEPVTVSWNSGVHTFPAVLQSSGLYSLSSVVTVPSSSLGTQTYICNVNHKPSNTKVDKRV

SEQ ID NO: 7592 - protein, 94 aa, synthetic construct
  REGION 1..94: note = IgG1_HeavyChain_CH1_constant_domain
SASTKGPSVLPLAPSSKSTSGGTAALGCLVKDYFPEPVTVSWNSGVHTFPAVLQSSGLYSLSSVVTVPSSSLGTQTYICNVNHKPSNTKVDKRA

SEQ ID NO: 7593 - protein, 110 aa, synthetic construct
  REGION 1..110: note = IgG1_HeavyChain_CH2_constant_domain
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7594 - protein, 110 aa, synthetic construct
  REGION 1..110: note = IgG1_HeavyChain_CH2_constant_domain
APELLGGPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7595 - protein, 110 aa, synthetic construct
  REGION 1..110: note = IgG1_HeavyChain_CH2_constant_domain
APELLGGPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7596 - protein, 110 aa, synthetic construct
  REGION 1..110: note = IgG1_HeavyChain_CH2_constant_domain
APELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7597 - protein, 110 aa, synthetic construct
  REGION 1..110: note = IgG1_HeavyChain_CH2_constant_domain
APELLGAPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7598 - protein, 110 aa, synthetic construct
  REGION 1..110: note = IgG1_HeavyChain_CH2_constant_domain
APELLGAPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7599 - protein, 110 aa, synthetic construct
  REGION 1..110: note = IgG1_HeavyChain_CH2_constant_domain
APELLGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7600 - protein, 110 aa, synthetic construct
  REGION 1..110: note = IgG1_HeavyChain_CH2_constant_domain
APELLGAPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7601 - protein, 110 aa, synthetic construct
  REGION 1..110: note = IgG1_HeavyChain_CH2_constant_domain
APELAGGPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7602 - protein, 110 aa, synthetic construct
  REGION 1..110: note = IgG1_HeavyChain_CH2_constant_domain
APELAGGPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7603 - protein, 110 aa, synthetic construct
  REGION 1..110: note = IgG1_HeavyChain_CH2_constant_domain
APELAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7604 - protein, 110 aa, synthetic construct
  REGION 1..110: note = IgG1_HeavyChain_CH2_constant_domain
APELAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7605 - protein, 110 aa, synthetic construct
  REGION 1..110: note = IgG1_HeavyChain_CH2_constant_domain
APELAGAPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7606 - protein, 110 aa, synthetic construct
  REGION 1..110: note = IgG1_HeavyChain_CH2_constant_domain
APELAGAPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7607 - protein, 110 aa, synthetic construct
  REGION 1..110: note = IgG1_HeavyChain_CH2_constant_domain
APELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7608 - protein, 110 aa, synthetic construct
  REGION 1..110: note = IgG1_HeavyChain_CH2_constant_domain
APELAGAPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7609 - protein, 110 aa, synthetic construct
  REGION 1..110: note = IgG1_HeavyChain_CH2_constant_domain
APEALGGPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7610 - protein, 110 aa, synthetic construct
  REGION 1..110: note = IgG1_HeavyChain_CH2_constant_domain
APEALGGPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7611 - protein, 110 aa, synthetic construct
  REGION 1..110: note = IgG1_HeavyChain_CH2_constant_domain
APEALGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7612 - protein, 110 aa, synthetic construct
  REGION 1..110: note = IgG1_HeavyChain_CH2_constant_domain
APEALGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7613 - protein, 110 aa, synthetic construct
  REGION 1..110: note = IgG1_HeavyChain_CH2_constant_domain
APEALGAPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7614 - protein, 110 aa, synthetic construct
  REGION 1..110: note = IgG1_HeavyChain_CH2_constant_domain
APEALGAPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7615 - protein, 110 aa, synthetic construct
  REGION 1..110: note = IgG1_HeavyChain_CH2_constant_domain
APEALGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7616 - protein, 110 aa, synthetic construct
  REGION 1..110: note = IgG1_HeavyChain_CH2_constant_domain
APEALGAPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7617 - protein, 110 aa, synthetic construct
  REGION 1..110: note = IgG1_HeavyChain_CH2_constant_domain
APEAAGGPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7618 - protein, 110 aa, synthetic construct
  REGION 1..110: note = IgG1_HeavyChain_CH2_constant_domain
APEAAGGPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7619 - protein, 110 aa, synthetic construct
  REGION 1..110: note = IgG1_HeavyChain_CH2_constant_domain
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7620 - protein, 110 aa, synthetic construct
  REGION 1..110: note = IgG1_HeavyChain_CH2_constant_domain
APEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7621 - protein, 110 aa, synthetic construct
  REGION 1..110: note = IgG1_HeavyChain_CH2_constant_domain
APEAAGAPSVFLFPPKPKDTLMISRTPEVTCVVVDVSHEDPEVKFNVYVDGVEVHNAKTKPREEQYNSTYRVVSVLTVLHQDWLNGKEYKCKVSNKALPAPIEKTISKAK

SEQ ID NO: 7622 - protein, 110 aa, synthetic construct
  REGION 1..110: note = IgG1_HeavyChain_CH2_constant_domain
APEAAGAPSVFLFPPKPKDTLMISRTPEVTCVVVDVSHEDPEVKFNVYVDGVEVHNAKTKPREEQYASTYRVVSVLTVLHQDWLNGKEYKCKVSNKALPAPIEKTISKAK

SEQ ID NO: 7623 - protein, 110 aa, synthetic construct
  REGION 1..110: note = IgG1_HeavyChain_CH2_constant_domain
APEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 7624 - protein, 110 aa, synthetic construct
  REGION 1..110: note = IgG1_HeavyChain_CH2_constant_domain
APEAAGAPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAK

SEQ ID NO: 7625 - protein, 106 aa, synthetic construct
  REGION 1..106: note = IgG1_HeavyChain_CH3_constant_domain
GQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 7626 - protein, 106 aa, synthetic construct
  REGION 1..106: note = IgG1_HeavyChain_CH3_constant_domain
GQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 7627 - protein, 106 aa, synthetic construct
  REGION 1..106: note = IgG1_HeavyChain_CH3_constant_domain
GQPREPQVYTLPPSRDEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 7628 - protein, 106 aa, synthetic construct [sequence omitted]

SEQ ID NO: 7629 - protein, 99 aa, synthetic construct
  REGION 1..99: note = IgG2_HeavyChain_CH1_constant_domain
SASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 7630 - protein, 99 aa, synthetic construct
  REGION 1..99: note = IgG2_HeavyChain_CH1_constant_domain
SASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTV

SEQ ID NO: 7631 - protein, 109 aa, synthetic construct
  REGION 1..109: note = IgG2_HeavyChain_CH2_constant_domain
APPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTK

SEQ ID NO: 7632 - protein, 109 aa, synthetic construct
  REGION 1..109: note = IgG2_HeavyChain_CH2_constant_domain
APPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPASIEKTISKTK

SEQ ID NO: 7633 - protein, 109 aa, synthetic construct
  REGION 1..109: note = IgG2_HeavyChain_CH2_constant_domain
APPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSPIEKTISKTK

SEQ ID NO: 7634 - protein, 109 aa, synthetic construct
  REGION 1..109: note = IgG2_HeavyChain_CH2_constant_domain
APPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTK

SEQ ID NO: 7635 - protein, 109 aa, synthetic construct
  REGION 1..109: note = IgG2_HeavyChain_CH2_constant_domain
APPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTK

SEQ ID NO: 7636 - protein, 109 aa, synthetic construct
  REGION 1..109: note = IgG2_HeavyChain_CH2_constant_domain
APPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPASIEKTISKTK

SEQ ID NO: 7637 - protein, 109 aa, synthetic construct
  REGION 1..109: note = IgG2_HeavyChain_CH2_constant_domain
APPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPSPIEKTISKTK

SEQ ID NO: 7638 - protein, 109 aa, synthetic construct
  REGION 1..109: note = IgG2_HeavyChain_CH2_constant_domain
APPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPSSIEKTISKTK

SEQ ID NO: 7639 - protein, 106 aa, synthetic construct
  REGION 1..106: note = IgG2_HeavyChain_CH3_constant_domain
GQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 7640 - protein, 99 aa, synthetic construct
  REGION 1..99: note = IgG4_HeavyChain_CH1_constant_domain
SASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRV

SEQ ID NO: 7641 - protein, 110 aa, synthetic construct
  REGION 1..110: note = IgG4_HeavyChain_CH2_constant_domain
APEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAK

SEQ ID NO: 7642 - protein, 106 aa, synthetic construct
  REGION 1..106: note = IgG4_HeavyChain_CH3_constant_domain
GQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 7643 - RNA, 1347 nt, synthetic construct
  misc_feature 1..1347: note = derived and/or modified sequence opt1 from AAB-003_gamma1-Chain
  source 1..1347: mol_type = other RNA
gaggtgcagctgctcgagagcggcgggggcctggtccagcccgggggctccctgcgcctcagctgcgccgcctccgggttcaccttcagcaactacggcatgtcctgggtgcggcaggcgccgggcaaggggctggagtgggtggccagcatccgctccggcgggggccggacctactacagcgacaacgtcaaggggcgcttcacgatctcccgggacaacagcaagaacaccctgtacctccagatgaactccctgcgcgccgaggacaccgccgtgtactactgcgtgcggtacgaccactacagcggctccagcgactactggggccaggggaccctggtcacggtgtccagcgcctccaccaagggccccagcgtgttccccctcgcgccctccagcaagagcacctccgggggcaccgccgccctgggctgcctggtcaaggactacttcccggagcccgtgacggtgagctggaactccggggccctcaccagcggcgtccacaccttccccgcggtgctgcagtccagcgggctgtactccctcagctccgtggtcaccgtgcccagctccagcctgggcacgcagacctacatctgcaacgtgaaccacaagccgtccaacaccaaggtcgacaagaaggtggagcccaagagctgcgacaagacccacacgtgcccgccctgccccgcccccgaggccgccggggccccctccgtgttcctgttcccgcccaagcccaaggacaccctcatgatcagccgcacccccgaggtgacctgcgtcgtggtcgacgtgtcccacgaggaccccgaggtcaagttcaactggtacgtggacggcgtggaggtccacaacgcgaagacgaagccgcgggaggagcagtacaacagcacctaccgcgtggtgtccgtcctgaccgtgctgcaccaggactggctcaacggcaaggagtacaagtgcaaggtgagcaacaaggccctgcccgcccccatcgagaagaccatcagcaaggccaaggggcagccccgggagccgcaggtctacacgctgccgccctcccgcgaggagatgaccaagaaccaggtgagcctgacctgcctcgtgaagggcttctacccctccgacatcgccgtcgagtgggagagcaacgggcagcccgagaacaactacaagaccacgccgcccgtgctggactccgacggcagcttcttcctctactccaagctgaccgtggacaagagccggtggcagcaggggaacgtcttctcctgcagcgtgatgcacgaggcgctgcacaaccactacacccagaagtccctcagcctgtcccccggcaag

SEQ ID NO: 7644 - RNA, 1329 nt, synthetic construct
  misc_feature 1..1329: note = derived and/or modified sequence opt1 from Abagovomab_HeavyChain
  source 1..1329: mol_type = other RNA
caggtgaagctgcaggagagcggcgccgagctcgcccgccccggggcgtccgtcaagctgagctgcaaggcctccggctacaccttcaccaactactggatgcagtgggtgaagcagcggccggggcagggcctggactggatcggggccatctaccccggcgacggcaacacccgctacacccacaagttcaaggggaaggccaccctcaccgccgacaagagctccagcacggcgtacatgcagctgtccagcctggcctccgaggacagcggcgtgtactactgcgcccgcggggagggcaactacgcctggttcgcgtactgggggcagggcaccaccgtcaccgtgtccagcgccaagacgaccccgccctccgtgtaccccctcgcccccggcagcgccgcccagaccaactccatggtcaccctggggtgcctggtgaagggctacttccccgagcccgtgacggtcacctggaacagcgggtccctcagctccggcgtgcacaccttcccggcggtgctgcagagcgacctgtacaccctcagctccagcgtcacggtgccctccagcacctggccctccgagaccgtgacctgcaacgtcgcccaccccgccagctccacgaaggtggacaagaagatcgtgccgcgggactgcggctgcaagccctgcatctgcaccgtccccgaggtgagctccgtgttcatcttcccgcccaagcccaaggacgtcctgaccatcaccctgacgcccaaggtgacctgcgtggtcgtggacatcagcaaggacgaccccgaggtccagttctcctggttcgtggacgacgtggaggtccacaccgcccagacccagccgcgggaggagcagttcaacagcacgttccgctccgtgagcgagctccccatcatgcaccaggactggctgaacgggaaggagttcaagtgccgggtgaactccgccgcgttccccgcccccatcgagaagaccatcagcaagaccaagggccgcccgaaggcgccccaggtctacaccatcccgccgcccaaggagcagatggccaaggacaaggtgtccctgacgtgcatgatcaccgacttcttccccgaggacatcaccgtggagtggcagtggaacgggcagcccgccgagaactacaagaacacccagcccatcatggacacggacggcagctacttcgtctactccaagctcaacgtgcagaagtccaactgggaggccgggaacaccttcacgtgcagcgtgctgcacgagggcctgcacaaccaccacaccgagaagtccctcagccacagccccggcaag

SEQ ID NO: 7645 - RNA, 642 nt, synthetic construct
  misc_feature 1..642: note = derived and/or modified sequence opt1 from Abagovomab_LightChain
  source 1..642: mol_type = other RNA
gacatcgagctgacccagagccccgcctccctcagcgcctccgtgggcgagaccgtgacgatcacgtgccaggcgagcgagaacatctactcctacctggcctggcaccagcagaagcaggggaagtccccgcagctgctcgtgtacaacgccaagaccctggccggcggggtgagcagccgcttctccggcagcgggtccggcacccacttcagcctgaagatcaagtccctccagcccgaggacttcggcatctactactgccagcaccactacgggatcctgcccaccttcggcgggggcaccaagctggagatcaagcgggccgacgcggcccccaccgtcagcatcttcccgccctccagcgagcagctcacctccgggggcgccagcgtggtgtgcttcctgaacaacttctaccccaaggacatcaacgtcaagtggaagatcgacggctccgagcgccagaacggggtgctgaacagctggacggaccaggacagcaaggactccacctacagcatgtccagcaccctcaccctgacgaaggacgagtacgagcggcacaactcctacacgtgcgaggccacccacaagaccagcacctcccccatcgtcaagagcttcaaccgcaacgagtgc

SEQ ID NO: 7646 - RNA, 1350 nt, synthetic construct
  misc_feature 1..1350: note = derived and/or modified sequence opt1 from Abciximab_HeavyChain
  source 1..1350: mol_type = other RNA
gaggtgcagctgcagcagagcggcgccgagctcgtcaagcccggggcctccgtgaagctgagctgcaccgcgtccggcttcaacatcaaggacacctacgtgcactgggtcaagcagcgcccggagcaggggctggagtggatcggccggatcgaccccgccaacgggtacacgaagtacgaccccaagttccagggcaaggccaccatcaccgccgacaccagctccaacacggcctacctccagctgagctccctgaccagcgaggacaccgcggtgtactactgcgtgcgccccctctacgactactacgccatggactactggggccaggggacctccgtcacggtgagctccgccaagaccaccgccccgagcgtgtaccccctggcgcccgtctgcggcgacaccacggggtccagcgtgaccctgggctgcctcgtgaaggggtacttccccgagccggtcaccctgacctggaactccggcagcctgtccagcggcgtgcacacgttccccgccgtgctccagtccgacctgtacaccctgagcagctccgtcaccgtgaccagctccacgtggcccagccagtccatcacgtgcaacgtggcccaccccgccagctccaccaaggtcgacaagaagatcgagccgcggcccaagagctgcgacaagacccacacgtgcccgccctgcccggcccccgagctcctcgggggcccctccgtgttcctgttcccgcccaagcccaaggacaccctgatgatcagccgcacccccgaggtgacctgcgtcgtggtggacgtctcccacgaggaccccgaggtgaagttcaactggtacgtcgacggggtggaggtgcacaacgcgaagaccaagccgcgggaggagcagtacaacagcacctaccgcgtcgtgtccgtgctgaccgtcctgcaccaggactggctcaacggcaaggagtacaagtgcaaggtgagcaacaaggccctgcccgcccccatcgagaagaccatctccaaggccaagggccagccccgggagccccaggtgtacacgctgccgcccagccgcgacgagctcaccaagaaccaggtctccctgacctgcctggtgaaggggttctaccccagcgacatcgccgtggagtgggagtccaacggccagcccgagaacaactacaagaccacgccgcccgtcctcgacagcgacgggagcttcttcctgtactccaagctgaccgtggacaagagccggtggcagcagggcaacgtgttctcctgcagcgtcatgcacgaggcgctccacaaccactacacccagaagtccctgagcctgtcccccgggaag

SEQ ID NO: 7647 - RNA, 642 nt, synthetic construct
  misc_feature 1..642: note = derived and/or modified sequence opt1 from Abciximab_LightChain
  source 1..642: mol_type = other RNA
gacatcctgatgacccagagcccctccagcatgtccgtgagcctcggcgacaccgtctccatcacgtgccacgccagccaggggatctccagcaacatcggctggctgcagcagaagccggggaagtccttcatgggcctgatctactacgggaccaacctcgtggacggcgtgcccagccgcttctccggcagcgggtccggcgccgactacagcctgaccatctccagcctggactccgaggacttcgcggactactactgcgtccagtacgcccagctcccctacaccttcgggggcgggacgaagctggagatcaagcgggccgacgccgcccccaccgtgagcatcttcccgccctccagcgagcagctgaccagcggcggcgcgtccgtggtctgcttcctcaacaacttctaccccaaggacatcaacgtgaagtggaagatcgacgggagcgagcgccagaacggcgtgctgaactcctggaccgaccaggacagcaaggactccacgtacagcatgtccagcaccctgaccctcaccaaggacgagtacgagcggcacaactcctacacgtgcgaggccacccacaagaccagcacctcccccatcgtcaagagcttcaaccgcaacgagtgc

SEQ ID NO: 7648 - RNA, 1341 nt, synthetic construct
  misc_feature 1..1341: note = derived and/or modified sequence opt1 from Abituzumab_HeavyChain1
  source 1..1341: mol_type = other RNA
caggtgcagctgcagcagagcggcggggagctcgccaagcccggcgcctccgtcaaggtgagctgcaaggcgtccgggtacaccttcagctccttctggatgcactgggtgcgccaggccccgggccaggggctggagtggatcggctacatcaacccccggagcggctacaccgagtacaacgagatcttccgcgacaaggccacgatgaccaccgacacctccacgagcaccgcctacatggagctgtccagcctccggtccgaggacaccgccgtctactactgcgcgagcttcctggggcgcggcgccatggactactgggggcagggcaccacggtgaccgtgtccagcgcctccaccaaggggcccagcgtcttccccctggccccgtgctcccggagcacctccgagagcacggcggccctcggctgcctggtgaaggactacttccccgagcccgtgaccgtcagctggaactccggcgccctgaccagcggggtgcacaccttccccgccgtgctccagtccagcggcctgtactccctgagctccgtcgtgacggtgccgagctccaacttcgggacccagacctacacgtgcaacgtcgaccacaagcccagcaacaccaaggtggacaagaccgtggagcccaagtccagcgacaagacccacacgtgcccgccctgccccgccccgcccgtcgcgggcccctccgtgttcctcttcccgcccaagcccaaggacaccctgatgatcagccgcacccccgaggtgacctgcgtcgtggtggacgtctcccacgaggaccccgaggtgcagttcaactggtacgtcgacggcgtggaggtgcacaacgccaagaccaagccccgggaggagcaggcccagagcacgttccgcgtcgtgtccgtgctgaccgtcgtgcaccaggactggctcaacgggaaggagtacaagtgcaaggtgagcaacaagggcctgcccgccccgatcgagaagaccatctccaagaccaaggggcagccccgggagccccaggtctacacgctgcccccgagccgcgaggagatgaccaagaaccaggtgagcctgacctgcctcgtgaagggcttctacccctccgacatcgccgtcgagtgggagagcaacgggcagcccgagaacaactacaagaccacgccgcccatgctggactccgacggcagcttcttcctctactccaagctgaccgtggacaagagccggtggcagcagggcaacgtgttctcctgcagcgtcatgcacgaggcgctgcacaaccactacacccagaagtccctcagcctgtcccccgggaag

SEQ ID NO: 7649 - RNA, 642 nt, synthetic construct
  misc_feature 1..642: note = derived and/or modified sequence opt1 from Abituzumab_LightChain1
  source 1..642: mol_type = other RNA
gacatccagatgacccagagcccctccagcctgtccgccagcgtgggcgaccgggtcaccatcacgtgccgggcctcccaggacatcagcaactacctcgcgtggtaccagcagaagccggggaaggcccccaagctgctgatctactacacctccaagatccacagcggcgtgccctcccgcttcagcgggtccggcagcgggaccgactacaccttcacgatctccagcctccagcccgaggacatcgccacctactactgccagcagggcaacaccttcccgtacaccttcggccaggggacgaaggtggagatcaagcggaccgtcgccgccccctccgtgttcatcttcccgcccagcgacgagcagctgaagtccggcaccgcgagcgtggtctgcctgctcaacaacttctacccccgcgaggccaaggtgcagtggaaggtggacaacgccctgcagtccgggaacagccaggagagcgtcaccgagcaggactccaaggacagcacgtactccctgagctccaccctcaccctgagcaaggccgactacgagaagcacaaggtgtacgcgtgcgaggtgacccaccagggcctgtccagccccgtcacgaagtccttcaaccgcggggagtgc

SEQ ID NO: 7650 - RNA, 1332 nt, synthetic construct
  misc_feature 1..1332: note = derived and/or modified sequence opt1 from Abrilumab_HeavyChain1
  source 1..1332: mol_type = other RNA
caggtgcagctggtccagagcggcgccgaggtgaagaagcccggggcctccgtgaaggtcagctgcaaggtgtccggctacaccctcagcgacctgtccatccactgggtgcgccaggcgccggggaagggcctggagtggatgggcgggttcgacccccaggacggcgagaccatctacgcccagaagttccaggggcgggtcacgatgaccgaggacaccagcaccgacacggcctacatggagctctccagcctgaagtccgaggacaccgccgtgtactactgcgccaccggcagctccagctcctggttcgacccctgggggcagggcaccctggtgacggtcagctccgcgagcaccaaggggccctccgtgttcccgctcgccccctgcagccgctccaccagcgagagcaccgccgccctgggctgcctggtgaaggactacttccccgagcccgtcacggtgtcctggaacagcggcgcgctcacctccggggtgcacaccttcccggccgtcctgcagagctccggcctgtacagcctctccagcgtggtgaccgtcccctccagcaacttcgggacgcagacctacacgtgcaacgtggaccacaagccctccaacaccaaggtggacaagaccgtcgagcggaagtgctgcgtggagtgcccgccctgccccgccccgcccgtggccggccccagcgtcttcctgttcccgcccaagcccaaggacaccctgatgatctcccgcacccccgaggtgacctgcgtcgtggtggacgtcagccacgaggaccccgaggtgcagttcaactggtacgtggacggcgtcgaggtgcacaacgccaagacgaagccccgggaggagcagttcaactccaccttccgcgtggtcagcgtgctcaccgtggtccaccaggactggctgaacgggaaggagtacaagtgcaaggtgtccaacaagggcctgcccgcgccgatcgagaagaccatcagcaagacgaaggggcagccccgggagccccaggtgtacaccctcccgccctcccgcgaggagatgaccaagaaccaggtcagcctgacctgcctggtgaagggcttctaccccagcgacatcgccgtggagtgggagtccaacgggcagcccgagaacaactacaagacgaccccgcccatgctcgacagcgacggctccttcttcctgtacagcaagctgaccgtcgacaagtcccggtggcagcagggcaacgtgttcagctgctccgtgatgcacgaggccctccacaaccactacacccagaagtccctgagcctgagccccgggaag

SEQ ID NO: 7651 - RNA, 642 nt, synthetic construct
  misc_feature 1..642: note = derived and/or modified sequence opt1 from Abrilumab_LightChain1
  source 1..642: mol_type = other RNA
gacatccagatgacccagagcccctccagcgtgtccgccagcgtcggcgaccgcgtgaccatcacgtgccgggcctcccaggggatcagctcctggctggcgtggtaccagcagaagccgggcaaggcccccaagctcctgatctacggggccagcaacctggagtccggcgtgcccagccgcttctccgggagcggctccggcaccgacttcaccctcaccatcagctccctgcagcccgaggacttcgccaactactactgccagcaggccaacagcttcccgtggacgttcgggcagggcaccaaggtcgagatcaagcggaccgtggcggccccctccgtgttcatcttcccgcccagcgacgagcagctgaagtccgggaccgccagcgtcgtgtgcctcctgaacaacttctacccccgcgaggccaaggtgcagtggaaggtcgacaacgcgctgcagagcggcaactcccaggagagcgtgacggagcaggactccaaggacagcacctactccctcagctccaccctgaccctgagcaaggccgactacgagaagcacaaggtgtacgcctgcgaggtcacgcaccaggggctctccagccccgtgaccaagtccttcaaccggggcgagtgc

SEQ ID NO: 7652 - RNA, 639 nt, synthetic construct
  misc_feature 1..639: note = derived and/or modified sequence opt1 from Abrilumab_LightChain1_variant2
  source 1..639: mol_type = other RNA
cagatcgtgctgacccagagccccgccatcatgtccgccagcccgggcgagaaggtgaccatcacgtgctccgcgagctccagcgtgtcctacatgaactggttccagcagaagcccgggaccagccccaagctctggatctactccaccagcaacctggcctccggcgtgcccgcccgcttcagcgggtccggcagcgggacctcctacagcctgacgatctcccggatggaggccgaggacgccgcgacctactactgccagcagcgcagctcctacccgaacaccttcggcggcgggaccaagctcgagatcaagcgggccgacgccgcccccacggtcagcatcttcccgcccagctccgagcagctgaccagcggcggggcgtccgtggtgtgcttcctgaacaacttctaccccaaggacatcaacgtcaagtggaagatcgacggcagcgagcgccagaacggggtgctcaactcctggaccgaccaggacagcaaggactccacctacagcatgtccagcacgctgaccctgaccaaggacgagtacgagcggcacaactcctacacgtgcgaggccacccacaagaccagcacctcccccatcgtcaagagcttcaaccgcaacgagtgc

SEQ ID NO: 7653 - RNA, 1347 nt, synthetic construct
  misc_feature 1..1347: note = derived and/or modified sequence opt1 from Actoxumab_HeavyChain1
  source 1..1347: mol_type = other RNA
gaggtgcagctggtccagagcggcgccgaggtgaagaagtccggggagagcctcaagatctcctgcaagggcagcgggtactccttcaccagctactggatcggctgggtgcgccagatgcccgggaagggcctggagtggatgggcatcttctacccgggggactccagcacccggtactcccccagcttccagggccaggtcacgatctccgccgacaagagcgtgaacaccgcgtacctgcagtggtccagcctcaaggcctccgacaccgccatgtactactgcgcccgccggcgcaactgggggaacgccttcgacatctggggccaggggaccatggtgacggtcagctccgcgagcaccaagggcccctccgtgttccccctggccccgagcagcaagtccaccagcggcgggaccgccgccctgggctgcctcgtgaaggactacttccccgagcccgtcacggtgtcctggaacagcggggcgctgacctccggcgtgcacaccttccccgccgtcctgcagagctccggcctctacagcctgtccagcgtggtgaccgtcccgtccagctccctggggacgcagacctacatctgcaacgtgaaccacaagcccagcaacaccaaggtggacaagcgggtcgagcccaagtcctgcgacaagacccacacgtgcccgccctgccccgcccccgagctcctgggcgggcccagcgtgttcctgttcccgcccaagcccaaggacaccctcatgatctcccgcacccccgaggtgacctgcgtcgtggtggacgtcagccacgaggacccggaggtgaagttcaactggtacgtcgacggcgtggaggtgcacaacgccaagacgaagccccgggaggagcagtacaactccacctaccgcgtcgtgagcgtgctgaccgtcctgcaccaggactggctcaacgggaaggagtacaagtgcaaggtgagcaacaaggccctgcccgcgcccatcgagaagaccatctccaaggccaagggccagccgcgggagccccaggtgtacacgctgccgcccagccgcgaggagatgaccaagaaccaggtctccctgacctgcctcgtgaagggcttctaccccagcgacatcgccgtggagtgggagtccaacgggcagcccgagaacaactacaagaccacgcccccggtcctggacagcgacggctccttcttcctctacagcaagctgaccgtggacaagtcccggtggcagcaggggaacgtgttcagctgctccgtcatgcacgaggccctgcacaaccactacacccagaagtccctcagcctgagccccggcaag

SEQ ID NO: 7654 - RNA, 645 nt, synthetic construct
  misc_feature 1..645: note = derived and/or modified sequence opt1 from Actoxumab_LightChain1
  source 1..645: mol_type = other RNA
gagatcgtgctgacccagagccccggcaccctctccctgagcccgggggagcgcgccacgctgtcctgccgggccagccagtccgtcagctccagctacctcgcgtggtaccagcagaagcccggccaggcgccccgcctgctgatctacggggcctccagccgggccaccggcatccccgaccgcttctccgggagcggctccggcaccgacttcaccctcacgatcagccggctggagccggaggacttcgccgtgtactactgccagcagtacgggtccagcacctggaccttcggccaggggaccaaggtggagatcaagcgcacggtcgccgccccctccgtgttcatcttcccgcccagcgacgagcagctgaagtccggcaccgccagcgtggtctgcctcctgaacaacttctacccccgggaggccaaggtgcagtggaaggtggacaacgcgctgcagagcgggaactcccaggagagcgtcaccgagcaggactccaaggacagcacctactccctcagctccacgctgaccctgagcaaggccgactacgagaagcacaaggtgtacgcctgcgaggtgacccaccagggcctctccagccccgtcaccaagtccttcaaccgcggcgagtgc

SEQ ID NO: 7655 - RNA, 672 nt, synthetic construct
  misc_feature 1..672: note = derived and/or modified sequence opt1 from Adalimumab_HeavyChain
  source 1..672: mol_type = other RNA
gaggtgcagctggtcgagagcggcgggggcctcgtgcagcccgggcgctccctgcggctgagctgcgccgcctccggcttcaccttcgacgactacgcgatgcactgggtgcgccaggccccggggaagggcctcgagtgggtcagcgccatcacctggaactccggccacatcgactacgccgacagcgtggaggggcggttcacgatctcccgcgacaacgccaagaacagcctgtacctgcagatgaactccctccgggcggaggacaccgccgtgtactactgcgccaaggtcagctacctgtccaccgccagctccctggactactggggccaggggaccctcgtgacggtgagctccgcgagcaccaagggcccctccgtcttccccctggcccccagctccaagagcaccagcgggggcaccgccgccctgggctgcctcgtgaaggactacttcccggagcccgtgacggtctcctggaacagcggggccctgacctccggcgtgcacaccttccccgcggtgctgcagagctccgggctctacagcctgtccagcgtcgtgaccgtgccctccagctccctgggcacgcagacctacatctgcaacgtcaaccacaagccgagcaacaccaaggtggacaagaaggtggagcccaagtcctgc

SEQ ID NO: 7656 - RNA, 642 nt, synthetic construct
  misc_feature 1..642: note = derived and/or modified sequence opt1 from Adalimumab_LightChain
  source 1..642: mol_type = other RNA
gacatccagatgacccagagcccctccagcctgtccgccagcgtgggcgaccgcgtcaccatcacgtgccgggcctcccaggggatccgcaactacctcgcgtggtaccagcagaagccgggcaaggcccccaagctgctgatctacgccgccagcaccctccagtccggggtgcccagccggttctccggcagcgggtccggcaccgacttcaccctgacgatcagctccctgcagcccgaggacgtggccacctactactgccagcgctacaaccgggcgccgtacaccttcggccaggggaccaaggtcgagatcaagcgcacggtggccgcccccagcgtgttcatcttcccgccctccgacgagcagctcaagagcggcaccgcctccgtcgtgtgcctgctgaacaacttctacccccgggaggcgaaggtgcagtggaaggtcgacaacgccctccagagcgggaactcccaggagagcgtgaccgagcaggacagcaaggactccacctacagcctgtccagcacgctgaccctctccaaggccgactacgagaagcacaaggtgtacgcctgcgaggtcacccaccagggcctgagctcccccgtgaccaagagcttcaaccgcggggagtgc

SEQ ID NO: 7657 - RNA, 1359 nt, synthetic construct
  misc_feature 1..1359: note = derived and/or modified sequence opt1 from Aducanumab_HeavyChain1
  source 1..1359: mol_type = other RNA
caggtgcagctggtcgagagcggcgggggcgtggtgcagcccgggcgctccctccggctgagctgcgccgcctccggcttcgcgttcagctcctacgggatgcactgggtccgccaggccccgggcaagggcctggagtgggtggccgtgatctggttcgacgggaccaagaagtactacaccgacagcgtcaagggccggttcacgatctcccgcgacaacagcaagaacaccctctacctgcagatgaacaccctgcgggccgaggacaccgccgtgtactactgcgcgcgcgaccgggggatcggcgcccgccgggggccctactacatggacgtgtggggcaagggcacgaccgtcaccgtgtccagcgcctccaccaaggggcccagcgtgttccccctcgccccgtccagcaagtccacgagcggcgggaccgcggccctgggctgcctggtcaaggactacttccccgagcccgtgaccgtgtcctggaacagcggcgccctcacctccggggtccacacgttccccgccgtgctgcagagcagcggcctgtactccctcagctccgtggtcaccgtgccgagctccagcctggggacccagacctacatctgcaacgtgaaccacaagccctccaacacgaaggtcgacaagcgcgtggagcccaagagctgcgacaagacccacacgtgcccgccctgccccgcccccgagctgctcggcgggccctccgtgttcctgttcccgcccaagcccaaggacaccctgatgatcagccggacccccgaggtgacctgcgtcgtcgtggacgtgtcccacgaggacccggaggtcaagttcaactggtacgtggacggcgtggaggtccacaacgcgaagaccaagccccgcgaggagcagtacaacagcacctaccgggtggtgtccgtcctcacggtgctgcaccaggactggctgaacggcaaggagtacaagtgcaaggtgagcaacaaggccctccccgcccccatcgagaagaccatctccaaggccaaggggcagccgcgcgagccccaggtctacaccctgccgcccagccgggaggagatgaccaagaaccaggtgtccctgacgtgcctcgtgaagggcttctaccccagcgacatcgccgtcgagtgggagtccaacgggcagcccgagaacaactacaagaccacgcccccggtgctggacagcgacggcagcttcttcctgtactccaagctcaccgtggacaagagccgctggcagcaggggaacgtcttctcctgcagcgtgatgcacgaggcgctgcacaaccactacacccagaagtccctgagcctctcccccggc

SEQ ID NO: 7658 - RNA, 642 nt, synthetic construct
  misc_feature 1..642: note = derived and/or modified sequence opt1 from Aducanumab_LightChain1
  source 1..642: mol_type = other RNA
gacatccagatgacccagagcccctccagcctgtccgccagcgtgggcgaccgggtcaccatcacgtgccgggcctcccagagcatctccagctacctcaactggtaccagcagaagccggggaaggcgcccaagctgctgatctacgccgcctccagcctccagtccggcgtgcccagccgcttctccgggagcggctccgggaccgacttcaccctgaccatcagctccctgcagcccgaggacttcgccacgtactactgccagcagagctactccaccccgctcaccttcggcggcgggaccaaggtggagatcaagcggacggtcgccgcgcccagcgtgttcatcttcccgcccagcgacgagcagctgaagtccggcaccgccagcgtggtctgcctgctcaacaacttctacccccgcgaggccaaggtgcagtggaaggtggacaacgccctgcagtccgggaacagccaggagtccgtcaccgagcaggacagcaaggactccacctacagcctgtccagcacgctcaccctgtccaaggcggactacgagaagcacaaggtgtacgcctgcgaggtgacccaccagggcctgagctcccccgtcaccaagagcttcaaccgcggggagtgc

SEQ ID NO: 7659 - RNA, 1359 nt, synthetic construct
  misc_feature 1..1359: note = derived and/or modified sequence opt1 from Afasevikumab_HeavyChain1
  source 1..1359: mol_type = other RNA
gaggtgcagctggtcgagagcggcgggggcctcgtgcagcccgggcgctccctgcggctgagctgcgccgcctccggcttcaccttcgacgactacgcgatgcactgggtgcgccaggccccggggaagggcctcgagtgggtcagcggcatcaactggtccagcgggggcatcgggtacgccgactccgtgaagggccggttcaccatcagccgcgacaacgccaagaactccctgtacctgcagatgaacagcctccgggccgaggacacggcgctgtactactgcgcccgcgacatcgggggcttcggcgagttctactggaacttcgggctgtggggccgggggaccctcgtgaccgtctccagcgcctccaccaagggccccagcgtgttccccctggccccctccagcaagtccacgagcggcgggaccgcggccctgggctgcctcgtgaaggactacttcccggagcccgtcaccgtgtcctggaacagcggggccctgaccagcggcgtgcacacgttccccgccgtcctgcagtccagcgggctctactccctgagctccgtggtgaccgtccccagctccagcctgggcacccagacctacatctgcaacgtgaaccacaagccgtccaacacgaaggtggacaagcgcgtcgagcccaagagctgcgacaagacccacacgtgcccgccctgcccggcccccgagctcctgggcgggccctccgtgttcctgttcccgcccaagcccaaggacaccctcatgatcagccggacccccgaggtgacctgcgtcgtggtggacgtctcccacgaggaccccgaggtgaagttcaactggtacgtcgacggcgtggaggtgcacaacgcgaagaccaagccgcgcgaggagcagtacaacagcacctaccgggtcgtgtccgtgctgacggtcctgcaccaggactggctcaacgggaaggagtacaagtgcaaggtgagcaacaaggccctgcccgcccccatcgagaagaccatctccaaggccaagggccagccccgcgagccccaggtgtacaccctgccgcccagccgggaggagatgaccaagaaccaggtctccctcacgtgcctggtgaaggggttctaccccagcgacatcgccgtggagtgggagagcaacggccagcccgagaacaactacaagaccaccccgcccgtcctggactccgacggcagcttcttcctctactccaagctgaccgtggacaagagccgctggcagcaggggaacgtgttctcctgcagcgtcatgcacgaggcgctgcacaaccactacacgcagaagtccctcagcctgtcccccggcaag

SEQ ID NO: 7660 - RNA, 645 nt, synthetic construct
  misc_feature 1..645: note = derived and/or modified sequence opt1 from Afasevikumab_LightChain1
  source 1..645: mol_type = other RNA
gagatcgtgctgacccagagccccgccaccctctccctgagccccggcgagcgggccacgctgtcctgccgggcgagccagtccgtccgcagctacctcgcctggtaccagcagaagcccgggcaggcgccccggctgctgatctacgacgcctccaaccgcgccaccggcatccccgcccggttcagcgggtccggcagcgggaccgacttcaccctcacgatctccagcctggagccggaggacttcgccgtgtactactgccagcagcgctccaactggccgcccgccaccttcggcggcgggaccaaggtggagatcaagcggaccgtcgccgcgcccagcgtgttcatcttcccgccctccgacgagcagctcaagagcggcacggcctccgtggtctgcctgctgaacaacttctacccccgcgaggccaaggtgcagtggaaggtggacaacgccctgcagagcgggaactcccaggagagcgtcaccgagcaggacagcaaggactccacctacagcctctccagcaccctgacgctgtccaaggccgactacgagaagcacaaggtgtacgcgtgcgaggtgacccaccagggcctcagctcccccgtcaccaagagcttcaaccgcggggagtgc

SEQ ID NO: 7661 - RNA, 1293 nt, synthetic construct
  misc_feature 1..1293: note = derived and/or modified sequence opt1 from Aflibercept_Fusion_protein1
  source 1..1293: mol_type = other RNA
agcgacaccggccgccccttcgtggagatgtactccgagatcccggagatcatccacatgaccgaggggcgggagctggtcatcccctgccgcgtgacgagccccaacatcaccgtgaccctcaagaagttccccctggacaccctgatcccggacggcaagcggatcatctgggactcccgcaaggggttcatcatcagcaacgccacgtacaaggagatcggcctcctgacctgcgaggccaccgtcaacgggcacctgtacaagaccaactacctcacgcaccggcagaccaacaccatcatcgacgtggtgctgtcccccagccacggcatcgagctgtccgtcggcgagaagctcgtgctgaactgcaccgcgcgcacggagctgaacgtggggatcgacttcaactgggagtaccccagctccaagcaccagcacaagaagctcgtcaaccgggacctgaagacccagagcggctccgagatgaagaagttcctgagcaccctcaccatcgacggggtgacgcgctccgaccagggcctgtacacgtgcgccgccagctccgggctgatgaccaagaagaacagcaccttcgtgcgggtccacgagaaggacaagacccacacgtgcccgccctgccccgcccccgagctcctgggcggcccctccgtgttcctgttcccgcccaagcccaaggacaccctcatgatcagccgcacccccgaggtgacctgcgtcgtggtggacgtctcccacgaggacccggaggtgaagttcaactggtacgtggacggggtcgaggtgcacaacgccaagaccaagccccgggaggagcagtacaacagcacctaccgcgtggtcagcgtgctgaccgtcctgcaccaggactggctcaacggcaaggagtacaagtgcaaggtgtccaacaaggcgctgcccgcccccatcgagaagacgatcagcaaggccaaggggcagccgcgggagccccaggtgtacaccctgccgccctcccgcgacgagctcaccaagaaccaggtcagcctgacctgcctggtgaagggcttctacccctccgacatcgccgtggagtgggagagcaacggccagcccgagaacaactacaagacgaccccgcccgtcctcgactccgacgggagcttcttcctgtactccaagctgaccgtggacaagagccggtggcagcagggcaacgtgttctcctgcagcgtcatgcacgaggcgctccacaaccactacacccagaagtccctgagcctgtcccccggg

SEQ ID NO: 7662 - RNA, 1332 nt, synthetic construct
  misc_feature 1..1332: note = derived and/or modified sequence opt1 from Afutuzuab_HeavyChain1
  source 1..1332: mol_type = other RNA
caggtgcagctggtccagagcggcgccgaggtgaagaagcccgggtccagcgtgaaggtctcctgcaaggccagcggctacgcgttctcctacagctggatcaactgggtgcgccaggccccggggcagggcctcgagtgggggcggatcttccccggcgacggcgacaccgactacaacgggaagttcaagggccgcgtgaccatcaccgccgacaagtccaccagcaccgcctacgagctgtccagcctgcggtccgaggacaccgccgtctactactgcgcgcgcaacgtgttcgacgggtactggctcgtgtactggggccaggggacgctggtcaccgtgagctccgccagcaccaagggcccctccgtgttccccctggccccgagctccaagagcacctccggcgggacggccgcgctcggctgcctggtcaaggactacttccccgagcccgtgaccgtgagctggaacagcggggccctgacctccggcgtccacaccttccccgccgtgctccagagctccggcctgtacagcctgtccagcgtggtcacggtgccgtccagctccctcgggacccagacctacatctgcaacgtgaaccacaagcccagcaacaccaaggtcgacaagaaggtggagcccaagtcctgcgacaagacgcacacgtgcccgccctgccccgcccccgagctgctgggcgggcccagcgtgttcctcttcccgcccaagcccaaggacaccctgatctcccggacccccgaggtgacctgcgtcgtcgtggacgtgagccacgaggacccggaggtcaagttcaactggtacgtggacggcgtggaggtccacaacgccaagaccaagccccgcgaggagcagtacaactccacctaccgggtggtgagcgtcctgaccgtgctccaccaggactggctgaacgggaaggagtacaagtgcaaggtgtccaacaaggcgctgcccgcccccatcgagaagacgatcagcaaggccaagggccagccgcgcgagccccaggtctacaccctcccgccctcccgggacgagctgaccaagaaccaggtgagcctgacctgcctcgtgaagggcttctaccccagcgacatcgccgtcgagtgggagtccaacgggcagcccgagaacaactacaagacgacgcccccggtgctggacagcgacggctccttcttcctgtacagcaagctcaccgtggacaagtcccgctggcagcaggggaacgtcttcagctgctccgtgcacgaggccctgcacaaccactacacccagaagtccctgagcctcagccccggc

SEQ ID NO: 7663 - RNA, 651 nt, synthetic construct
  misc_feature 1..651: note = derived and/or modified sequence opt1 from Afutuzuab_LightChain1
  source 1..651: mol_type = other RNA
gacatcgtgacccagacgcccctgagcctcccggtcacccccggcgagcccgcctccatcagctgccgctccagcaagtccctgctgcacagcaacgggatcacctacctctactggtacctgcagaagcccggccagtccccgcagctgctcatctaccagagcaacctggtgtccggggtgcccgaccggttcagcggctccgggagcggcaccgacttcaccctgaagatctcccgcgtcgaggccgaggacgtgggcgtgtactactgcgcgcagaacctcgagctgccctacacgttcgggggcgggaccaaggtcgagatcaagcggaccgtggccgcccccagcgtgttcatcttcccgccctccgacgagcagctcaagagcggcaccgcctccgtcgtgtgcctgctgaacaacttctacccccgcgaggccaaggtgcagtggaaggtcgacaacgcgctgcagagcgggaactcccaggagagcgtgacggagcaggacagcaaggactccacctacagcctctccagcaccctgaccctgtccaaggccgactacgagaagcacaaggtgtacgcctgcgaggtcacgcaccagggcctcagctcccccgtgaccaagagcttcaaccggggcgagtgc

SEQ ID NO: 7664 - RNA, 1347 nt, synthetic construct
  misc_feature 1..1347: note = derived and/or modified sequence opt1 from Afutuzumab_HeavyChain1
  source 1..1347: mol_type = other RNA
caggtgcagctggtccagagcggcgccgaggtgaagaagcccgggtccagcgtgaaggtctcctgcaaggccagcggctacgcgttctcctacagctggatcaactgggtgcgccaggccccggggcagggcctcgagtggatggggcggatcttccccggcgacggcgacaccgactacaacgggaagttcaagggccgcgtgaccatcaccgccgacaagtccaccagcaccgcctacatggagctgtccagcctgcggtccgaggacaccgccgtctactactgcgcgcgcaacgtgttcgacgggtactggctcgtgtactggggccaggggacgctggtcaccgtgagctccgccagcaccaagggcccctccgtgttccccctggccccgagctccaagagcacctccggcgggacggccgcgctcggctgcctggtcaaggactacttccccgagcccgtgaccgtgagctggaacagcggggccctgacctccggcgtccacaccttccccgccgtgctccagagctccggcctgtacagcctgtccagcgtggtcacggtgccgtccagctccctcgggacccagacctacatctgcaacgtgaaccacaagcccagcaacaccaaggtcgacaagaaggtggagcccaagtcctgcgacaagacgcacacgtgcccgccctgccccgcccccgagctgctgggcgggcccagcgtgttcctcttcccgcccaagcccaaggacaccctgatgatctcccggacccccgaggtgacctgcgtcgtcgtggacgtgagccacgaggacccggaggtcaagttcaactggtacgtggacggcgtggaggtccacaacgccaagaccaagccccgcgaggagcagtacaactccacctaccgggtggtgagcgtcctgaccgtgctccaccaggactggctgaacgggaaggagtacaagtgcaaggtgtccaacaaggcgctgcccgcccccatcgagaagacgatcagcaaggccaagggccagccgcgcgagccccaggtctacaccctcccgccctcccgggacgagctgaccaagaaccaggtgagcctgacctgcctcgtgaagggcttctaccccagcgacatcgccgtcgagtgggagtccaacgggcagcccgagaacaactacaagacgacgcccccggtgctggacagcgacggctccttcttcctgtacagcaagctcaccgtggacaagtcccgctggcagcaggggaacgtcttcagctgctccgtgatgcacgaggccctgcacaaccactacacccagaagtccctgagcctcagccccggcaag

SEQ ID NO: 7665 - RNA, 657 nt, synthetic construct
  misc_feature 1..657: note = derived and/or modified sequence opt1 from Afutuzumab_LightChain1
  source 1..657: mol_type = other RNA
gacatcgtgatgacccagacgcccctgagcctcccggtcacccccggcgagcccgcctccatcagctgccgctccagcaagtccctgctgcacagcaacgggatcacctacctctactggtacctgcagaagcccggccagtccccgcagctgctcatctaccagatgagcaacctggtgtccggggtgcccgaccggttcagcggctccgggagcggcaccgacttcaccctgaagatctcccgcgtcgaggccgaggacgtgggcgtgtactactgcgcgcagaacctcgagctgccctacacgttcgggggcgggaccaaggtcgagatcaagcggaccgtggccgcccccagcgtgttcatcttcccgccctccgacgagcagctcaagagcggcaccgcctccgtcgtgtgcctgctgaacaacttctacccccgcgaggccaaggtgcagtggaaggtcgacaacgcgctgcagagcgggaactcccaggagagcgtgacggagcaggacagcaaggactccacctacagcctctccagcaccctgaccctgtccaaggccgactacgagaagcacaaggtgtacgcctgcgaggtcacgcaccagggcctcagctcccccgtgaccaagagcttcaaccggggcgagtgc

SEQ ID NO: 7666 - RNA, 684 nt, synthetic construct
  misc_feature 1..684: note = derived and/or modified sequence opt1 from Alacizumab_pegol_HeavyChain1
  source 1..684: mol_type = other RNA
gaggtgcagctggtcgagagcggcgggggcctcgtgcagcccgggggctccctgcgcctgagctgcgccgcctccgggttcaccttcagctcctacggcatgagctgggtgcggcaggcgccgggcaaggggctcgagtgggtcgccaccatcacctccggcgggagctacacctactacgtggactccgtgaagggccgcttcaccatcagccgggacaacgccaagaacaccctgtacctgcagatgaactccctccgcgccgaggacacggccgtctactactgcgtgcggatcggggaggacgcgctggactactggggccagggcaccctggtgaccgtcagctccgccagcaccaaggggccctccgtgttccccctcgcccccagctccaagagcacgtccggcgggaccgccgcgctgggctgcctggtgaaggactacttcccggagcccgtcaccgtgagctggaacagcggcgccctcacctccggggtgcacacgttccccgccgtcctgcagagctccggcctgtacagcctctccagcgtggtgaccgtcccctccagctccctggggacccagacctacatctgcaacgtgaaccacaagccgagcaacacgaaggtggacaagaaggtcgagcccaagtcctgcgacaagacccacacgtgcgccgcc

SEQ ID NO: 7667 - RNA, 642 nt, synthetic construct
  misc_feature 1..642: note = derived and/or modified sequence opt1 from Alacizumab_pegol_LightChain1
  source 1..642: mol_type = other RNA
gacatccagatgacccagagcccctccagcctgtccgccagcgtgggcgaccgggtcaccatcacgtgccgggcctcccaggacatcgcggggagcctcaactggctgcagcagaagccgggcaaggccatcaagcgcctgatctacgccacctccagcctcgactccggggtgcccaagcggttcagcggctcccgcagcgggtccgactacaccctgaccatcagctccctgcagcccgaggacttcgccacgtactactgcctccagtacggcagcttcccgcccaccttcggccaggggaccaaggtggagatcaagcggaccgtcgccgcgccctccgtgttcatcttcccgcccagcgacgagcagctgaagtccggcacggccagcgtggtctgcctgctcaacaacttctacccccgcgaggccaaggtgcagtggaaggtggacaacgccctgcagagcgggaactcccaggagagcgtcaccgagcaggactccaaggacagcacctactccctgagctccaccctcacgctgagcaaggcggactacgagaagcacaaggtgtacgcctgcgaggtgacccaccagggcctgtccagccccgtcaccaagtccttcaaccgcggggagtgc

SEQ ID NO: 7668 - RNA, 1353 nt, synthetic construct
  misc_feature 1..1353: note = derived and/or modified sequence opt1 from Alemtuzumab_HeavyChain
  source 1..1353: mol_type = other RNA
caggtgcagctgcaggagagcggccccgggctcgtccgcccgtcccagaccctgagcctgacctgcacggtgtccggcttcaccttcaccgacttctacatgaactgggtgcggcagccgcccgggcgcggcctcgagtggatcgggttcatccgggacaaggccaagggctacaccacggagtacaaccccagcgtcaagggccgcgtgaccatgctggtggacacctccaagaaccagttcagcctgcggctctccagcgtcaccgccgcggacacggccgtgtactactgcgcccgcgaggggcacaccgccgccccgttcgactactggggccaggggtccctggtgaccgtcagctccgcgagcaccaagggcccctccgtgttccccctggcccccagctccaagagcacgtccgggggcaccgccgccctcggctgcctggtgaaggactacttcccggagcccgtcaccgtgagctggaactccggggcgctgaccagcggcgtgcacacgttccccgccgtcctccagagctccgggctgtacagcctgtccagcgtggtgaccgtcccctccagctccctcggcacccagacctacatctgcaacgtgaaccacaagccgagcaacacgaaggtggacaagaaggtcgagcccaagtcctgcgacaagacccacacgtgcccgccctgccccgcccccgagctgctgggcgggcccagcgtgttcctcttcccgcccaagcccaaggacaccctgatgatctcccggacccccgaggtgacctgcgtcgtggtcgacgtgagccacgaggaccccgaggtgaagttcaactggtacgtcgacggcgtggaggtgcacaacgccaagaccaagccgcgcgaggagcagtacaactccacctaccgggtcgtgagcgtgctgacggtcctccaccaggactggctgaacgggaaggagtacaagtgcaaggtgtccaacaaggccctgcccgcgcccatcgagaagaccatcagcaaggccaagggccagccccgcgagccccaggtgtacaccctcccgccctcccgggacgagctgaccaagaaccaggtcagcctgacgtgcctcgtgaaggggttctacccctccgacatcgccgtggagtgggagagcaacggccagcccgagaacaactacaagaccaccccgcccgtcctggacagcgacggctccttcttcctgtacagcaagctcaccgtggacaagtcccgctggcagcaggggaacgtgttcagctgctccgtcatgcacgaggccctgcacaaccactacacgcagaagtccctgagcctcagccccggcaag

SEQ ID NO: 7669 - RNA, 657 nt, synthetic construct
  misc_feature 1..657: note = derived and/or modified sequence opt1 from Alemtuzumab_HeavyChain_variant_1bey_H
  source 1..657: mol_type = other RNA
caggtgcagctgcaggagagcggccccgggctcgtccgcccgtcccagaccctgagcctgacctgcacggtgtccggcttcaccttcaccgacttctacatgaactgggtgcggcagccgcccgggcgcggcctcgagtggatcgggttcatccgggacaaggccaagggctacaccacggagtacaaccccagcgtcaagggccgcgtgaccatgctggtggacacctccaagaaccagttcagcctgcggctctccagcgtcaccgccgcggacacggccgtgtactactgcgcccgcgaggggcacaccgccgcccccttcgactactggggccaggggtccctggtgaccgtcagctccgcgagcaccaagggcccctccgtgttccccctggcccccagctccaagagcacgtccgggggcaccgccgccctcggctgcctggtgaaggactacttcccggagcccgtcaccgtgagctggaactccggggcgctgaccagcggcgtgcacacgttccccgccgtcctccagagctccgggctgtacagcctgtccagcgtggtgaccgtcccctccagctccctcggcacccagacctacatctgcaacgtgaaccacaagccgagcaacacgaaggtggacaagaaggtc

SEQ ID NO: 7670 - RNA, 660 nt, synthetic construct
  misc_feature 1..660: note = derived and/or modified sequence opt1 from Alemtuzumab_HeavyChain_variant_1ce1_H
  source 1..660: mol_type = other RNA
caggtgcagctgcaggagagcggccccgggctcgtccgcccgtcccagaccctgagcctgacctgcacggtgtccggcttcaccttcaccgacttctacatgaactgggtgcggcagccgcccgggcgcggcctcgagtggatcgggttcatccgggacaaggccaagggctacaccacggagtacaaccccagcgtcaagggccgcgtgaccatgctggtggacacctccaagaaccagttcagcctgcggctctccagcgtcaccgccgcggacacggccgtgtactactgcgcccgcgaggggcacaccgccgcccccttcgactactggggccaggggtccctggtgaccgtcagctccgcgagcaccaagggcccctccgtgttccccctggcccccagctccaagagcacgtccgggggcaccgccgccctcggctgcctggtgaaggactacttcccggagcccgtcaccgtgagctggaactccggggcgctgaccagcggcgtgcacacgttccccgccgtcctccagagctccgggctgtacagcctgtccagcgtggtgaccgtcccctccagctccctcggcacccagacctacatctgcaacgtgaaccacaagccgagcaacacgaaggtggacaagaaggtcgag

SEQ ID NO: 7671 - RNA, 1311 nt, synthetic construct
  misc_feature 1..1311: note = derived and/or modified sequence opt1 from Alemtuzumab_HeavyChain_variant_8005_H
  source 1..1311: mol_type = other RNA
caggtgcagctgcaggagagcggccccgggctcgtccgcccgtcccagaccctgagcctgacctgcacggtgtccggcttcaccttcaccgacttctacatgaactgggtgcggcagccgcccgggcgcggcctcgagtggatcgggttcatccgggacaaggccaagggctacaccacggagtacaaccccagcgtcaagggccgcgtgaccatgctggtggacacctccaagaaccagttcagcctgcggctctccagcgtcaccgccgcggacacggccgtgtactactgcgcccgcgaggggcacaccgccgccccgttcgactactggggccaggggtccctggtgaccgtcagctccgcgagcaccaagggcccctccgtgttccccctggcccccagctccaagagcacgtccgggggcaccgccgccctcggctgcctggtgaaggactacttcccggagcccgtcaccgtgagctggaactccggggcgctgaccagcggcgtgcacacgttccccgccgtcctccagagctccgggctgtacagcctgtccagcgtggtgaccgtcccctccagctccctcggcacccagacctacatctgcaacgtgaaccacaagccgagcaacacgaaggtggacaagaaggtcgaggcccccgagctgctgggcgggccctccgtgttcctcttcccgcccaagcccaaggacaccctgatgatcagccggacccccgaggtgacctgcgtcgtggtcgacgtgtcccacgaggaccccgaggtgaagttcaactggtacgtcgacggcgtggaggtgcacaacgccaagacgaagccgcgcgaggagcagtacaacagcacctaccgggtcgtgtccgtgctgaccgtcctccaccaggactggctgaacgggaaggagtacaagtgcaaggtgagcaacaaggccctgcccgcgcccatcgagaagaccatctccaaggccaagggccagccccgcgagccccaggtgtacacgctcccgcccagccgggacgagctgaccaagaaccaggtctccctgacctgcctcgtgaaggggttctaccccagcgacatcgccgtggagtgggagtccaacggccagcccgagaacaactacaagaccacgccgcccgtcctggacagcgacggcagcttcttcctgtactccaagctcaccgtggacaagagccgctggcagcaggggaacgtgttctcctgcagcgtcatgcacgaggccctgcacaaccactacacccagaagtccctgagcctctcccccggcaag

SEQ ID NO: 7672 - RNA, 633 nt, synthetic construct
  misc_feature 1..633: note = derived and/or modified sequence opt1 from Alemtuzumab_LightChain
  source 1..633: mol_type = other RNA
gacatccagatgacccagagcccctccagcctgtccgccagcgtgggcgaccgcgtcaccatcacgtgcaaggcctcccagaacatcgacaagtacctcaactggtaccagcagaagccggggaaggcgcccaagctgctgatctacaacaccaacaacctccagaccggcgtgcccagccggttctccgggagcggctccgggaccgacttcacgttcaccatcagctccctgcagcccgaggacatcgccacctactactgcctgcagcacatcagccgcccgcggaccttcggccagggcacgaaggtggagatcaagcgcaccgtcgccgccccctccgtgttcatcttcccgcccagcgacgagcagctcaagtccgggaccgccagcgtggtctgcctgctgaacaacttctacccccgggaggcgaaggtgcagtggaaggtggacaacgccctccagtccggcaacagccaggagtccgtcaccgagcaggacagcaaggacagcacgtactccctgagctccaccctgaccctcagcaaggccgactacgagaagcacaaggtgtacgcctgcgaggtgacccaccaggggctgtccagccccgtcacgaagtccttcaaccgc

SEQ ID NO: 7673 - RNA, 642 nt, synthetic construct
  misc_feature 1..642: note = derived and/or modified sequence opt1 from Alemtuzumab_LightChain_variant_8005_L
  source 1..642: mol_type = other RNA
gacatccagatgacccagagcccctccagcctgtccgccagcgtgggcgaccgcgtcaccatcacgtgcaaggcctcccagaacatcgacaagtacctcaactggtaccagcagaagccggggaaggcgcccaagctgctgatctacaacaccaacaacctccagaccggcgtgcccagccggttctccgggagcggctccgggaccgacttcacgttcaccatcagctccctgcagcccgaggacatcgccacctactactgcctgcagcacatcagccgcccgcggaccttcggccagggcacgaaggtggagatcaagcgcaccgtcgccgccccctccgtgttcatcttcccgcccagcgacgagcagctcaagtccgggaccgccagcgtggtctgcctgctgaacaacttctacccccgggaggcgaaggtgcagtggaaggtggacaacgccctccagtccggcaacagccaggagtccgtcaccgagcaggacagcaaggacagcacgtactccctgagctccaccctgaccctcagcaaggccgactacgagaagcacaaggtgtacgcctgcgaggtgacccaccaggggctgtccagccccgtcacgaagtccttcaaccgcggcgagtgc

SEQ ID NO: 7674 - RNA, 1341 nt, synthetic construct
  misc_feature 1..1341: note = derived and/or modified sequence opt1 from Alirocumab_HeavyChain1
  source 1..1341: mol_type = other RNA
gaggtgcagctggtcgagagcggcgggggcctcgtgcagcccgggggctccctgcgcctgagctgcgccgcctccgggttcaccttcaacaactacgcgatgaactgggtgcggcaggccccgggcaagggcctcgactgggtcagcaccatctccgggagcggcgggacgaccaactacgccgactccgtgaagggccgcttcatcatcagccgggactccagcaagcacaccctgtacctgcagatgaactccctccgcgccgaggacaccgccgtgtactactgcgcgaaggacagcaactgggggaacttcgacctgtggggccggggcacgctggtcaccgtgtccagcgcctccaccaaggggcccagcgtgttccccctcgccccctccagcaagtccaccagcggcgggacggccgcgctgggctgcctggtcaaggactacttcccggagcccgtgaccgtgagctggaactccggcgccctcaccagcggggtccacaccttccccgccgtgctgcagtccagcggcctgtactccctcagctccgtggtcacggtgcccagctccagcctggggacccagacctacatctgcaacgtgaaccacaagccgtccaacaccaaggtcgacaagaaggtggagcccaagagctgcgacaagacgcacacgtgcccgccctgccccgcccccgagctgctcggcgggccctccgtgttcctgttcccgcccaagcccaaggacaccctgatgatcagccgcacccccgaggtgacctgcgtcgtggtcgacgtgtcccacgaggaccccgaggtcaagttcaactggtacgtggacggcgtggaggtccacaacgccaagaccaagccgcgggaggagcagtacaacagcacctaccgcgtggtgtccgtcctcaccgtgctgcaccaggactggctgaacggcaaggagtacaagtgcaaggtgagcaacaaggcgctccccgcccccatcgagaagacgatctccaaggccaaggggcagccccgggagccgcaggtctacaccctgccgcccagccgcgacgagctgaccaagaaccaggtgagcctgacctgcctcgtgaagggcttctacccctccgacatcgccgtcgagtgggagagcaacgggcagcccgagaacaactacaagacgaccccgcccgtgctggactccgacggcagcttcttcctctactccaagctgaccgtggacaagagccggtggcagcaggggaacgtcttctcctgcagcgtgatgcacgaggccctgcacaaccactacacccagaagtccctcagcctgtcccccggc

SEQ ID NO: 7675 - RNA, 660 nt, synthetic construct
  misc_feature 1..660: note = derived and/or modified sequence opt1 from Alirocumab_LightChain1
  source 1..660: mol_type = other RNA
gacatcgtgatgacccagagccccgactccctggccgtcagcctcggcgagcgggccaccatcaactgcaagtccagccagtccgtgctgtaccggagcaacaaccgcaacttcctggggtggtaccagcagaagccgggccagccgcccaacctcctgatctactgggcgtccacgcgggagagcggggtgcccgaccgcttctccggcagcgggtccggcaccgacttcaccctgaccatcagctccctccaggccgaggacgtcgccgtgtactactgccagcagtactacacgaccccctacaccttcggccaggggaccaagctggagatcaagcggacggtggccgcccccagcgtcttcatcttcccgccctccgacgagcagctcaagagcggcaccgcgtccgtggtgtgcctgctgaacaacttctacccccgcgaggccaaggtccagtggaaggtggacaacgccctgcagagcgggaactcccaggagagcgtgaccgagcaggacagcaaggactccacctacagcctctccagcacgctgaccctgtccaaggccgactacgagaagcacaaggtctacgcgtgcgaggtgacccaccagggcctcagctcccccgtgaccaagagcttcaaccgcggggagtgc

SEQ ID NO: 7676 - RNA, 735 nt, synthetic construct
  misc_feature 1..735: note = derived and/or modified sequence opt1 from ALX-0061_HeavyChain1
  source 1..735: mol_type = other RNA
gaggtgcagctggtcgagagcggcgggggcctcgtgcagcccgggggctccctgcgcctgagctgcgccgcctccgggagcgtgttcaagatcaacgtcatggcgtggtaccggcaggccccgggcaagggccgcgagctcgtggccgggatcatctccggcgggagcacctcctacgccgacagcgtgaagggccggttcaccatctcccgcgacaacgccaagaacacgctgtacctgcagatgaacagcctccggcccgaggacaccgcggtctactactgcgccttcatcaccaccgagtccgactacgacctggggcgccggtactggggccagggcacgctggtgaccgtgagctccgggggcgggggcagcggcgggggctccgaggtccagctcgtggagagcgggggcgggctggtgcagcccggcaactccctgcgcctcagctgcgccgcctccggcttcaccttcagcagcttcgggatgtcctgggtccggcaggcgcccggcaaggggctggagtgggtgagctccatcagcggctccgggagcgacaccctgtacgccgactccgtgaagggccgcttcacgatcagccgggacaacgccaagaccaccctctacctgcagatgaactccctgcgcccggaggacaccgccgtctactactgcacgatcggcgggagcctctcccggagctcccagggcaccctggtgaccgtgagctcc

SEQ ID NO: 7677 - RNA, 1347 nt, synthetic construct
  misc_feature 1..1347: note = derived and/or modified sequence opt1 from Amatuximab_HeavyChain1
  source 1..1347: mol_type = other RNA
caggtgcagctgcagcagagcggccccgagctcgagaagccgggggcctccgtcaagatcagctgcaaggcctccggctacagcttcaccgggtacaccatgaactgggtgaagcagtcccacggcaagagcctggagtggatcgggctgatcacgccctacaacggcgcgtccagctacaaccagaagttccgcggcaaggccaccctcaccgtggacaagtccagctccaccgcctacatggacctgctgagcctcacgtccgaggacagcgccgtctacttctgcgcccgcgggggctacgacgggcggggcttcgactactgggggtccggcacccccgtgaccgtgagctccgcgagcaccaagggcccctccgtcttcccgctggcccccagcagcaagtccacgagcgggggcaccgccgccctggggtgcctcgtgaaggactacttccccgagcccgtgaccgtctcctggaacagcggcgcgctgacctccggcgtgcacacgttcccggccgtgctgcagagctccgggctctacagcctgtccagcgtcgtgaccgtgccctccagctccctgggcacccagacctacatctgcaacgtcaaccacaagcccagcaacacgaaggtggacaagaaggtggagcccaagtcctgcgacaagacccacacgtgcccgccctgccccgcccccgagctcctcgggggcccgagcgtcttcctgttcccgcccaagcccaaggacaccctgatgatctcccggacccccgaggtgacctgcgtggtcgtggacgtgagccacgaggaccccgaggtcaagttcaactggtacgtggacggggtcgaggtgcacaacgccaagaccaagccccgcgaggagcagtacaactccacctaccgggtggtcagcgtgctgacggtgctgcaccaggactggctcaacggcaaggagtacaagtgcaaggtcagcaacaaggccctgcccgcgccgatcgagaagaccatctccaaggccaagggccagccccgcgagccccaggtgtacaccctgcccccgagccgggacgagctcaccaagaaccaggtgtccctgacgtgcctggtcaaggggttctaccccagcgacatcgccgtggagtgggagtccaacggccagcccgagaacaactacaagaccaccccgcccgtgctcgacagcgacgggtccttcttcctgtacagcaagctgaccgtcgacaagtcccgctggcagcagggcaacgtgttcagctgctccgtgatgcacgaggccctccacaaccactacacgcagaagtccctgagcctgagccccgggaag

SEQ ID NO: 7678 - RNA, 639 nt, synthetic construct
  misc_feature 1..639: note = derived and/or modified sequence opt1 from Amatuximab_LightChain1
  source 1..639: mol_type = other RNA
gacatcgagctgacccagagccccgccatcatgtccgccagcccgggcgagaaggtgaccatgacgtgctccgcgagctccagcgtctcctacatgcactggtaccagcagaagtccgggaccagccccaagcgctggatctacgacaccagcaagctcgcctccggcgtgcccgggcggttcagcggctccgggagcggcaactcctacagcctgaccatctccagcgtggaggccgaggacgacgccacgtactactgccagcagtggtccaagcaccccctgaccttcggcagcgggaccaaggtcgagatcaagcgcaccgtggccgcgccgagcgtgttcatcttcccgccctccgacgagcagctcaagagcggcacggcctccgtcgtgtgcctgctgaacaacttctacccccgggaggccaaggtgcagtggaaggtcgacaacgccctccagagcgggaactcccaggagagcgtgaccgagcaggactccaaggacagcacctactccctgagctccaccctgacgctcagcaaggcggactacgagaagcacaaggtgtacgcctgcgaggtcacccaccagggcctgtccagccccgtgaccaagtccttcaaccgcggggagtgc

SEQ ID NO: 7679 - RNA, 1350 nt, synthetic construct
  misc_feature 1..1350: note = derived and/or modified sequence opt1 from Anetumab_ravtansine_HeavyChain1
  source 1..1350: mol_type = other RNA
caggtggagctggtccagagcggcgccgaggtgaagaagcccggggagtccctcaagatcagctgcaagggctccgggtacagcttcacctcctactggatcggctgggtgcgccaggccccggggaagggcctggagtggatgggcatcatcgaccccggggacagccggacccgctactcccccagcttccagggccaggtcacgatctccgcggacaagagcatctccaccgcctacctgcagtggagctccctcaaggccagcgacaccgccatgtactactgcgcccgggggcagctgtacggcgggacctacatggacggctggggccaggggacgctggtgaccgtgtccagcgcgtccaccaagggccccagcgtcttcccgctcgccccctccagcaagagcacctccgggggcacggccgccctgggctgcctggtgaaggactacttccccgagcccgtgaccgtcagctggaactccggggcgctcaccagcggcgtgcacaccttcccggccgtgctgcagtccagcgggctgtactccctcagctccgtcgtgacggtgcccagctccagcctgggcacccagacctacatctgcaacgtcaaccacaagccctccaacaccaaggtggacaagaaggtggagcccaagagctgcgacaagacgcacacgtgcccgccctgccccgcccccgagctgctcgggggcccgtccgtcttcctgttcccgcccaagcccaaggacaccctgatgatcagccgcacccccgaggtgacctgcgtggtcgtggacgtgtcccacgaggaccccgaggtcaagttcaactggtacgtggacggcgtcgaggtgcacaacgccaagaccaagccccgggaggagcagtacaacagcacctaccgcgtggtctccgtgctcaccgtgctgcaccaggactggctgaacgggaaggagtacaagtgcaaggtcagcaacaaggccctccccgcgccgatcgagaagacgatcagcaaggccaagggccagccccgggagccccaggtgtacaccctgcccccgtcccgcgacgagctgaccaagaaccaggtgagcctgacctgcctcgtcaaggggttctacccctccgacatcgccgtggagtgggagagcaacggccagcccgagaacaactacaagacgaccccgcccgtgctggactccgacgggagcttcttcctctactccaagctgaccgtcgacaagagccggtggcagcagggcaacgtgttctcctgcagcgtgatgcacgaggccctgcacaaccactacacccagaagtccctcagcctgtcccccggcaag

SEQ ID NO: 7680 - RNA, 651 nt, synthetic construct
  misc_feature 1..651: note = derived and/or modified sequence opt1 from Anetumab_ravtansine_LightChain1
  source 1..651: mol_type = other RNA
gacatcgccctgacccagcccgccagcgtgtccggcagcccggggcagtccatcaccatcagctgcacgggcacctccagcgacatcgggggctacaactccgtcagctggtaccagcagcaccccgggaaggcgcccaagctcatgatctacggcgtgaacaaccgcccctccggcgtgagcaaccggttctccgggagcaagtccggcaacaccgccagcctgaccatctccgggctgcaggccgaggacgaggccgactactactgcagctcctacgacatcgagagcgccacgccggtcttcggcgggggcaccaagctcaccgtgctgggccagcccaaggcggccccctccgtgaccctgttcccgcccagcagcgaggagctccaggccaacaaggccacgctggtctgcctgatctccgacttctaccccggggcggtgaccgtggcctggaagggcgacagctcccccgtcaaggccggggtggagaccaccacgcccagcaagcagtccaacaacaagtacgccgccagctcctacctcagcctgaccccggagcagtggaagtcccaccgcagctactcctgccaggtgacccacgagggcagcaccgtcgagaagacggtggcgcccaccgagtgctcc

SEQ ID NO: 7681 - RNA, 1341 nt, synthetic construct
  misc_feature 1..1341: note = derived and/or modified sequence opt1 from Anifrolumab_HeavyChain1
  source 1..1341: mol_type = other RNA
gaggtgcagctggtccagagcggcgccgaggtgaagaagcccggggagtccctcaagatcagctgcaagggctccgggtacatcttcaccaactactggatcgcctgggtgcgccagatgccgggcaaggggctggagagcatgggcatcatctaccccggcgactccgacatccggtacagcccctccttccaggggcaggtcaccatcagcgcggacaagtccatcacgaccgcctacctgcagtggagctccctcaaggccagcgacaccgccatgtactactgcgcccgccacgacatcgagggcttcgactactgggggcggggcaccctggtgacggtgtccagcgcgtccaccaaggggcccagcgtcttcccgctggccccctccagcaagtccaccagcggcggcaccgccgccctcgggtgcctggtgaaggactacttccccgagcccgtgacggtcagctggaactccggcgcgctgaccagcggggtgcacaccttcccggccgtgctccagtccagcggcctgtactccctgagctccgtcgtgaccgtgcccagctccagcctcggcacgcagacctacatctgcaacgtcaaccacaagccctccaacaccaaggtggacaagcgcgtggagcccaagagctgcgacaagacccacacgtgcccgccctgccccgcccccgagttcgagggcgggccgtccgtcttcctgttcccgcccaagcccaaggacaccctgatgatcagccggacccccgaggtgacctgcgtggtcgtggacgtgtcccacgaggaccccgaggtcaagttcaactggtacgtggacggggtcgaggtgcacaacgccaagacgaagccccgcgaggagcagtacaacagcacctaccgggtggtctccgtgctcaccgtgctgcaccaggactggctgaacggcaaggagtacaagtgcaaggtcagcaacaaggccctccccgcgtccatcgagaagaccatcagcaaggccaaggggcagccgcgcgagccccaggtgtacacgctgccgcccagccgggaggagatgaccaagaaccaggtgtccctgacctgcctcgtcaagggcttctaccccagcgacatcgccgtggagtgggagtccaacggccagcccgagaacaactacaagaccacgcccccggtgctggacagcgacgggtccttcttcctgtacagcaagctcaccgtcgacaagtcccgctggcagcagggcaacgtgttcagctgctccgtgatgcacgaggccctgcacaaccactacacccagaagtccctgagcctcagccccgggaag

SEQ ID NO: 7682 - RNA, 645 nt, synthetic construct
  misc_feature 1..645: note = derived and/or modified sequence opt1 from Anifrolumab_LightChain1
  source 1..645: mol_type = other RNA
gagatcgtgctgacccagagccccggcaccctctccctgagcccgggggagcgcgccacgctgtcctgccgggccagccagtccgtcagctccagcttcttcgcgtggtaccagcagaagcccggccaggcgccccgcctcctgatctacggggcctccagccgggccaccggcatccccgaccgcctgtccgggagcggctccggcaccgacttcaccctcacgatcacccggctggagccggaggacttcgccgtgtactactgccagcagtacgacagctccgccatcaccttcgggcagggcacccgcctggagatcaagcggacggtggccgcccccagcgtcttcatcttcccgccctccgacgagcagctcaagagcgggaccgcctccgtggtgtgcctgctgaacaacttctacccccgcgaggcgaaggtccagtggaaggtggacaacgccctccagagcggcaacagccaggagtccgtgaccgagcaggacagcaaggactccacctacagcctgtccagcacgctgaccctctccaaggccgactacgagaagcacaaggtctacgcctgcgaggtgacccaccaggggctgagctcccccgtgaccaagagcttcaaccggggcgagtgc

SEQ ID NO: 7683 - RNA, 1344 nt, synthetic construct
  misc_feature 1..1344: note = derived and/or modified sequence opt1 from Anrukinzumab_HeavyChain1
  source 1..1344: mol_type = other RNA
gaggtgcagctggtcgagagcggcgggggcctcgtgcagcccgggggctccctgcgcctgagctgcgccgcctccgggttcaccttcatcagctacgcgatgtcctgggtgcggcaggccccgggcaagggcctcgagtgggtcgccagcatctccagcgggggcaacacctactaccccgactccgtgaaggggcgcttcacgatcagccgggacaacgccaagaactccctgtacctgcagatgaacagcctccgcgccgaggacaccgcggtgtactactgcgcccggctggacggctactacttcgggttcgcctactggggccagggcaccctggtcaccgtgtccagcgcctccacgaaggggcccagcgtgttccccctcgcgccgtccagcaagtccaccagcggcgggaccgccgccctgggctgcctggtcaaggactacttccccgagcccgtgaccgtgagctggaactccggcgccctcacgagcggggtccacaccttccccgccgtgctgcagtccagcggcctgtactccctcagctccgtggtcaccgtgccgagctccagcctggggacccagacgtacatctgcaacgtgaaccacaagccctccaacaccaaggtcgacaagaaggtggagcccaagagctgcgacaagacccacacgtgcccgccctgccccgcgcccgaggccctgggcgccccctccgtgttcctcttcccgcccaagcccaaggacaccctgatgatcagccgcacccccgaggtgacctgcgtcgtggtcgacgtgtcccacgaggacccggaggtcaagttcaactggtacgtggacggggtggaggtccacaacgccaagaccaagccccgggaggagcagtacaacagcacgtaccgcgtggtgtccgtcctgaccgtgctccaccaggactggctgaacggcaaggagtacaagtgcaaggtgagcaacaaggccctgcccgcgcccatcgagaagaccatctccaaggccaagggccagccgcgggagccccaggtctacaccctcccgcccagccgcgaggagatgacgaagaaccaggtgagcctgacctgcctggtgaaggggttctacccctccgacatcgccgtcgagtgggagagcaacggccagcccgagaacaactacaagaccacgcccccggtgctcgactccgacgggagcttcttcctgtactccaagctgaccgtggacaagagccggtggcagcagggcaacgtcttctcctgcagcgtgatgcacgaggccctccacaaccactacacccagaagtccctgagcctgtcccccgggaag

SEQ ID NO: 7684 - RNA, 654 nt, synthetic construct
  misc_feature 1..654: note = derived and/or modified sequence opt1 from Anrukinzumab_LightChain1
  source 1..654: mol_type = other RNA
gacatccagatgacccagagcccctccagcctgtccgccagcgtgggcgaccgcgtcaccatcacgtgcaaggcctccgagagcgtggacaactacgggaagtccctcatgcactggtaccagcagaagccgggcaaggcgcccaagctgctgatctaccgggccagcaacctcgagtccggggtgcccagccgcttctccggcagcgggtccggcaccgacttcaccctgaccatcagctccctgcagcccgaggacttcgccacgtactactgccagcagagcaacgaggacccgtggaccttcggcgggggcaccaaggtcgagatcaagcggaccgtggccgccccctccgtgttcatcttcccgcccagcgacgagcagctcaagtccgggacggcgagcgtcgtgtgcctgctgaacaacttctacccccgcgaggccaaggtgcagtggaaggtcgacaacgccctccagagcggcaactcccaggagagcgtgaccgagcaggactccaaggacagcacctactccctgagctccaccctgacgctcagcaaggccgactacgagaagcacaaggtgtacgcgtgcgaggtcacccaccaggggctgtccagccccgtgaccaagtccttcaaccggggcgagtgc

SEQ ID NO: 7685 - RNA, 1338 nt, synthetic construct
  misc_feature 1..1338: note = derived and/or modified sequence opt1 from Apolizumab_HeavyChain1
  source 1..1338: mol_type = other RNA
caggtgcagctgcaggagagcggccccgggctcgtcaagccgtccgagaccctgagcctgacctgcacggtgtccggcttcagcctcaccaactacggggtgcactgggtccgccagtcccccggcaaggggctggagtggatcggcgtgaagtggagcggcgggtccaccgagtacaacgccgccttcatcagccggctgaccatctccaaggacacgagcaagaaccaggtgtccctcaagctgaacagcctgaccgcggccgacaccgccgtctactactgcgcccgcaacgaccggtacgccatggactactggggccaggggaccctcgtgacggtgtccagcgcgtccaccaagggccccagcgtcttccccctggccccgtccagcaagtccaccagcgggggcaccgccgccctgggctgcctcgtgaaggactacttccccgagcccgtgacggtcagctggaactccggggcgctgaccagcggcgtgcacaccttccccgccgtgctgcagtccagcgggctctactccctgagctccgtcgtgaccgtgccgagctccagcctgggcacgcagacctacatctgcaacgtcaaccacaagccctccaacaccaaggtggacaagaaggtggagcccaagagctgcgacaagacccacacgtgcccgccctgccccgcccccgagctcctgggcgggccctccgtcttcctgttcccgcccaagcccaaggacaccctcatgatcagccgcacccccgaggtgacctgcgtggtcgtggacgtctcccacgaggacccggaggtgaagttcaactggtacgtggacggcgtcgaggtgcacaacgccaagacgaagccccgggaggagcagtacaacagcacctaccgcgtggtctccgtgctgaccgtgctgcaccaggactggctcaacgggaaggagtacaagtgcaaggtcagcaacaaggccctgcccgcgcccatcgagaagaccatctccaaggccaagggccagccgcgggagccccaggtgtacacgctgccgcccagccgcgacgagctcaccaagaaccaggtgagcctgacctgcctggtcaaggggttctacccctccgacatcgccgtggagtgggagagcaacggccagcccgagaacaactacaagaccacgcccccggtgctcgactccgacggcagcttcttcctgtactccaagctgaccgtcgacaagagccggtggcagcaggggaacgtgttctcctgcagcgtgatgcacgaggccctccacaaccactacacccagaagtccctgagcctgtcccccggcaag

SEQ ID NO: 7686 - RNA, 642 nt, synthetic construct
  misc_feature 1..642: note = derived and/or modified sequence opt1 from Apolizumab_LightChain1
  source 1..642: mol_type = other RNA
gacatccagatgacccagagcccctccagcctgtccgccagcgtgggcgaccgggtcaccatcacgtgccgggcctccgagaacatctacagctacctcgcgtggtaccagcagaagccggggaaggcccccaagctgctggtgtccaacgccaagaccctcgccgagggcgtgcccagccgcttctccgggagcggctccgggaagcagttcaccctgaccatcagctccctgcagcccgaggacttcgccacgtactactgccagcaccactacggcaacagctacccgttcggccaggggaccaagctcgagatcaagcggaccgtcgcggccccctccgtgttcatcttcccgcccagcgacgagcagctgaagtccggcaccgccagcgtggtctgcctgctcaacaacttctacccccgcgaggccaaggtgcagtggaaggtggacaacgcgctgcagtccgggaacagccaggagagcgtcacggagcaggactccaaggacagcacctactccctgagctccaccctcaccctgagcaaggccgactacgagaagcacaaggtgtacgcctgcgaggtgacgcaccagggcctgtccagccccgtcaccaagtccttcaaccgcggggagtgc

SEQ ID NO: 7687 - RNA, 378 nt, synthetic construct
  misc_feature 1..378: note = derived and/or modified sequence opt1 from Apomab_HeavyChain
  source 1..378: mol_type = other RNA
gaggtgcagctggtccagagcggcgggggcgtggagcgccccgggggctccctccggctgagctgcgccgcctccgggttcaccttcgacgactacgcgatgtgggtgcgccaggccccgggcaagggcctggagtgggtcagcgggatcaactggcagggcgggtccaccggctacgccgacagcgtgaaggggcgggtgacgatctcccgcgacaacgccaagaacagcctctacctgcagatgaactccctgcgggccgaggacaccgcggtctactactgcgccaagatcctcggcgccggccgcgggtggtacttcgactactggggcaaggggaccaccgtgacggtgagctccgccagcaccaagggcccc

SEQ ID NO: 7688 - RNA, 324 nt, synthetic construct
  misc_feature 1..324: note = derived and/or modified sequence opt1 from Apomab_LightChain
  source 1..324: mol_type = other RNA
agcgagctgacccaggaccccgccgtgtccgtcgccctcggccagaccgtgcgcatcacgtgcagcggggactccctgcggagctactacgcgtcctggtaccagcagaagccgggccaggcccccgtgctggtcatctacggggccaacaaccgccccagcggcatccccgaccggttctccgggagctccagcggcaacaccgcctccctcaccatcaccggcgcccaggcggaggacgaggccgactactactgcaacagcgccgactccagcgggaaccacgtggtgttcggcgggggcacgaagctgaccgtcctgggg

SEQ ID NO: 7689 - RNA, 645 nt, synthetic construct
  misc_feature 1..645: note = derived and/or modified sequence opt1 from Aquaporumab_LightChain
  source 1..645: mol_type = other RNA
gagatcgtgctgacccagagccccggcaccctctccctgagcccgggggagcgcgccacgctgtcctgccgggccagccagaccgtccgcaccaactacctcgcgtggttccagcagaagcccggccaggcgccccggctgctgatcttcggggcctccagccgcgccaccggcatccccgaccggttctccgggagcggctccggcacggacttcaccctcaccatcagccgcctggagccggaggacttcgccgtgtactactgccagcagtacgggtccagcccctggaccttcggccaggggacgaaggtggagatcaagcggaccgtcgccgccccctccgtgttcatcttcccgcccagcgacgagcagctgaagtccggcaccgccagcgtggtctgcctcctgaacaacttctacccccgcgaggccaaggtgcagtggaaggtggacaacgcgctgcagtccgggaacagccaggagtccgtcaccgagcaggacagcaaggacagcacgtactccctcagctccaccctgaccctgagcaaggccgactacgagaagcacaaggtgtacgcctgcgaggtgacccaccagggcctctccagccccgtcacgaagtccttcaaccggggcgagtgc

SEQ ID NO: 7690 - RNA, 1326 nt, synthetic construct
  misc_feature 1..1326: note = derived and/or modified sequence opt1 from Arcitumomab_99tc_HeavyChain
  source 1..1326: mol_type = other RNA
gaggtgaagctggtcgagagcggcgggggcctcgtgcagcccgggggctccctgcgcctgagctgcgccacctccgggttcaccttcacggactactacatgaactgggtgcggcagccgcccggcaaggccctcgagtggctgggcttcatcgggaacaaggccaacggctacaccaccgagtacagcgcctccgtcaaggggcgcttcaccatcagccgggacaagtcccagagcatcctgtacctccagatgaacacgctgcgcgccgaggactccgccacctactactgcacccgggaccgcggcctgcggttctacttcgactactgggggcagggcaccacgctcaccgtgagctccgccaagaccaccccgcccagcgtgtaccccctggcgcccggctccgccgcccagacgaacagcatggtcaccctggggtgcctcgtgaagggctacttccccgagcccgtgaccgtcacctggaactccgggagcctgtccagcggcgtgcacacgttcccggccgtgctgcagtccgacctctacaccctgagcagctccgtcaccgtgcccagcagcccccgccccagcgagaccgtgacgtgcaacgtcgcgcacccggcctccagcaccaaggtggacaagaagatcgtgccccgggactgcccgccctgcaagtgccccgcccccaacctgctcggcgggccctccgtcttcatcttcccgcccaagatcaaggacgtgctgatgatcagcctgtcccccatcgtgacctgcgtcgtggtggacgtcagcgaggacgaccccgacgtgcagatctcctggttcgtcaacaacgtggaggtgcacaccgcccagacgcagacccaccgcgaggactacaacagcaccctccgggtcgtgtccgccctgcccatccagcaccaggactggatgagcggcaaggagttcaagtgcaaggtgaacaacaaggacctgccggcgcccatcgagcgcaccatctccaagcccaaggggagcgtccgggcgccccaggtgtacgtgctcccgccgcccgaggaggagatgacgaagaagcaggtcaccctgacctgcatggtgaccgacttcatgcccgaggacatctacgtggagtggacgaacaacggcaagaccgagctgaactacaagaacaccgagcccgtcctcgactccgacgggagctacttcatgtactccaagctgcgcgtggagaagaagaactgggtggagcggaacagctacagctgctccgtcgtgcacgagggcctgcacaaccaccacaccacgaagtccttctcccgc

SEQ ID NO: 7691 - RNA, 639 nt, synthetic construct
  misc_feature 1..639: note = derived and/or modified sequence opt1 from Arcitumomab_99tc_LightChain
  source 1..639: mol_type = other RNA
cagaccgtgctgagccagtcccccgccatcctcagcgcctccccgggcgagaaggtcaccatgacgtgccgcgcgagctccagcgtgacctacatccactggtaccagcagaagcccgggtccagccccaagtcctggatctacgccaccagcaacctggcctccggcgtgcccgcccggttcagcgggtccggcagcgggacctcctacagcctgacgatctcccgcgtcgaggccgaggacgcggccacctactactgccagcactggagctccaagccgcccaccttcggcggcgggaccaagctcgagatcaagcgggccgacgccgcgcccacggtgagcatcttcccgcccagctccgagcagctgaccagcggcggggcctccgtggtctgcttcctgaacaacttctaccccaaggacatcaacgtgaagtggaagatcgacggcagcgagcgccagaacggggtgctcaactcctggaccgaccaggacagcaaggactccacctacagcatgtccagcacgctgaccctgaccaaggacgagtacgagcggcacaactcctacacgtgcgaggccacccacaagaccagcacctcccccatcgtcaagagcttcaaccgcaacgagtgc

SEQ ID NO: 7692 - RNA, 1329 nt, synthetic construct
  misc_feature 1..1329: note = derived and/or modified sequence opt1 from Ascrinvacumab_HeavyChain1
  source 1..1329: mol_type = other RNA
caggtgcagctgcaggagagcggccccgggctcgtcaagccgtcccagaccctgagcctgacctgcacggtgtccggcgggagcatctccagcggcgagtactactggaactggatccgccagcaccccgggaagggcctcgagtggatcggctacatctactactccgggagcacctactacaacccctccctcaagagccgggtgaccatctccgtcgacaccagcaagaaccagttctccctgaagctcagctccgtgacggccgccgacaccgcggtgtactactgcgcccgcgagagcgtcgccggcttcgactactgggggcagggcaccctggtgaccgtgtccagcgcctccacgaaggggcccagcgtcttcccgctggccccctgcagccggtccaccagcgagtccaccgcggccctcggctgcctggtgaaggactacttccccgagcccgtgaccgtcagctggaactccggcgccctgacgagcggggtgcacaccttcccggccgtgctccagtccagcggcctgtactccctgagctccgtcgtgaccgtgcccagctccaacttcgggacccagacgtacacgtgcaacgtcgaccacaagcccagcaacaccaaggtggacaagaccgtggagcgcaagtgctgcgtcgagtgcccgccctgccccgcgccgcccgtggccggcccctccgtgttcctcttcccgcccaagcccaaggacaccctgatgatcagccggacccccgaggtgacctgcgtcgtcgtggacgtgtcccacgaggaccccgaggtccagttcaactggtacgtggacggcgtggaggtccacaacgccaagaccaagccccgcgaggagcagttcaacagcacgttccgggtggtgtccgtcctgaccgtggtgcaccaggactggctcaacgggaaggagtacaagtgcaaggtcagcaacaagggcctgcccgccccgatcgagaagaccatcagcaagaccaaggggcagccccgcgagccccaggtgtacacgctgcccccgtcccgggaggagatgaccaagaaccaggtgagcctgacctgcctggtcaagggcttctacccctccgacatcgccgtggagtgggagagcaacgggcagcccgagaacaactacaagaccacgccgcccatgctggactccgacggcagcttcttcctctactccaagctgaccgtggacaagagccgctggcagcagggcaacgtcttctcctgcagcgtgatgcacgaggcgctgcacaaccactacacccagaagtccctcagcctgtcccccggg

SEQ ID NO: 7693 - RNA, 645 nt, synthetic construct
  misc_feature 1..645: note = derived and/or modified sequence opt1 from Ascrinvacumab_LightChain1
  source 1..645: mol_type = other RNA
gagatcgtgctgacccagagccccggcaccctctccctgagcccgggggagcgcgccacgctgtcctgccgggccagccagtccgtcagctccagctacctcgcgtggtaccagcagaagcccggccaggcgccccgcctgctgatctacgggacctccagccgggccaccggcatccccgaccgcttctccgggagcggctccggcaccgacttcacgctcaccatcagccggctggagccggaggacttcgccgtgtactactgccagcagtacgggtccagccccatcaccttcggccaggggacccgcctggagatcaagcggacggtggccgccccctccgtcttcatcttcccgcccagcgacgagcagctcaagtccggcaccgccagcgtggtgtgcctgctgaacaacttctacccccgcgaggccaaggtccagtggaaggtggacaacgccctccagagcgggaactcccaggagagcgtgaccgagcaggactccaaggacagcacctactccctgagctccacgctgaccctcagcaaggcggactacgagaagcacaaggtctacgcctgcgaggtgacccaccagggcctgtccagccccgtgaccaagtccttcaaccggggcgagtgc

SEQ ID NO: 7694 - RNA, 1314 nt, synthetic construct
  misc_feature 1..1314: note = derived and/or modified sequence opt1 from Aselizuab_HeavyChain1
  source 1..1314: mol_type = other RNA
gaggtgcagctggtcgagagcggcgggggcctcgtgcagcccgggggctccctgcgcctgagctgcgccgcctccgggttcaccttcagcacctacgcgtcctgggtgcggcaggcccccggcaagggcctcgagtgggtcgccagcatctccaccgggggcagcacctactaccccgactccgtgaaggggcgcttcaccatcagccgggacaacgccaagaacaccctgtacctgcagaactccctccgcgccgaggacacggcggtgtactactgcgcccgggactacgacggctacttcgactactgggggcagggcaccctggtcaccgtgagctccgccagcaccaagggcccctccgtgttccccctggccccgtgcagccgctccacgagcgagtccaccgcggccctcgggtgcctggtcaaggactacttccccgagcccgtgaccgtgagctggaacagcggcgccctgacctccggggtccacacgttccccgccgtgctccagagctccggcctgtacagcctgtccagcgtggtcaccgtgccgtccagctccctcggcaccaagacctacacgtgcaacgtggaccacaagcccagcaacaccaaggtcgacaagcgggtggagtccaagtacgggccgccctgccccagctgccccgcccccgagttcctgggcgggccctccgtgttcctgttcccgcccaagcccaaggacaccctcatcagccgcacccccgaggtcacgtgcgtggtggtcgacgtgtcccaggaggacccggaggtccagttcaactggtacgtggacggcgtggaggtccacaacgcgaagaccaagccccgggaggagcagttcaacagcacctaccgcgtggtgtccgtcctgaccgtgctgcaccaggactggctcaacgggaaggagtacaagtgcaaggtgagcaacaagggcctgccctccagcatcgagaagacgatcagcaaggccaagggccagccccgggagccgcaggtctacaccctgccgccctcccaggaggagaccaagaaccaggtgagcctcacgtgcctggtgaaggggttctacccctccgacatcgccgtcgagtgggagagcaacggccagcccgagaacaactacaagacgaccccgcccgtgctggactccgacgggagcttcttcctctactcccgcctgaccgtggacaagagccggtggcaggagggcaacgtcttctcctgcagcgtgcacgaggccctgcacaaccactacacccagaagtccctcagcctgtccctggggaag

SEQ ID NO: 7695 - RNA, 1311 nt, synthetic construct
  misc_feature 1..1311: note = derived and/or modified sequence opt1 from Aselizuab_HeavyChain2
  source 1..1311: mol_type = other RNA
gaggtgcagctggtcgagagcggcgggggcctcgtgcagcccgggggctccctgcgcctgagctgcgccgcctccgggttcaccttcagcacctacgcgtcctgggtgcggcaggcccccggcaagggcctcgagtgggtcgccagcatctccaccgggggcagcacgtactaccccgactccgtgaaggggcgcttcaccatcagccgggacaacgccaagaacaccctgtacctgcagaactccctccgcgccgaggacacggcggtgtactactgcgcccgggactacgacggctacttcgactactgggggcagggcaccctggtcaccgtgagctccgccagcaccaagggcccctccgtgttccccctggccccgtgcagccgctccacgagcgagtccaccgcggccctcgggtgcctggtcaaggactacttccccgagcccgtgaccgtgagctggaacagcggcgccctgacctccggggtccacacgttccccgccgtgctccagagctccggcctgtacagcctgtccagcgtggtcaccgtgccgtccagctccctcggcaccaagacctacacgtgcaacgtggaccacaagcccagcaacaccaaggtcgacaagcgggtggagtccaagtacgggccgccctgccccagctgccccgcccccgagttcctgggcgggccctccgtgttcctgttcccgcccaagcccaaggacaccatcagccgcacccccgaggtcacgtgcgtggtggtcgacgtgtcccaggaggacccggaggtccagttcaactggtacgtggacggcgtggaggtccacaacgcgaagaccaagccccgggaggagcagttcaacagcacctaccgcgtggtgtccgtcctcaccgtgctgcaccaggactggctgaacgggaaggagtacaagtgcaaggtgagcaacaagggcctcccctccagcatcgagaagacgatcagcaaggccaagggccagccccgggagccgcaggtctacaccctgccgccctcccaggaggagaccaagaaccaggtgagcctgacctgcctcgtgaaggggttctacccctccgacatcgccgtcgagtgggagagcaacggccagcccgagaacaactacaagacgaccccgcccgtgctggactccgacgggagcttcttcctgtactcccgcctcaccgtggacaagagccggtggcaggagggcaacgtcttctcctgcagcgtgcacgaggccctgcacaaccactacacccagaagtccctgagcctctccctggggaag

SEQ ID NO: 7696 - RNA, 648 nt, synthetic construct
  misc_feature 1..648: note = derived and/or modified sequence opt1 from Aselizuab_LightChain1
  source 1..648: mol_type = other RNA
gacatccagacccagagcccctccagcctgtccgccagcgtgggcgaccgcgtcaccatcacgtgcaaggcctcccagagcgtggactacgacggggactcctacaactggtaccagcagaagccgggcaaggcgcccaagctcctgatctacgccgccagcaacctggagtccgggatccccagccggttctccggcagcgggtccggcaccgacttcaccctcaccatcagctccctgcagcccgaggacttcgccacgtactactgccagcagagcaacgaggacccgtggaccttcggccaggggaccaaggtggagatcaagcgcaccgtcgccgcgccctccgtgttcatcttcccgcccagcgacgagcagctgaagtccggcacggccagcgtggtctgcctcctgaacaacttctacccccgggaggccaaggtgcagtggaaggtggacaacgccctgcagagcgggaactcccaggagagcgtcaccgagcaggactccaaggacagcacctactccctcagctccaccctgacgctgagcaaggcggactacgagaagcacaaggtgtacgcctgcgaggtgacccaccagggcctctccagccccgtcaccaagtccttcaaccgcggggagtgc

SEQ ID NO: 7697 - RNA, 1344 nt, synthetic construct
  misc_feature 1..1344: note = derived and/or modified sequence opt1 from Atezolizumab_HeavyChain1
  source 1..1344: mol_type = other RNA
gaggtgcagctggtcgagagcggcgggggcctcgtgcagcccgggggctccctgcgcctgagctgcgccgcctccgggttcaccttcagcgactcctggatccactgggtgcggcaggcgccgggcaagggcctcgagtgggtcgcctggatcagcccctacgggggctccacctactacgccgacagcgtgaaggggcgcttcacgatctccgccgacaccagcaagaacaccgcctacctgcagatgaactccctgcgggcggaggacaccgccgtgtactactgcgcccgccggcactggcccggcgggttcgactactggggccagggcacgctcgtcaccgtgagctccgccagcaccaaggggccctccgtgttcccgctggcgcccagctccaagagcacctccggcgggacggccgccctgggctgcctcgtcaaggactacttccccgagcccgtgaccgtgagctggaacagcggcgccctgacctccggggtccacaccttcccggccgtgctgcagagctccggcctctacagcctgtccagcgtggtcacggtgccctccagctccctggggacccagacctacatctgcaacgtgaaccacaagcccagcaacaccaaggtcgacaagaaggtggagcccaagtcctgcgacaagacgcacacgtgcccgccctgccccgcgcccgagctcctgggcgggccgagcgtgttcctgttcccgcccaagcccaaggacaccctcatgatctcccgcacccccgaggtgacctgcgtcgtggtcgacgtgagccacgaggaccccgaggtcaagttcaactggtacgtggacggcgtggaggtccacaacgccaagaccaagccccgggaggagcagtacgcctccacctaccgcgtggtgagcgtcctgaccgtgctgcaccaggactggctcaacggcaaggagtacaagtgcaaggtgtccaacaaggccctgcccgccccgatcgagaagacgatcagcaaggcgaaggggcagccccgggagccccaggtctacaccctgcccccgtcccgcgaggagatgaccaagaaccaggtgagcctgacctgcctcgtgaagggcttctaccccagcgacatcgccgtcgagtgggagtccaacgggcagcccgagaacaactacaagacgaccccgcccgtgctggacagcgacggctccttcttcctctacagcaagctgaccgtggacaagtcccggtggcagcaggggaacgtcttcagctgctccgtgatgcacgaggccctgcacaaccactacacccagaagtccctcagcctgagccccggcaag

SEQ ID NO: 7698 - RNA, 642 nt, synthetic construct
  misc_feature 1..642: note = derived and/or modified sequence opt1 from Atezolizumab_LightChain1
  source 1..642: mol_type = other RNA
gacatccagatgacccagagcccctccagcctgtccgccagcgtgggcgaccgcgtcaccatcacgtgccgggcctcccaggacgtgagcaccgcggtggcctggtaccagcagaagccggggaaggcccccaagctcctgatctactccgccagcttcctgtactccggcgtccccagccgcttctccgggagcggctccgggaccgacttcaccctcacgatcagctccctgcagcccgaggacttcgccacctactactgccagcagtacctgtaccacccggcgaccttcggccagggcaccaaggtggagatcaagcggacggtggccgcccccagcgtcttcatcttcccgccctccgacgagcagctcaagagcgggaccgcctccgtggtgtgcctgctgaacaacttctacccccgcgaggcgaaggtccagtggaaggtggacaacgccctccagagcggcaacagccaggagtccgtgaccgagcaggacagcaaggactccacctacagcctgtccagcacgctgaccctctccaaggccgactacgagaagcacaaggtctacgcctgcgaggtgacccaccaggggctgagctcccccgtgaccaagagcttcaaccggggcgagtgc

SEQ ID NO: 7699 - RNA, 1323 nt, synthetic construct
  misc_feature 1..1323: note = derived and/or modified sequence opt1 from Atinumab_HeavyChain1
  source 1..1323: mol_type = other RNA
gaggtgcagctggtcgagagcggcgggggcctcgtgcagcccgggggctccctgcgcctgagctgcgccgcctccgggttcaccttcagcaactactggatgtcctgggtgcggcaggcgccgggcaagggcctcgagtgggtcgccaccatcaagcaggacgggagccagaagaactacgtggactccgtgaagggccgcttcacgatcagccgggacaacgccaagaactccctgtacctgcgcctcaacagcctgcgggccgaggacaccgccgtctactactgcgcgaccgagctgttcgacctctgggggcgcggctccctggtgaccgtgagctccgccagcacgaaggggccctccgtcttccccctggccccctgcagccggtccaccagcgagtccaccgccgcgctcggctgcctggtgaaggactacttcccggagcccgtgaccgtcagctggaacagcggcgccctgacgtccggggtgcacaccttccccgccgtgctccagagctccggcctgtacagcctgtccagcgtcgtgaccgtgccctccagctccctcgggaccaagacgtacacgtgcaacgtcgaccacaagccgagcaacaccaaggtggacaagcgcgtggagtccaagtacggcccgccctgccccagctgccccgcccccgagttcctgggcgggccctccgtcttcctgttcccgcccaagcccaaggacaccctcatgatcagccggacccccgaggtgacctgcgtggtcgtggacgtctcccaggaggaccccgaggtgcagttcaactggtacgtggacggcgtcgaggtgcacaacgccaagaccaagccgcgcgaggagcagttcaacagcacctaccgggtggtctccgtgctgacggtgctgcaccaggactggctcaacgggaaggagtacaagtgcaaggtcagcaacaagggcctgccctccagcatcgagaagaccatcagcaaggcgaaggggcagccccgcgagccccaggtgtacaccctgccgccctcccaggaggagatgaccaagaaccaggtgagcctcacgtgcctggtcaagggcttctacccctccgacatcgccgtggagtgggagagcaacggccagcccgagaacaactacaagaccaccccgcccgtgctggactccgacgggagcttcttcctctactcccggctgaccgtcgacaagagccgctggcaggagggcaacgtgttctcctgcagcgtgatgcacgaggccctgcacaaccactacacgcagaagtccctcagcctgtccctggggaag

SEQ ID NO: 7700 - RNA, 642 nt, synthetic construct
  misc_feature 1..642: note = derived and/or modified sequence opt1 from Atinumab_LightChain1
  source 1..642: mol_type = other RNA
gagatcgtgctgacccagagccccgccaccctctccctgagcccgggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggcccatcaccttcggccagggcaccaagctggagatcaagcgcaccgtggccgccccctccgtcttcatcttcccgcccagcgacgagcagctcaagtccgggacggcgagcgtggtgtgcctgctgaacaacttctacccccgggaggccaaggtccagtggaaggtggacaacgccctccagtccggcaacagccaggagagcgtgaccgagcaggactccaaggacagcacctactccctgagctccaccctgacgctcagcaaggccgactacgagaagcacaaggtctacgcctgcgaggtgacccaccaggggctgtccagccccgtgaccaagtccttcaaccgcggcgagtgc

SEQ ID NO: 7701 - RNA, 1329 nt, synthetic construct
  misc_feature 1..1329: note = derived and/or modified sequence opt1 from Atlizuab_HeavyChain1
  source 1..1329: mol_type = other RNA
gtgcagctgcaggagagcggccccgggctcgtccgcccctcccagaccctgagcctgacctgcacggtgtccggctacagcatcacctccgaccacgcctggagctgggtgcggcagccgcccgggcgcggcctcgagtggatcgggtacatctcctacagcggcatcaccacctacaacccctccctcaagagccgggtcacgctgcgcgacacctccaagaaccagttcagcctgcggctgtccagcgtgaccgccgcggacaccgccgtgtactactgcgcccgctccctggcccggacgaccgccgactactggggccaggggagcctcgtcaccgtgtccagcgcgtccaccaagggcccgagcgtgttccccctggcccccagctccaagagcacgtccgggggcaccgccgccctggggtgcctcgtcaaggactacttccccgagccggtgaccgtgagctggaactccggcgcgctgaccagcggcgtccacacgttccccgccgtgctgcagtccagcgggctctactccctgagctccgtggtcaccgtgcccagctccagcctgggcacccagacctacatctgcaacgtgaaccacaagccctccaacacgaaggtcgacaagaaggtggagcccaagagctgcgacaagacccacacgtgcccgccctgccccgcccccgagctcctcgggggcccctccgtgttcctgttcccgcccaagcccaaggacaccctgatcagccgcacccccgaggtgacctgcgtcgtggtcgacgtgtcccacgaggaccccgaggtcaagttcaactggtacgtggacggcgtggaggtccacaacgccaagaccaagccccgggaggagcagtacaacagcacctaccgcgtggtgagcgtcctgacggtgctgcaccaggactggctcaacgggaaggagtacaagtgcaaggtgtccaacaaggccctgccggcgcccatcgagaagaccatcagcaaggccaagggccagccccgggagccccaggtctacaccctgccgccctcccgcgacgagctcaccaagaaccaggtgagcctgacgtgcctggtgaaggggttctacccctccgacatcgccgtcgagtgggagagcaacggccagccggagaacaactacaagaccaccccgcccgtgctcgactccgacgggagcttcttcctgtactccaagctgaccgtggacaagagccggtggcagcagggcaacgtcttctcctgcagcgtgcacgaggccctccacaaccactacacgcagaagtccctgagcctgtcccccggc

SEQ ID NO: 7702 - RNA, 639 nt, synthetic construct
  misc_feature 1..639: note = derived and/or modified sequence opt1 from Atlizuab_LightChain1
  source 1..639: mol_type = other RNA
gacatccagacgcagagcccctccagcctgtccgccagcgtgggcgaccgcgtcaccatcacgtgccgggcctcccaggacatcagctcctacctcaactggtaccagcagaagccggggaaggcgcccaagctgctgatctactacaccagccgcctccactccggcgtgcccagccggttctccgggagcggctccgggaccgacttcaccttcacgatcagctccctgcagcccgaggacatcgccacctactactgccagcagggcaacaccctgccgtacaccttcggccaggggacgaaggtggagatcaagcgcaccgtcgccgcccccagcgtgttcatcttcccgccctccgacgagcagctcaagagcggcaccgcctccgtggtctgcctgctgaacaacttctacccccgggaggcgaaggtgcagtggaaggtggacaacgccctccagagcgggaacagccaggagtccgtcaccgagcaggacagcaaggactccacgtacagcctgtccagcaccctgaccctctccaaggccgactacgagaagcacaaggtgtacgcctgcgaggtgacccaccagggcctgagctcccccgtcaccaagagcttcaaccgcggggagtgc

SEQ ID NO: 7703 - RNA, 792 nt, synthetic construct
  misc_feature 1..792: note = derived and/or modified sequence opt1 from Aurograb_SingleChain
  source 1..792: mol_type = other RNA
atggccaaggtgcagctgctccagagcgccaccgaggtcaagaagcccggcgcgtccgtgaaggtgagctgcaaggcctacgggtacaccttcacggactacggcatcacctgggtccgccaggccccggggcagggcctggagtggatggggtggatctccgcctacaacggctacaccaactacgcccagaagttccaggaccggatcaccatgacgaccgacgcgagcacctccaccgcctacatggagctgcgcagcctccggcccgacgacacggccgtgctgtactgcgcccgcgaccgggaggacgcgtccctgctccgcgacggccactgggggcagggcaccctggtgaccgtcagctccgggggcgggggcagcggcgggggcgggtccggcggcgggggcagcgggggcgggggctccgagaccacgctgacccagagccccggcaccctctccctgagccccggggagcgggccaccctgtcctgccgcgccagccagatcgtgtccagcagctacctcgcctggtaccagcagaagccgggccaggcgccccggctgctgatctacggggcctccagccgcgccacgggcatccccgaccggttctccgggagcggctccggcaccgacttcaccctcaccatcagcaagctggagcccgaggacttcgccgtgtactactgccagcactacgggtccagctccccgtggacgagccgcccccgggaccagtccgacatcaagcgcgccgccgcgctggagcaccaccaccaccaccac

SEQ ID NO: 7704 - RNA, 1350 nt, synthetic construct
  misc_feature 1..1350: note = derived and/or modified sequence opt1 from Avelumab_HeavyChain1
  source 1..1350: mol_type = other RNA
gaggtgcagctgctcgagagcggcgggggcctggtccagcccgggggctccctgcgcctcagctgcgccgcctccgggttcaccttcagctcctacatcatgatgtgggtgcggcaggcgccgggcaagggcctggagtgggtgagctccatctaccccagcgggggcatcaccttctacgccgacacggtcaaggggcgcttcaccatctcccgggacaacagcaagaacaccctgtacctccagatgaactccctgcgcgccgaggacaccgccgtgtactactgcgcccggatcaagctgggcacggtgaccaccgtcgactactgggggcagggcaccctcgtgacggtgagctccgcgagcaccaagggcccctccgtcttccccctggccccgagctccaagagcacctccgggggcaccgccgccctggggtgcctcgtgaaggactacttccccgagcccgtgacggtcagctggaacagcggcgcgctgacctccggcgtgcacaccttccccgccgtgctgcagagctccgggctctacagcctgtccagcgtcgtgaccgtgccgtccagctccctgggcacgcagacctacatctgcaacgtcaaccacaagcccagcaacaccaaggtggacaagaaggtggagcccaagtcctgcgacaagacccacacgtgcccgccctgccccgcccccgagctcctcgggggccccagcgtcttcctgttcccgcccaagcccaaggacaccctgatgatctcccgcacccccgaggtgacctgcgtggtcgtggacgtcagccacgaggacccggaggtgaagttcaactggtacgtggacggggtcgaggtgcacaacgccaagacgaagccccgggaggagcagtacaactccacctaccgcgtggtcagcgtgctgaccgtgctgcaccaggactggctcaacggcaaggagtacaagtgcaaggtctccaacaaggccctgcccgcgcccatcgagaagaccatcagcaaggccaagggccagccgcgggagccccaggtgtacacgctgccgccctcccgcgacgagctcaccaagaaccaggtgagcctgacctgcctggtcaaggggttctaccccagcgacatcgccgtggagtgggagtccaacggccagcccgagaacaactacaagaccacgcccccggtgctcgacagcgacgggtccttcttcctgtacagcaagctgaccgtcgacaagtcccggtggcagcagggcaacgtgttcagctgctccgtgatgcacgaggccctccacaaccactacacccagaagtccctgagcctgagccccgggaag

SEQ ID NO: 7705 - RNA, 648 nt, synthetic construct
  misc_feature 1..648: note = derived and/or modified sequence opt1 from Avelumab_LightChain1
  source 1..648: mol_type = other RNA
cagagcgccctgacccagcccgcctccgtgagcggctccccggggcagagcatcaccatctcctgcacgggcaccagctccgacgtcgggggctacaactacgtgagctggtaccagcagcaccccgggaaggcgcccaagctcatgatctacgacgtgtccaaccgccccagcggcgtctccaaccggttcagcggctccaagagcgggaacaccgcctccctgaccatcagcggcctgcaggccgaggacgaggccgactactactgctccagctacacgtccagcagcacccgcgtgttcgggaccggcaccaaggtgacggtcctcgggcagccgaaggccaaccccaccgtgaccctgttcccgccctccagcgaggagctgcaggcgaacaaggccaccctcgtgtgcctgatctccgacttctaccccggcgccgtcacggtggcctggaaggcggacggcagccccgtgaaggccggggtcgagaccaccaagccctccaagcagagcaacaacaagtacgccgcctccagctacctgtccctcacccccgagcagtggaagtcccaccggagctacagctgccaggtgacgcacgagggctccaccgtggagaagaccgtcgccccgaccgagtgcagc

SEQ ID NO: 7706 - RNA, 1344 nt, synthetic construct
  misc_feature 1..1344: note = derived and/or modified sequence opt1 from Bapineuzumab_HeavyChain1
  source 1..1344: mol_type = other RNA
gaggtgcagctgctcgagagcggcgggggcctggtccagcccgggggctccctgcgcctcagctgcgccgcctccgggttcaccttcagcaactacggcatgtcctgggtgcggcaggcgccgggcaaggggctggagtgggtggccagcatccgctccggcgggggccggacctactacagcgacaacgtcaaggggcgcttcacgatctcccgggacaacagcaagaacaccctgtacctccagatgaactccctgcgcgccgaggacaccgccgtgtactactgcgtgcggtacgaccactacagcggctccagcgactactggggccaggggaccctggtcacggtgtccagcgcctccaccaagggccccagcgtgttccccctcgcgccctccagcaagagcacctccgggggcaccgccgccctgggctgcctggtcaaggactacttcccggagcccgtgacggtgagctggaactccggggccctcaccagcggcgtccacaccttccccgcggtgctgcagtccagcgggctgtactccctcagctccgtggtcaccgtgcccagctccagcctgggcacgcagacctacatctgcaacgtgaaccacaagccgtccaacaccaaggtcgacaagaaggtggagcccaagagctgcgacaagacccacacgtgcccgccctgccccgcccccgagctgctcgggggcccctccgtgttcctgttcccgcccaagcccaaggacaccctgatgatcagccgcacccccgaggtgacctgcgtcgtggtcgacgtgtcccacgaggaccccgaggtcaagttcaactggtacgtggacggcgtggaggtccacaacgccaagacgaagccgcgggaggagcagtacaacagcacctaccgcgtggtgtccgtcctcaccgtgctgcaccaggactggctgaacgggaaggagtacaagtgcaaggtgagcaacaaggccctccccgcccccatcgagaagaccatcagcaaggcgaagggccagccccgggagccgcaggtctacacgctgccgccctcccgcgaggagatgaccaagaaccaggtgagcctgacctgcctcgtgaaggggttctacccctccgacatcgccgtcgagtgggagagcaacggccagcccgagaacaactacaagaccacgccgcccgtgctggactccgacgggagcttcttcctgtactccaagctcaccgtggacaagagccggtggcagcagggcaacgtcttctcctgcagcgtgatgcacgaggccctgcacaaccactacacccagaagtccctgagcctctcccccggc

SEQ ID NO: 7707 - RNA, 657 nt, synthetic construct
  misc_feature 1..657: note = derived and/or modified sequence opt1 from Bapineuzumab_LightChain1
  source 1..657: mol_type = other RNA
gacgtggtcatgacccagagccccctgtccctcccggtgacccccggcgagcccgccagcatctcctgcaagagctcccagagcctgctggactccgacgggaagacgtacctcaactggctgctgcagaagcccggccagagcccgcagcgcctcatctacctggtgtccaagctggacagcggggtccccgaccggttctccggcagcgggtccggcaccgacttcaccctcaagatcagccgcgtggaggccgaggacgtgggcgtctactactgctggcaggggacccacttcccccggacgttcggccaggggaccaaggtggagatcaagcgcaccgtggcggccccctccgtcttcatcttcccgcccagcgacgagcagctgaagtccggcaccgccagcgtggtgtgcctgctcaacaacttctacccccgggaggccaaggtccagtggaaggtggacaacgccctgcagtccgggaacagccaggagagcgtgacggagcaggactccaaggacagcacctactccctgagctccaccctcaccctgagcaaggcggactacgagaagcacaaggtctacgcctgcgaggtgacgcaccagggcctgtccagccccgtgaccaagtccttcaaccgcggcgagtgc

SEQ ID NO: 7708 - RNA, 1338 nt, synthetic construct
  misc_feature 1..1338: note = derived and/or modified sequence opt1 from Basiliximab_HeavyChain
  source 1..1338: mol_type = other RNA
cagctgcagcagagcggcaccgtgctcgcccgccccggggcctccgtcaagatgagctgcaaggcgtccggctacagcttcacccggtactggatgcactggatcaagcagcgcccggggcagggcctggagtggatcggggccatctaccccggcaactccgacacgagctacaaccagaagttcgagggcaaggccaagctgaccgccgtgacctccgccagcaccgcgtacatggagctctccagcctgacgcacgaggactccgccgtgtactactgcagccgggactacgggtactacttcgacttctggggccaggggaccaccctgaccgtctccagcgcctccacgaagggccccagcgtgttccccctcgccccgtccagcaagtccaccagcgggggcaccgcggccctgggctgcctggtgaaggactacttccccgagcccgtcaccgtgagctggaactccggggccctcacgagcggcgtgcacaccttccccgccgtcctgcagtccagcgggctgtactccctcagctccgtggtgaccgtcccgagctccagcctgggcacccagacgtacatctgcaacgtgaaccacaagccctccaacaccaaggtggacaagcgcgtcgagccgcccaagagctgcgacaagacccacacgtgcccgccctgccccgcccccgagctgctcggcgggccctccgtgttcctgttcccgcccaagcccaaggacaccctgatgatcagccggacccccgaggtgacctgcgtcgtggtggacgtctcccacgaggaccccgaggtgaagttcaactggtacgtggacggcgtcgaggtgcacaacgcgaagaccaagccccgcgaggagcagtacaacagcacgtaccgggtcgtgtccgtgctcaccgtcctgcaccaggactggctgaacgggaaggagtacaagtgcaaggtgagcaacaaggccctccccgccccgatcgagaagaccatctccaaggccaagggccagccccgcgagccccaggtgtacaccctgcccccgagccgggacgagctgacgaagaaccaggtcagcctgacctgcctcgtgaaggggttctacccctccgacatcgccgtggagtgggagagcaacggccagcccgagaacaactacaagaccaccccgcccgtcctggactccgacggcagcttcttcctctactccaagctgacggtggacaagagccgctggcagcaggggaacgtgttctcctgcagcgtcatgcacgaggcgctgcacaaccactacacccagaagtccctcagcctgtcccccggcaag

SEQ ID NO: 7709 - RNA, 630 nt, synthetic construct
  misc_feature 1..630: note = derived and/or modified sequence opt1 from Basiliximab_LightChain
  source 1..630: mol_type = other RNA
cagatcgtgagcacccagtcccccgccatcatgagcgcctccccgggcgagaaggtcaccatgacgtgcagcgcgtccagctcccgcagctacatgcagtggtaccagcagaagcccgggacctcccccaagcggtggatctacgacaccagcaagctggcctccggcgtgcccgcccgcttcagcgggtccggcagcgggacctcctacagcctcacgatctccagcatggaggccgaggacgccgcgacctactactgccaccagcggtccagctacaccttcggcggcgggaccaagctggagatcaagcgcacggtggccgccccgagcgtcttcatcttcccgccctccgacgagcagctcaagagcggcaccgcctccgtggtgtgcctgctgaacaacttctacccccgggaggcgaaggtccagtggaaggtggacaacgccctgcagagcgggaactcccaggagagcgtgaccgagcaggactccaaggacagcacctactccctcagctccacgctgaccctgagcaaggccgactacgagaagcacaaggtctacgcctgcgaggtgacccaccagggcctctccagccccgtgaccaagtccttcaaccgcggggag

SEQ ID NO: 7710 - RNA, 1350 nt, synthetic construct
  misc_feature 1..1350: note = derived and/or modified sequence opt1 from Bavituximab_HeavyChain
  source 1..1350: mol_type = other RNA
gaggtgcagctgcagcagagcggccccgagctcgagaagccgggggcctccgtcaagctgagctgcaaggcctccggctacagcttcaccgggtacaacatgaactgggtgaagcagtcccacggcaagagcctggagtggatcgggcacatcgacccctactacggcgacacctcctacaaccagaagttccgcggcaaggcgacgctcaccgtggacaagagctccagcaccgcctacatgcagctgaagtccctgaccagcgaggactccgccgtctactactgcgtgaagggcgggtactacgggcactggtacttcgacgtgtggggcgccgggacgaccgtcaccgtgagctccgccagcaccaagggcccctccgtgttccccctcgcgccgagctccaagagcacgagcggcgggaccgccgccctgggctgcctggtcaaggactacttccccgagcccgtgaccgtgtcctggaacagcggggccctcacctccggcgtccacacgttccccgcggtgctgcagagctccggcctgtacagcctctccagcgtggtcaccgtgccgtccagctccctggggacccagacctacatctgcaacgtgaaccacaagcccagcaacacgaaggtcgacaagaaggtggagcccaagtcctgcgacaagacccacacgtgcccgccctgccccgcccccgagctgctcggcgggcccagcgtgttcctgttcccgcccaagcccaaggacaccctgatgatctcccggacccccgaggtgacctgcgtcgtggtcgacgtgagccacgaggacccggaggtcaagttcaactggtacgtggacggcgtggaggtccacaacgccaagaccaagccccgcgaggagcagtacaactccacctaccgggtggtgagcgtcctcacggtgctgcaccaggactggctgaacgggaaggagtacaagtgcaaggtgtccaacaaggccctccccgcccccatcgagaagaccatcagcaaggcgaagggccagccgcgcgagccccaggtctacaccctgccgcccagccgggacgagctgaccaagaaccaggtgtccctcacgtgcctggtgaagggcttctaccccagcgacatcgccgtcgagtgggagtccaacgggcagcccgagaacaactacaagaccacgcccccggtgctggacagcgacggctccttcttcctctacagcaagctgaccgtggacaagtcccgctggcagcaggggaacgtcttcagctgctccgtgatgcacgaggccctgcacaaccactacacccagaagtccctcagcctgagccccggcaag

SEQ ID NO: 7711 - RNA, 642 nt, synthetic construct
  misc_feature 1..642: note = derived and/or modified sequence opt1 from Bavituximab_LightChain
  source 1..642: mol_type = other RNA
gacatccagatgacccagagcccctccagcctgtccgccagcctcggcgagcgggtgtccctgacctgccgggccagccaggacatcgggtccagcctgaactggctccagcagggcccggacgggacgatcaagcgcctgatctacgcgacctccagcctggactccggcgtccccaagcggttcagcgggtcccgcagcggctccgactacagcctcaccatctccagcctggagtccgaggacttcgtggactactactgcctgcagtacgtgagcagcccgcccaccttcggcgccgggacgaagctcgagctgaagcgggccgacgccgccccctccgtcttcatcttcccgcccagcgacgagcagctgaagtccggcaccgcgagcgtggtgtgcctcctgaacaacttctacccccgcgaggccaaggtccagtggaaggtggacaacgccctgcagtccgggaacagccaggagtccgtgaccgagcaggacagcaaggactccacctacagcctctccagcacgctgaccctgtccaaggccgactacgagaagcacaaggtctacgcgtgcgaggtgacccaccagggcctcagctcccccgtgaccaagagcttcaaccgcggggagtgc

SEQ ID NO: 7712 - RNA, 624 nt, synthetic construct
  misc_feature 1..624: note = derived and/or modified sequence opt1 from Bavituximab_LightChain_variant_8734_L
  source 1..624: mol_type = other RNA
gacatccagatgacccagagcccctccagcctgtccgccagcctcggcgagcgggtgtccctgacctgccgggccagccaggacatcgggtccagcctgaactggctccagcagggcccggacgggacgatcaagcgcctgatctacgcgacctccagcctggactccggcgtccccaagcggttcagcgggtcccgcagcggctccgactacagcctcaccatctccagcctggagtccgaggacttcgtggactactactgcctgcagtacgtgagcagcccgcccaccttcggcgccgggacgaagctcgagctgaagcgggccgacgccgccccctccgtcttcatcttcccgcccagcgacgagcagctgaagtccggcaccgcgagcgtggtgtgcctcctgaacaacttctacccccgcgaggccaaggtccagtggaaggtggacaacgccctgcagtccgggaacagccaggagtccgtgaccgagcaggacagcaaggactccacctacagcctctccaaggccgactacgagaagcacaaggtctacgcgtgcgaggtgacgcaccagggcctgagctcccccgtgaccaagagcttcaaccgcggggagtgc

SEQ ID NO: 7713 - RNA, 1368 nt, synthetic construct
  misc_feature 1..1368: note = derived and/or modified sequence opt1 from Begelomab_HeavyChain1
  source 1..1368: mol_type = other RNA
caggtgcagctgcagcagagcggcgccgagctcgtcaagcccggggcctccgtgaagctgagctgcaaggcgtccggctacaccttccgcagctacgacatcaactgggtgcggcagcgcccggagcaggggctggagtggatcggctggatcttccccggggacggctccaccaagtacaacgagaagttcaagggcaaggccacgctcaccaccgacaagagctccagcaccgcctacatgcagctgtcccggctgacgagcgaggactccgccgtctacttctgcgcccgctggaccgtggtggggcccggctacttcgacgtctggggcgcggggaccaccgtgacggtgagctccgccaagaccacgcccccgagcgtctaccccctcgcccccgggtgcggcgacaccaccggctccagcgtgaccctggggtgcctggtgaagggctacttccccgagtccgtcaccgtgacctggaacagcgggtccctcagcagctccgtgcacacgttcccggccctgctgcagagcggcctctacaccatgtccagctccgtcaccgtgcccagctccacctggcccagccagacggtgacctgctccgtcgcgcaccccgccagctccaccaccgtggacaagaagctggagccgagcggccccatctccacgatcaacccctgcccgccctgcaaggagtgccacaagtgccccgcccccaacctggagggcgggcccagcgtgttcatcttcccgcccaacatcaaggacgtcctcatgatctccctgacccccaaggtgacctgcgtggtcgtggacgtcagcgaggacgaccccgacgtgcagatctcctggttcgtgaacaacgtcgaggtgcacaccgcccagacgcagacccaccgggaggactacaacagcaccatccgcgtggtctccaccctgccgatccagcaccaggactggatgagcgggaaggagttcaagtgcaaggtgaacaacaaggacctccccagccccatcgagcggacgatctccaagatcaagggcctggtgcgcgcgccccaggtctacatcctgccgccgcccgccgagcagctcagccggaaggacgtgtccctgacctgcctggtggtcgggttcaaccccggcgacatcagcgtggagtggacctccaacggccacaccgaggagaactacaaggacacggcccccgtgctcgacagcgacgggtcctacttcatctacagcaagctgaacatgaagacctccaagtgggagaagaccgacagcttctcctgcaacgtccgccacgagggcctgaagaactactacctcaagaagaccatcagccggtcccccgggaag

SEQ ID NO: 7714 - RNA, 639 nt, synthetic construct; identical to SEQ ID NO: 7652
  misc_feature 1..639: note = derived and/or modified sequence opt1 from Begelomab_LightChain1
  source 1..639: mol_type = other RNA

SEQ ID NO: 7715 - RNA, 1353 nt, synthetic construct
  misc_feature 1..1353: note = derived and/or modified sequence opt1 from Benralizumab_HeavyChain1
  source 1..1353: mol_type = other RNA
gaggtgcagctggtccagagcggcgccgaggtgaagaagcccggggcctccgtgaaggtcagctgcaaggcgtccggctacaccttcaccagctacgtgatccactgggtgcgccagcggccggggcagggcctcgcctggatggggtacatcaacccctacaacgacggcacgaagtacaacgagcgcttcaagggcaaggtcaccatcacctccgaccggagcacctccacggtgtacatggagctgagctccctgcgcagcgaggacaccgccgtgtacctctgcgggcgggagggcatccgctactacgggctgctgggcgactactgggggcagggcaccctcgtcaccgtgtccagcgcctccacgaagggccccagcgtgttccccctggccccgtccagcaagtccaccagcgggggcaccgcggccctggggtgcctcgtcaaggactacttccccgagcccgtgaccgtgtcctggaacagcggcgccctgacgagcggcgtccacaccttccccgccgtgctgcagtccagcgggctctactccctgagctccgtggtcaccgtgccgagctccagcctgggcacccagacgtacatctgcaacgtgaaccacaagccctccaacaccaaggtcgacaagaaggtggagcccaagagctgcgacaagacccacacgtgcccgccctgccccgcgcccgagctcctcgggggcccctccgtgttcctgttcccgcccaagcccaaggacaccctgatgatcagccggacccccgaggtgacctgcgtcgtcgtggacgtgtcccacgaggacccggaggtcaagttcaactggtacgtggacggggtggaggtccacaacgccaagaccaagccccgcgaggagcagtacaacagcacgtaccgggtggtgtccgtcctgaccgtgctgcaccaggactggctcaacggcaaggagtacaagtgcaaggtgagcaacaaggccctgcccgcccccatcgagaagaccatctccaaggccaagggccagccgcgcgagccccaggtctacaccctgccgcccagccgggacgagctcacgaagaaccaggtgtccctgacctgcctggtgaaggggttctaccccagcgacatcgcggtcgagtgggagagcaacggccagcccgagaacaactacaagaccacgcccccggtgctcgactccgacgggagcttcttcctgtactccaagctgaccgtggacaagagccgctggcagcagggcaacgtcttctcctgcagcgtgatgcacgaggccctccacaaccactacacccagaagtccctgagcctgtcccccgggaag

SEQ ID NO: 7716 - RNA, 642 nt, synthetic construct
  misc_feature 1..642: note = derived and/or modified sequence opt1 from Benralizumab_LightChain1
  source 1..642: mol_type = other RNA
gacatccagatgacccagagcccctccagcctgtccgccagcgtgggcgaccgcgtcaccatcacgtgcgggacctccgaggacatcatcaactacctcaactggtaccagcagaagccgggcaaggcccccaagctgctgatctaccacaccagccggctccagtccggggtgcccagccgcttctccggcagcgggtccggcaccgacttcacgctgaccatcagctccctgcagcccgaggacttcgcgacctactactgccagcagggctacaccctcccgtacacgttcgggcagggcaccaaggtggagatcaagcggaccgtcgccgcccccagcgtgttcatcttcccgccctccgacgagcagctcaagagcgggaccgcctccgtggtctgcctgctgaacaacttctacccccgcgaggccaaggtgcagtggaaggtggacaacgcgctgcagagcggcaactcccaggagagcgtcacggagcaggacagcaaggactccacctacagcctgtccagcaccctcaccctgtccaaggccgactacgagaagcacaaggtgtacgcctgcgaggtgacgcaccaggggctgagctcccccgtcaccaagagcttcaaccggggcgagtgc

SEQ ID NO: 7717 - RNA, 1329 nt, synthetic construct
  misc_feature 1..1329: note = derived and/or modified sequence opt1 from Betalutin_HeavyChain1
  source 1..1329: mol_type = other RNA
gagatccagctgcagcagagcggccccgagctcgtgaagccgggggcctccgtcaaggtgagctgcaaggcctccggctacagcttcaccgactacaacatgtactgggtgaagcagtcccacggcaagagcctggagtggatcgggtacatcgacccctacaacggggacaccacctacaaccagaagttcaagggcaaggcgaccctgaccgtcgacaagtccagctccaccgccttcatccacctcaacagcctgacgtccgaggacagcgccgtgtactactgcgcccgctccccctacggccactacgccatggactactgggggcagggcaccagcgtgaccgtctccagcgcgaagaccacgcccccgtccgtgtaccccctggcccccgggagcgccgcccagaccaactccatggtgaccctcggctgcctggtcaaggggtacttccccgagccggtgaccgtgacgtggaacagcggcagcctgtccagcggcgtccacaccttccccgcggtgctccagtccgacctgtacaccctgagctccagcgtgaccgtcccctccagcacgtggccctccgagaccgtgacctgcaacgtggcccacccggccagctccaccaaggtcgacaagaagatcgtgccccgggactgcgggtgcaagccctgcatctgcacggtgcccgaggtcagctccgtgttcatcttcccgcccaagcccaaggacgtgctcaccatcaccctgacccccaaggtcacgtgcgtggtcgtggacatcagcaaggacgacccggaggtgcagttctcctggttcgtcgacgacgtggaggtgcacaccgcccagacccagccccgcgaggagcagttcaacagcaccttccggtccgtcagcgagctgcccatcatgcaccaggactggctcaacggcaaggagttcaagtgccgcgtgaactccgccgcgttccccgccccgatcgagaagacgatcagcaagaccaaggggcggcccaaggcgccccaggtgtacaccatcccgccgcccaaggagcagatggccaaggacaaggtcagcctgacctgcatgatcacggacttcttccccgaggacatcaccgtggagtggcagtggaacggccagcccgccgagaactacaagaacacccagcccatcatggacaccgacggctcctacttcgtgtacagcaagctgaacgtccagaagtccaactgggaggccgggaacacgttcacgtgcagcgtgctccacgagggcctgcacaaccaccacaccgagaagtccctgagccactcccccgggaag

SEQ ID NO: 7718 - RNA, 642 nt, synthetic construct
  misc_feature 1..642: note = derived and/or modified sequence opt1 from Betalutin_LightChain1
  source 1..642: mol_type = other RNA
gacatcgtgatgacccagagccacaagctgctctccaccagcgtgggcgaccgcgtgtccatcacgtgcaaggccagccaggacgtgtccaccgccgtcgactggtaccagcagaagcccgggcagagcccgaagctgctgatcaactgggcgtccacccggcacaccggcgtgcccgaccgcttcacggggagcggctccgggaccgactacaccctcaccatcagctccatgcaggccgaggacctggccctgtactactgccggcagcactacagcacgcccttcaccttcggctccggcaccaagctcgagatcaagcgcgccgacgccgcgcccaccgtgagcatcttcccgccctccagcgagcagctgacgtccgggggcgccagcgtcgtgtgcttcctgaacaacttctaccccaaggacatcaacgtgaagtggaagatcgacgggtccgagcggcagaacggcgtcctcaacagctggaccgaccaggacagcaaggactccacctacagcatgtccagcaccctgacgctgaccaaggacgagtacgagcgccacaactcctacacgtgcgaggccacccacaagaccagcacctcccccatcgtcaagagcttcaaccggaacgagtgc

SEQ ID NO: 7719 - RNA, 1344 nt, synthetic construct
  misc_feature 1..1344: note = derived and/or modified sequence opt1 from Bevacituzuab_HeavyChain1
  source 1..1344: mol_type = other RNA
gaggtgcagctggtcgagagcggcgggggcctcgtgcagcccgggggctccctgcgcctgagctgcgccgcctccgggtacaccttcaccaactacggcaactgggtgcggcaggcgccgggcaaggggctcgagtgggtcggctggatcaacacgtacaccggggagcccacctacgccgccgacttcaagcgccggttcaccttcagcctggacacgtccaagagcaccgcctacctgcagaactccctccgcgccgaggacaccgcggtgtactactgcgccaagtacccccactactacggcagctcccactggtacttcgacgtgtgggggcagggcaccctggtcacggtgagctccgccagcaccaagggcccctccgtgttcccgctggcccccagctccaagagcacctccgggggcaccgcggccctcgggtgcctggtcaaggactacttccccgagcccgtgacggtgagctggaactccggcgccctgaccagcggcgtccacaccttcccggccgtgctccagagctccgggctgtacagcctgtccagcgtggtcaccgtgccctccagctccctcggcacgcagacctacatctgcaacgtgaaccacaagcccagcaacaccaaggtcgacaagaaggtggagcccaagtcctgcgacaagacccacacgtgcccgccctgccccgcccccgagctgctcgggggcccgagcgtgttcctcttcccgcccaagcccaaggacaccctgatctcccggacccccgaggtgacctgcgtcgtggtcgacgtgagccacgaggaccccgaggtcaagttcaactggtacgtggacggggtggaggtccacaacgcgaagacgaagccccgcgaggagcagtacaactccacctaccgggtggtgagcgtcctgaccgtgctccaccaggactggctgaacggcaaggagtacaagtgcaaggtgtccaacaaggccctgcccgccccgatcgagaagaccatcagcaaggccaagggccagccccgcgagccccaggtctacacgctgcccccgtcccgggaggagaccaagaaccaggtgagcctgacctgcctggtgaaggggttctacccctccgacatcgccgtcgagtgggagagcaacggccagcccgagaacaactacaagaccacgccgcccgtgctcgacagcgacgggtccttcttcctgtacagcaagctgaccgtggacaagtcccgctggcagcagggcaacgtcttcagctgctccgtgcacgaggcgctccacaaccactacacccagaagtccctgagcctgagccccgggaag

SEQ ID NO: 7720 - RNA, 639 nt, synthetic construct
  misc_feature 1..639: note = derived and/or modified sequence opt1 from Bevacituzuab_LightChain1
  source 1..639: mol_type = other RNA
gacatccagacgcagagcccctccagcctgtccgccagcgtgggcgaccgcgtcaccatcacgtgctccgccagccaggacatctccaactacctcaactggtaccagcagaagccggggaaggcgcccaaggtgctgatctacttcaccagctccctgcacagcggcgtgccctcccggttcagcgggtccggcagcgggaccgacttcaccctcacgatctccagcctgcagcccgaggacttcgccacctactactgccagcagtactccaccgtcccgtggaccttcggccagggcacgaaggtggagatcaagcgcaccgtggccgcccccagcgtcttcatcttcccgccctccgacgagcagctcaagagcgggaccgccagcgtggtgtgcctgctgaacaacttctacccccgggaggcgaaggtccagtggaaggtggacaacgccctgcagtccggcaacagccaggagtccgtgaccgagcaggacagcaaggactccacgtacagcctctccagcaccctgaccctgtccaaggccgactacgagaagcacaaggtctacgcctgcgaggtgacccaccaggggctcagctcccccgtgaccaagagcttcaaccgcggcgagtgc

SEQ ID NO: 7721 - RNA, 639 nt, synthetic construct
  misc_feature 1..639: note = derived and/or modified sequence opt1 from Bevacizumab_154-aspartic_acid_LightChain
  source 1..639: mol_type = other RNA
gacatccagatgacgcagagcccctccagcctgtccgccagcgtgggcgaccgcgtcaccatcacgtgctccgccagccaggacatctccaactacctcaactggtaccagcagaagccggggaaggcgcccaaggtgctgatctacttcaccagctccctgcacagcggcgtgccctcccggttcagcgggtccggcagcgggaccgacttcaccctcacgatctccagcctgcagcccgaggacttcgccacctactactgccagcagtactccaccgtcccgtggaccttcggccagggcacgaaggtggagatcaagcgcaccgtggccgcccccagcgtcttcatcttcccgccctccgacgagcagctcaagagcgggaccgccagcgtggtgtgcctgctgaacaacttctacccccgggaggcgaaggtccagtggaaggtggacaacgccgaccagtccggcaacagccaggagtccgtgaccgagcaggacagcaaggactccacgtacagcctgtccagcaccctcaccctgtccaaggccgactacgagaagcacaaggtctacgcctgcgaggtgacccaccaggggctgagctcccccgtgaccaagagcttcaaccgcggcgag

SEQ ID NO: 7722 - RNA, 639 nt, synthetic construct; identical to SEQ ID NO: 7721
  misc_feature 1..639: note = derived and/or modified sequence opt1 from Bevacizumab_154-substitution_deriv_LightChain
  source 1..639: mol_type = other RNA

SEQ ID NO: 7723 - RNA, 672 nt, synthetic construct
  misc_feature 1..672: note = derived and/or modified sequence opt1 from Bevacizumab_180-serine_HeavyChain
  source 1..672: mol_type = other RNA
gaggtgcagctggtcgagagcggcgggggcctcgtgcagcccgggggctccctgcgcctgagctgcgccgcctccgggtacaccttcaccaactacggcatgaactgggtgcggcaggcgccgggcaaggggctcgagtgggtcggctggatcaacacgtacaccggggagcccacctacgccgccgacttcaagcgccggttcaccttcagcctggacacgtccaagagcaccgcctacctgcagatgaactccctccgcgccgaggacaccgcggtgtactactgcgccaagtacccccactactacggcagctcccactggtacttcgacgtgtgggggcagggcaccctggtcacggtgagctccgccagcaccaagggcccctccgtgttcccgctggcccccagctccaagagcacctccgggggcaccgcggccctcgggtgcctggtcaaggactacttccccgagcccgtgacggtgagctggaactccggcgccctgaccagcggcgtccacaccttcccggccgtgagccagtccagcgggctctactccctgagctccgtggtcaccgtgcccagctccagcctgggcacgcagacctacatctgcaacgtgaaccacaagccctccaacaccaaggtcgacaagaaggtggagcccaag

SEQ ID NO: 7724 - RNA, 672 nt, synthetic construct; identical to SEQ ID NO: 7723
  misc_feature 1..672: note = derived and/or modified sequence opt1 from Bevacizumab_180-substitution_deriv_HeavyCahin
  source 1..672: mol_type = other RNA

SEQ ID NO: 7725 - RNA, 1359 nt, synthetic construct
  misc_feature 1..1359: note = derived and/or modified sequence opt1 from Bevacizumab_beta_HeavyChain1
  source 1..1359: mol_type = other RNA
gaggtgcagctggtcgagagcggcgggggcctcgtgcagcccgggggctccctgcgcctgagctgcgccgcctccgggtacaccttcaccaactacggcatgaactgggtgcggcaggcgccgggcaaggggctcgagtgggtcggctggatcaacacgtacaccggggagcccacctacgccgccgacttcaagcgccggttcaccttcagcctggacacgtccaagagcaccgcctacctgcagatgaactccctccgcgccgaggacaccgcggtgtactactgcgccaagtacccccactactacggcagctcccactggtacttcgacgtgtgggggcagggcaccctggtcacggtgagctccgccagcaccaagggcccctccgtgttcccgctggcccccagctccaagagcacctccgggggcaccgcggccctcgggtgcctggtcaaggactacttccccgagcccgtgacggtgagctggaactccggcgccctgaccagcggcgtccacaccttcccggccgtgctccagagctccgggctgtacagcctgtccagcgtggtcaccgtgccctccagctccctcggcacgcagacctacatctgcaacgtgaaccacaagcccagcaacaccaaggtcgacaagaaggtggagcccaagtcctgcgacaagacccacacgtgcccgccctgccccgcccccgagctgctcgggggcccgagcgtgttcctcttcccgcccaagcccaaggacaccctgatgatctcccggacccccgaggtgacctgcgtcgtggtcgacgtgagccacgaggaccccgaggtcaagttcaactggtacgtggacggggtggaggtccacaacgcgaagacgaagccccgcgaggagcagtacaactccacctaccgggtggtgagcgtcctgaccgtgctccaccaggactggctgaacggcaaggagtacaagtgcaaggtgtccaacaaggccctgcccgccccgatcgagaagaccatcagcaaggccaagggccagccccgcgagccccaggtctacacgctgcccccgtcccgggaggagatgaccaagaaccaggtgagcctgacctgcctggtgaaggggttctacccctccgacatcgccgtcgagtgggagagcaacggccagcccgagaacaactacaagaccacgccgcccgtgctcgacagcgacgggtccttcttcctgtacagcaagctgaccgtggacaagtcccgctggcagcagggcaacgtcttcagctgctccgtgatgcacgaggcgctccacaaccactacacccagaagtccctgagcctgagccccgggaag

SEQ ID NO: 7726 - RNA, 642 nt, synthetic construct
  misc_feature 1..642: note = derived and/or modified sequence opt1 from Bevacizumab_beta_LightChain1
  source 1..642: mol_type = other RNA
gacatccagatgacgcagagcccctccagcctgtccgccagcgtgggcgaccgcgtcaccatcacgtgctccgccagccaggacatctccaactacctcaactggtaccagcagaagccggggaaggcgcccaaggtgctgatctacttcaccagctccctgcacagcggcgtgccctcccggttcagcgggtccggcagcgggaccgacttcaccctcacgatctccagcctgcagcccgaggacttcgccacctactactgccagcagtactccaccgtcccgtggaccttcggccagggcacgaaggtggagatcaagcgcaccgtggccgcccccagcgtcttcatcttcccgccctccgacgagcagctcaagagcgggaccgccagcgtggtgtgcctgctgaacaacttctacccccgggaggcgaaggtccagtggaaggtggacaacgccctgcagtccggcaacagccaggagtccgtgaccgagcaggacagcaaggactccacgtacagcctctccagcaccctgaccctgtccaaggccgactacgagaagcacaaggtctacgcctgcgaggtgacccaccaggggctcagctcccccgtgaccaagagcttcaaccgcggcgagtgc

SEQ ID NO: 7727 - RNA, 687 nt, synthetic construct
  misc_feature 1..687: note = derived and/or modified sequence opt1 from Bevacizumab_FcDomain
  source 1..687: mol_type = other RNA
agctgcgacaagacccacacgtgcccgccctgccccgcccccgagctgctcggcgggccctccgtgttcctgttcccgcccaagcccaaggacaccctgatgatcagccgcacccccgaggtgacctgcgtcgtggtcgacgtgtcccacgaggacccggaggtgaagttcaactggtacgtcgacggcgtggaggtgcacaacgccaagaccaagccccgggaggagcagtacaacagcacgtaccgcgtcgtgtccgtgctcaccgtcctgcaccaggactggctgaacgggaaggagtacaagtgcaaggtgagcaacaaggcgctccccgcccccatcgagaagaccatctccaaggccaagggccagccgcgggagccccaggtgtacaccctgccgcccagccgcgacgagctgacgaagaaccaggtctccctgacctgcctcgtgaaggggttctaccccagcgacatcgccgtggagtgggagtccaacggccagcccgagaacaactacaagaccaccccgcccgtcctggacagcgacggctccttcttcctctacagcaagctgacggtggacaagtcccggtggcagcaggggaacgtgttcagctgctccgtcatgcacgaggccctgcacaaccactacacccagaagtccctcagcctgagccccggcaag

SEQ ID NO: 7728 - RNA, 672 nt, synthetic construct
  misc_feature 1..672: note = derived and/or modified sequence opt1 from Bevacizumab_HeavyChain
  source 1..672: mol_type = other RNA
gaggtgcagctggtcgagagcggcgggggcctcgtgcagcccgggggctccctgcgcctgagctgcgccgcctccgggtacaccttcaccaactacggcatgaactgggtgcggcaggcgccgggcaaggggctcgagtgggtcggctggatcaacacgtacaccggggagcccacctacgccgccgacttcaagcgccggttcaccttcagcctggacacgtccaagagcaccgcctacctgcagatgaactccctccgcgccgaggacaccgcggtgtactactgcgccaagtacccccactactacggcagctcccactggtacttcgacgtgtgggggcagggcaccctggtcacggtgagctccgccagcaccaagggcccctccgtgttcccgctggcccccagctccaagagcacctccgggggcaccgcggccctcgggtgcctggtcaaggactacttccccgagcccgtgacggtgagctggaactccggcgccctgaccagcggcgtccacaccttcccggccgtgctccagagctccgggctgtacagcctgtccagcgtggtcaccgtgccctccagctccctcggcacgcagacctacatctgcaacgtgaaccacaagcccagcaacaccaaggtcgacaagaaggtggagcccaag

SEQ ID NO: 7729 - RNA, 1428 nt, synthetic construct
  misc_feature 1..1428: note = derived and/or modified sequence opt1 from Bevacizumab_HeavyChain_variant1
  source 1..1428: mol_type = other RNA
gccagcgccaccatgggctggtcctgcatcatcctgttcctcgtggcgaccgccacgggggtccacagcgaggtgcagctggtggagtccggcgggggcctggtccagcccgggggcagcctccgcctgtcctgcgccgccagcggctacaccttcaccaactacgggatgaactgggtgcggcaggccccgggcaaggggctggagtgggtgggctggatcaacacctacacgggggagcccacctacgcggccgacttcaagcgccggttcaccttctccctcgacaccagcaagtccacggcctacctgcagatgaacagcctgcgcgccgaggacaccgcggtctactactgcgccaagtacccccactactacggctccagccactggtacttcgacgtgtggggccaggggaccctcgtgaccgtctccagcgcctccacgaagggccccagcgtgttcccgctggccccctccagcaagtccaccagcgggggcaccgccgcgctgggctgcctcgtgaaggactacttccccgagcccgtcaccgtgagctggaactccggggccctgacgagcggcgtgcacaccttcccggccgtcctgcagtccagcgggctctactccctgagctccgtggtgaccgtccccagctccagcctgggcacccagacgtacatctgcaacgtgaaccacaagccctccaacaccaaggtggacaagaaggtcgagcccaagagctgcgacaagacccacacgtgcccgccctgccccgcccccgagctcctcgggggcccgtccgtgttcctgttcccgcccaagcccaaggacaccctcatgatcagccggacccccgaggtgacctgcgtcgtggtcgacgtgtcccacgaggaccccgaggtgaagttcaactggtacgtcgacggcgtggaggtgcacaacgccaagaccaagccccgcgaggagcagtacaacagcacgtaccgggtcgtgtccgtgctgaccgtcctgcaccaggactggctcaacgggaaggagtacaagtgcaaggtgagcaacaaggcgctgcccgccccgatcgagaagaccatctccaaggccaagggccagccccgcgagccccaggtgtacaccctgcccccgagccgggaggagatgacgaagaaccaggtcagcctgacctgcctggtgaaggggttctacccctccgacatcgccgtggagtgggagagcaacggccagcccgagaacaactacaagaccaccccgcccgtcctggactccgacgggagcttcttcctctactccaagctgacggtggacaagagccgctggcagcagggcaacgtgttctcctgcagcgtcatgcacgaggccctgcacaaccactacacccagaagtccctcagcctgtcccccggcaag

SEQ ID NO: 7730 - RNA, 369 nt, synthetic construct
  misc_feature 1..369: note = derived and/or modified sequence opt1 from Bevacizumab_HeavyChain_V-Region
  source 1..369: mol_type = other RNA
gaggtgcagctggtcgagagcggcgggggcctcgtgcagcccgggggctccctgcgcctgagctgcgccgcctccgggtacaccttcaccaactacggcatgaactgggtgcggcaggcgccgggcaaggggctcgagtgggtcggctggatcaacacgtacaccggggagcccacctacgccgccgacttcaagcgccggttcaccttcagcctggacacgtccaagagcaccgcctacctgcagatgaactccctccgcgccgaggacaccgcggtgtactactgcgccaagtacccccactactacggcagctcccactggtacttcgacgtgtgggggcagggcaccctggtcacggtgagctcc

SEQ ID NO: 7731 - RNA, 717 nt, synthetic construct
  misc_feature 1..717: note = derived and/or modified sequence opt1 from Bevacizumab_LightChain1
  source 1..717: mol_type = other RNA
gccagcaagctggccaccatgggctggtcctgcatcatcctcttcctggtggcgaccgccacgggggtccacagcgacatccagatgacccagtcccccagctccctgagcgcctccgtgggcgaccgcgtgaccatcacgtgccgggccagccaggacatctccagctacctcaactggtaccagcagaagccggggaaggcccccaagctgctgatctactacacctcccgcctccacagcggcgtcccctcccggttcagcgggtccggcagcggcaccgacttcaccttcaccatctccagcctgcagcccgaggacatcgcgacgtactactgccagcaggggaacaccctgccgtacaccttcggccaggggaccaaggtggagatcaagcgcacggtggccgccccctccgtcttcatcttcccgcccagcgacgagcagctcaagagcggcaccgcctccgtggtgtgcctgctgaacaacttctacccccgggaggcgaaggtccagtggaaggtggacaacgccctccagagcgggaactcccaggagagcgtgaccgagcaggactccaaggacagcacctactccctgagctccacgctgaccctcagcaaggccgactacgagaagcacaaggtctacgcctgcgaggtgacccaccagggcctgtccagccccgtgaccaagtccttcaaccgcggcgagtgc

SEQ ID NO: 7732 - RNA, 711 nt, synthetic construct
  misc_feature 1..711: note = derived and/or modified sequence opt1 from Bevacizumab_LightChain2
  source 1..711: mol_type = other RNA
gccagcgccaccatgggctggtcctgcatcatcctgttcctcgtggcgaccgccacgggggtccacagcgacatccagatgacccagtcccccagctccctgagcgcctccgtgggcgaccgcgtgaccatcacgtgcagcgcctcccaggacatcagcaactacctgaactggtaccagcagaagccggggaaggcccccaaggtcctcatctacttcacctccagcctgcactccggcgtgcccagccggttctccgggagcggctccggcaccgacttcaccctgaccatcagctccctccagcccgaggacttcgcgacgtactactgccagcagtacagcaccgtgccgtggaccttcgggcagggcaccaaggtcgagatcaagcgcacggtggccgcccccagcgtgttcatcttcccgccctccgacgagcagctcaagagcgggaccgcctccgtcgtgtgcctgctgaacaacttctacccccgggaggcgaaggtgcagtggaaggtcgacaacgccctgcagagcggcaactcccaggagagcgtgaccgagcaggactccaaggacagcacctactccctgagctccacgctcaccctgagcaaggccgactacgagaagcacaaggtgtacgcctgcgaggtcacccaccaggggctgtccagccccgtgaccaagtccttcaaccgcggcgagtgc

SEQ ID NO: 7733 - RNA, 642 nt, synthetic construct; identical to SEQ ID NO: 7726
  misc_feature 1..642: note = derived and/or modified sequence opt1 from Bevacizumab_LightChain
  source 1..642: mol_type = other RNA

SEQ ID NO: 7734 - RNA, 324 nt, synthetic construct
  misc_feature 1..324: note = derived and/or modified sequence opt1 from Bevacizumab_LightChain_VJ-Region
  source 1..324: mol_type = other RNA
gacatccagatgacccagagcccctccagcctgtccgccagcgtgggcgaccgcgtcaccatcacgtgctccgccagccaggacatctccaactacctcaactggtaccagcagaagccggggaaggcgcccaaggtgctgatctacttcaccagctccctgcacagcggcgtgccctcccggttcagcgggtccggcagcgggaccgacttcaccctcacgatctccagcctgcagcccgaggacttcgccacctactactgccagcagtactccaccgtcccgtggaccttcggccagggcacgaaggtggagatcaagcgc

SEQ ID NO: 7735 - RNA, 321 nt, synthetic construct
  misc_feature 1..321: note = derived and/or modified sequence opt1 from Bevacizumab_LightChain_V-Region
  source 1..321: mol_type = other RNA
gacatccagatgacccagagcccctccagcctgtccgccagcgtgggcgaccgcgtcaccatcacgtgctccgccagccaggacatctccaactacctcaactggtaccagcagaagccggggaaggcgcccaaggtgctgatctacttcaccagctccctgcacagcggcgtgccctcccggttcagcgggtccggcagcgggaccgacttcaccctcacgatctccagcctgcagcccgaggacttcgccacctactactgccagcagtactccaccgtcccgtggaccttcggccagggcacgaaggtggagatcaag

SEQ ID NO: 7736 - RNA, 369 nt, synthetic construct; identical to SEQ ID NO: 7730
  misc_feature 1..369: note = derived and/or modified sequence opt1 from Bevacizumab-rhuMAb-VEGF_HeavyChain_gamma1-Chain_VDJ-Region
  source 1..369: mol_type = other RNA

SEQ ID NO: 7737 - RNA, 321 nt, synthetic construct; identical to SEQ ID NO: 7735
  misc_feature 1..321: note = derived and/or modified sequence opt1 from Bevacizumab-rhuMAb-VEGF_LightChain_VJ-Region
  source 1..321: mol_type = other RNA

SEQ ID NO: 7738 - RNA, 1341 nt, synthetic construct
  misc_feature 1..1341: note = derived and/or modified sequence opt1 from Bevacizumab_gamma1-Chain
  source 1..1341: mol_type = other RNA
gaggtgcagctggtcgagagcggcgggggcctcgtgcagcccgggggctccctgcgcctgagctgcgccgcctccgggtacaccttcaccaactacggcatgaactgggtgcggcaggcgccgggcaaggggctcgagtgggtcggctggatcaacacgtacaccggggagcccacctacgccgccgacttcaagcgccggttcaccttcagcctggacacgtccaagagcaccgcctacctgcagatgaactccctccgcgccgaggacaccgcggtgtactactgcgccaagtacccccactactacggcagctcccactggtacttcgacgtgtgggggcagggcaccctggtcacggtgagctccgccagcaccaagggcccctccgtgttcccgctggcccccagctccaagagcacctccgggggcaccgcggccctcgggtgcctggtcaaggactacttccccgagcccgtgacggtgagctggaactccggcgccctgaccagcggcgtccacaccttcccggccgtgctccagagctccgggagcctgtccagcgtggtcaccgtgccctccagctccctgggcacgcagacctacatctgcaacgtgaaccacaagcccagcaacaccaaggtcgacaagaaggtggagcccaagtcctgcgacaagacccacacgtgcccgccctgccccgcccccgagctcctcgggggcccgagcgtgttcctgttcccgcccaagcccaaggacaccctgatgatctcccggacccccgaggtgacctgcgtcgtggtcgacgtgagccacgaggaccccgaggtcaagttcaactggtacgtggacggggtggaggtccacaacgcgaagacgaagccccgcgaggagcagtacaactcctacgtggtgagcgtcctgaccgtgctgcaccaggactggctcaacggcaaggagtacaagtgcaaggtgtccaacaaggccctgcccgccccgatcgagaagaccatcagcaaggccaagggccagccccgggagccccaggtctacaccctgcccccgtcccgcgacgagctcacgaagaaccaggtgagcctgacctgcctggtgaaggggttctacccctccgacatcgccgtcgagtgggagagcaacggccagcccgagaacaactacaagaccaccccgcccgtgctcgacagcgacgggtccttcttcaagaagctgacggtggacaagagccggtggcagcagggcaacgtcttctcctgcagcgtgatgcacgaggcgctgcacaaccactacacccagaagtccctcagcctgtcccccgggaag

SEQ ID NO: 7739 - RNA, 1359 nt, synthetic construct
  misc_feature 1..1359: note = derived and/or modified sequence opt1 from Bevacizumab_gamma1-Chain_CH3-Region_mutein
  source 1..1359: mol_type = other RNA
gaggtgcagctggtcgagagcggcgggggcctcgtgcagcccgggggctccctgcgcctgagctgcgccgcctccgggtacaccttcaccaactacggcatgaactgggtgcggcaggcgccgggcaaggggctcgagtgggtcggctggatcaacacgtacaccggggagcccacctacgccgccgacttcaagcgccggttcaccttcagcctggacacgtccaagagcaccgcctacctgcagatgaactccctccgcgccgaggacaccgcggtgtactactgcgccaagtacccccactactacggcagctcccactggtacttcgacgtgtgggggcagggcaccctggtcacggtgagctccgccagcaccaagggcccctccgtgttcccgctggcccccagctccaagagcacctccgggggcaccgcggccctcgggtgcctggtcaaggactacttccccgagcccgtgacggtgagctggaactccggcgccctgaccagcggcgtccacaccttcccggccgtgctccagagctccgggctgtacagcctgtccagcgtggtcaccgtgccctccagctccctcggcacgcagacctacatctgcaacgtgaaccacaagcccagcaacaccaaggtcgacaagaaggtggagcccaagtcctgcgacaagacccacacgtgcccgccctgccccgcccccgagctgctcgggggcccgagcgtgttcctcttcccgcccaagcccaaggacaccctgatgatctcccggacccccgaggtgacctgcgtcgtggtcgacgtgagccacgaggaccccgaggtcaagttcaactggtacgtggacggggtggaggtccacaacgcgaagacgaagccccgcgaggagcagtacaactccacctaccgggtggtgagcgtcctgaccgtgctccaccaggactggctgaacggcaaggagtacaagtgcaaggtgtccaacaaggccctgcccgccccgatcgagaagaccatcagcaaggccaagggccagccccgcgagccccaggtctgcacgctgcccccgtcccgggacgagctgaccaagaaccaggtgagcctgtcctgcgccgtgaaggggttctaccccagcgacatcgcggtcgagtgggagagcaacggccagcccgagaacaactacaagaccaccccgcccgtgctcgactccgacgggagcttcttcctggtgtccaagctgacggtcgacaagagccgctggcagcagggcaacgtgttctcctgcagcgtgatgcacgaggccctccacaaccactacacccagaagtccctgagcctgtcccccgggaag

SEQ ID NO: 7740 - RNA, 1347 nt, synthetic construct; identical to SEQ ID NO: 7653
  misc_feature 1..1347: note = derived and/or modified sequence opt1 from Bezlotoxumab_HeavyChain1
  source 1..1347: mol_type = other RNA

SEQ ID NO: 7741 - RNA, 645 nt, synthetic construct; identical to SEQ ID NO: 7654
  misc_feature 1..645: note = derived and/or modified sequence opt1 from Bezlotoxumab_LightChain1
  source 1..645: mol_type = other RNA

SEQ ID NO: 7742 - RNA, 1335 nt, synthetic construct
  misc_feature 1..1335: note = derived and/or modified sequence opt1 from Bimagrumab_HeavyChain1
  source 1..1335: mol_type = other RNA
caggtgcagctggtccagagcggcgccgaggtgaagaagcccggggcctccgtgaaggtcagctgcaaggcgtccggctacaccttcaccagctcctacatcaactgggtgcgccaggccccggggcagggcctcgagtggatggggacgatcaaccccgtgagcggctccaccagctacgcccagaagttccagggccgggtcaccatgacccgcgacacgtccatcagcaccgcctacatggagctgtcccggctgcgcagcgacgacaccgccgtgtactactgcgcgcgcgggggctggttcgactactgggggcagggcaccctcgtgacggtctccagcgcctccaccaaggggcccagcgtgttccccctggccccgtccagcaagtccaccagcggcggcaccgccgcgctggggtgcctcgtgaaggactacttccccgagcccgtcacggtgagctggaactccggcgccctgaccagcggggtgcacaccttccccgccgtcctgcagtccagcggcctctactccctgagctccgtggtgaccgtcccgagctccagcctgggcacgcagacctacatctgcaacgtgaaccacaagccctccaacaccaaggtggacaagcgggtcgagcccaagagctgcgacaagacccacacgtgcccgccctgccccgcccccgaggccgccgggggcccctccgtgttcctcttcccgcccaagcccaaggacaccctgatgatcagccggacccccgaggtgacctgcgtcgtggtcgacgtgtcccacgaggacccggaggtgaagttcaactggtacgtcgacggggtggaggtgcacaacgcgaagacgaagccccgcgaggagcagtacaacagcacctaccgggtcgtgtccgtgctgaccgtcctccaccaggactggctgaacggcaaggagtacaagtgcaaggtgagcaacaaggccctgcccgcccccatcgagaagaccatctccaaggccaaggggcagccgcgcgagccccaggtgtacacgctcccgcccagccgggaggagatgaccaagaaccaggtcagcctgacctgcctggtgaagggcttctacccctccgacatcgcggtggagtgggagagcaacggccagcccgagaacaactacaagaccacgcccccggtcctcgactccgacgggagcttcttcctgtactccaagctgaccgtggacaagagccgctggcagcagggcaacgtgttctcctgcagcgtcatgcacgaggccctccacaaccactacacccagaagtccctgagcctgtcccccgggaag

SEQ ID NO: 7743 - RNA, 1332 nt, synthetic construct
  misc_feature 1..1332: note = derived and/or modified sequence opt1 from Bimagrumab_HeavyChain
  source 1..1332: mol_type = other RNA
caggtgcagctggtccagagcggcgccgaggtgaagaagcccggggcctccgtgaaggtcagctgcaaggcgtccggctacaccttcaccagctcctacatcaactgggtgcgccaggccccggggcagggcctcgagtggatggggacgatcaaccccgtgagcggctccaccagctacgcccagaagttccagggccgggtcaccatgacccgcgacacgtccatcagcaccgcctacatggagctgtcccggctgcgcagcgacgacaccgccgtgtactactgcgcgcgcgggggctggttcgactactgggggcagggcaccctcgtgacggtctccagcgcctccaccaaggggcccagcgtgttccccctggccccgtccagcaagtccaccagcggcggcaccgccgcgctggggtgcctcgtgaaggactacttccccgagcccgtcacggtgagctggaactccggcgccctgaccagcggggtgcacaccttccccgccgtcctgcagtccagcggcctctactccctgagctccgtggtgaccgtcccgagctccagcctgggcacgcagacctacatctgcaacgtgaaccacaagccctccaacaccaaggtggacaagcgggtcgagcccaagagctgcgacaagacccacacgtgcccgccctgccccgcccccgaggccgccgggggcccctccgtgttcctcttcccgcccaagcccaaggacaccctgatgatcagccggacccccgaggtgacctgcgtcgtggtcgacgtgtcccacgaggacccggaggtgaagttcaactggtacgtcgacggggtggaggtgcacaacgcgaagacgaagccccgcgaggagcagtacaacagcacctaccgggtcgtgtccgtgctgaccgtcctccaccaggactggctgaacggcaaggagtacaagtgcaaggtgagcaacaaggccctgcccgcccccatcgagaagaccatctccaaggccaaggggcagccgcgcgagccccaggtgtacacgctcccgcccagccgggaggagatgaccaagaaccaggtcagcctgacctgcctggtgaagggcttctacccctccgacatcgcggtggagtgggagagcaacggccagcccgagaacaactacaagaccacgcccccggtcctcgactccgacgggagcttcttcctgtactccaagctgaccgtggacaagagccgctggcagcagggcaacgtgttctcctgcagcgtcatgcacgaggccctccacaaccactacacccagaagtccctgagcctgtcccccggg

SEQ ID NO: 7744 - RNA, 651 nt, synthetic construct
  misc_feature 1..651: note = derived and/or modified sequence opt1 from Bimagrumab_LightChain1
  source 1..651: mol_type = other RNA
cagagcgccctgacccagcccgcctccgtgagcggctccccggggcagagcatcaccatctcctgcacgggcaccagctccgacgtcgggagctacaactacgtgaactggtaccagcagcaccccggcaaggcgcccaagctcatgatctacggggtgtccaagcgccccagcggcgtctccaaccggttcagcggctccaagagcgggaacaccgcctccctgaccatcagcggcctgcaggccgaggacgaggccgactactactgcgggacgttcgccggcgggtcctactacggcgtgttcggcgggggcaccaagctcaccgtgctggggcagccgaaggcggcccccagcgtcaccctgttcccgccctccagcgaggagctccaggccaacaaggccacgctggtgtgcctgatcagcgacttctaccccggcgcggtgaccgtcgcctggaaggccgactccagccccgtgaaggccggcgtggagaccaccacgccctccaagcagagcaacaacaagtacgccgcgtccagctacctctccctgacccccgagcagtggaagtcccaccgcagctacagctgccaggtcacccacgaggggtccaccgtggagaagacggtggccccgaccgagtgcagc

SEQ ID NO: 7745 - RNA, 1365 nt, synthetic construct
  misc_feature 1..1365: note = derived and/or modified sequence opt1 from Bimekizumab_HeavyChain1
  source 1..1365: mol_type = other RNA
gaggtgcagctggtcgagagcggcgggggcctcgtgcagcccgggggctccctgcgcctgagctgcgccgcctccgggttcaccttcagcgactacaacatggcgtgggtgcggcaggccccgggcaagggcctcgagtgggtcgccaccatcacgtacgaggggcgcaacacctactaccgggactccgtgaagggccgcttcaccatcagccgggacaacgccaagaactccctgtacctgcagatgaacagcctccgcgccgaggacaccgcggtgtactactgcgcctccccgccccagtactacgaggggagcatctaccggctgtggttcgcccactggggccaggggacgctggtcaccgtgtccagcgcctccaccaagggccccagcgtgttccccctcgcgccctccagcaagtccaccagcggcgggacggccgccctgggctgcctggtcaaggactacttccccgagcccgtgaccgtgtcctggaacagcggggccctcaccagcggcgtccacaccttcccggccgtgctgcagtccagcggcctgtactccctcagctccgtggtcacggtgcccagctccagcctggggacccagacctacatctgcaacgtgaaccacaagccctccaacaccaaggtcgacaagaaggtggagcccaagagctgcgacaagacgcacacgtgcccgccctgccccgcgcccgagctgctcggcgggccgtccgtgttcctgttcccgcccaagcccaaggacaccctgatgatcagccgcacccccgaggtgacctgcgtcgtggtcgacgtgtcccacgaggaccccgaggtcaagttcaactggtacgtggacggcgtggaggtccacaacgccaagaccaagccccgggaggagcagtacaacagcacctaccgcgtggtgtccgtcctcaccgtgctgcaccaggactggctgaacgggaaggagtacaagtgcaaggtgagcaacaaggccctccccgccccgatcgagaagacgatctccaaggccaagggccagccccgggagccccaggtctacaccctgcccccgagccgcgacgagctgaccaagaaccaggtgtccctgacctgcctcgtgaagggcttctaccccagcgacatcgcggtcgagtgggagagcaacgggcagcccgagaacaactacaagacgaccccgcccgtgctggactccgacggcagcttcttcctctactccaagctgaccgtggacaagagccggtggcagcaggggaacgtcttctcctgcagcgtgatgcacgaggccctgcacaaccactacacccagaagtccctcagcctgtcccccggcaag

SEQ ID NO: 7746 - RNA, 642 nt, synthetic construct
  misc_feature 1..642: note = derived and/or modified sequence opt1 from Bimekizumab_LightChain1
  source 1..642: mol_type = other RNA
gccatccagctgacccagagcccctccagcctctccgccagcgtgggcgaccgcgtcaccatcacgtgccgggcggacgagtccgtgcgcaccctgatgcactggtaccagcagaagccggggaaggcccccaagctgctcatctacctggtgagcaactccgagatcggcgtccccgaccggttcagcgggtccggcagcgggaccgacttccgcctgaccatctccagcctccagcccgaggacttcgccacgtactactgccagcagacctggtccgacccgtggaccttcggccagggcaccaaggtggagatcaagcggacggtggccgcccccagcgtcttcatcttcccgccctccgacgagcagctcaagagcgggaccgcgtccgtggtgtgcctgctgaacaacttctacccccgcgaggccaaggtccagtggaaggtggacaacgccctgcagagcggcaactcccaggagagcgtgaccgagcaggacagcaaggactccacctacagcctgtccagcacgctcaccctgtccaaggccgactacgagaagcacaaggtctacgcgtgcgaggtgacccaccaggggctgagctcccccgtgaccaagagcttcaaccggggcgagtgc

SEQ ID NO: 7747 - RNA, 1344 nt, synthetic construct
  misc_feature 1..1344: note = derived and/or modified sequence opt1 from Bleselumab_HeavyChain1
  source 1..1344: mol_type = other RNA
cagctgcagctccaggagagcggccccgggctgctgaagccgtccgagaccctcagcctgacctgcacggtgtccggcgggagcatctccagccccggctactacgggggctggatccgccagccgcccggcaaggggctggagtggatcggctccatctacaagagcgggtccacctaccacaaccccagcctcaagtcccgggtcaccatcagcgtggacacctccaagaaccagttcagcctgaagctgtccagcgtgacggccgccgacaccgcggtctactactgcacccgccccgtggtgcggtacttcggctggttcgacccctgggggcagggcaccctcgtcacggtgtccagcgcctccaccaagggccccagcgtgttcccgctggccccctgcagccgctccaccagcgagtccaccgccgccctggggtgcctcgtcaaggactacttccccgagcccgtgacggtgagctggaactccggcgcgctgaccagcggggtccacaccttcccggccgtgctgcagtccagcggcctctactccctgagctccgtggtcaccgtgcccagctccagcctgggcacgaagacctacacgtgcaacgtggaccacaagccctccaacaccaaggtcgacaagcgggtggagagcaagtacgggcccccgtgcccgccctgccccgcccccgagttcgagggcgggccctccgtgttcctcttcccgcccaagcccaaggacaccctgatgatcagccgcacccccgaggtgacctgcgtcgtggtcgacgtgtcccaggaggaccccgaggtccagttcaactggtacgtggacggcgtggaggtccacaacgccaagaccaagccccgggaggagcagttcaacagcacgtaccgcgtggtgagcgtcctgaccgtgctccaccaggactggctgaacgggaaggagtacaagtgcaaggtgtccaacaagggcctgccgagctccatcgagaagaccatcagcaaggcgaagggccagccccgggagccccaggtctacaccctcccgccctcccaggaggagatgacgaagaaccaggtgagcctgacctgcctggtgaaggggttctacccctccgacatcgccgtcgagtgggagagcaacggccagcccgagaacaactacaagaccaccccgcccgtgctcgactccgacgggagcttcttcctgtactcccgcctgacggtggacaagagccggtggcaggagggcaacgtcttctcctgcagcgtgatgcacgaggccctccacaaccactacacccagaagtccctgagcctgtccctcgggaag

SEQ ID NO: 7748 - RNA, 639 nt, synthetic construct
  misc_feature 1..639: note = derived and/or modified sequence opt1 from Bleselumab_LightChain1
  source 1..639: mol_type = other RNA
gccatccagctgacccagagcccctccagcctctccgccagcgtgggcgaccgggtcaccatcacgtgccgggcgtcccaggggatcagctccgccctggcctggtaccagcagaagccgggcaaggcccccaagctgctcatctacgacgccagcaacctggagtccggggtgcccagccgcttctccggcagcgggtccggcaccgacttcaccctgaccatcagctccctccagcccgaggacttcgcgacgtactactgccagcagttcaacagctacccgaccttcggccaggggaccaaggtggagatcaagcggaccgtcgccgccccctccgtgttcatcttcccgcccagcgacgagcagctgaagtccggcacggccagcgtggtctgcctgctcaacaacttctacccccgcgaggcgaaggtgcagtggaaggtggacaacgccctgcagagcgggaactcccaggagagcgtcaccgagcaggactccaaggacagcacctactccctgagctccaccctcacgctgagcaaggccgactacgagaagcacaaggtgtacgcctgcgaggtgacccaccagggcctgtccagccccgtcaccaagtccttcaaccgcggggagtgc

SEQ ID NO: 7749 - RNA, 1512 nt, synthetic construct
  misc_feature 1..1512: note = derived and/or modified sequence opt1 from Blinatumomab_HeavyChain1
  source 1..1512: mol_type = other RNA
gacatccagctgacccagagccccgcctccctcgccgtgagcctgggccagcgcgcgaccatctcctgcaaggccagccagtccgtcgactacgacggggacagctacctgaactggtaccagcagatcccgggccagccgcccaagctcctgatctacgacgcctccaacctggtgagcgggatcccgccccggttctccggcagcgggtccggcacggacttcaccctcaacatccaccccgtggagaaggtcgacgccgccacctaccactgccagcagagcaccgaggacccctggacgttcggcgggggcaccaagctggagatcaagggcggcgggggctccggcgggggcgggagcggcggcgggggctcccaggtgcagctgcagcagagcggggcggagctcgtgcgccccggctccagcgtcaagatctcctgcaaggccagcgggtacgccttcagctcctactggatgaactgggtgaagcagcggcccggccagggcctggagtggatcgggcagatctggcccggcgacggggacaccaactacaacggcaagttcaaggggaaggccaccctgacggcggacgagagctccagcaccgcctacatgcagctctccagcctggcctccgaggacagcgccgtgtacttctgcgcccgccgggagaccaccacggtcggccgctactactacgcgatggactactggggccaggggaccaccgtgaccgtgtccagcggcgggggcgggtccgacatcaagctgcagcagagcggcgccgagctcgcccggcccggcgcctccgtcaagatgagctgcaagacgtccgggtacaccttcacccgctacaccatgcactgggtgaagcagcggcccggccaggggctggagtggatcggctacatcaacccgagccgcggctacacgaactacaaccagaagttcaaggacaaggccaccctgaccaccgacaagtccagctccacggcgtacatgcagctcagcagcctgacctccgaggacagcgccgtgtactactgcgcccggtactacgacgaccactactgcctggactactgggggcagggcaccaccctcacggtctccagcgtggagggcgggtccggcgggagcggcgggtccggcgggagcggcggggtggacgacatccagctgacccagtcccccgccatcatgagcgcctcccccggggagaaggtcaccatgacctgccgcgcgagctccagcgtgtcctacatgaactggtaccagcagaagtccggcacgagccccaagcggtggatctacgacaccagcaaggtggccagcggggtcccgtaccgcttctccggcagcgggtccggcaccagctactccctgaccatcagctccatggaggccgaggacgccgccacgtactactgccagcagtggagctccaaccccctcaccttcggggcgggcaccaagctggagctgaagcaccaccaccaccaccac

SEQ ID NO: 7750 - RNA, 1512 nt, synthetic construct; identical to SEQ ID NO: 7749
  misc_feature 1..1512: note = derived and/or modified sequence opt1 from Blinatumomab_SingleChain
  source 1..1512: mol_type = other RNA

SEQ ID NO: 7751 - RNA, 1512 nt, synthetic construct; identical to SEQ ID NO: 7749
  misc_feature 1..1512: note = derived and/or modified sequence opt1 from Blinatumumab_SingleChain_variable_fragment_fusion_protein_( bite)
  source 1..1512: mol_type = other RNA

SEQ ID NO: 7752 - RNA, 1344 nt, synthetic construct
  misc_feature 1..1344: note = derived and/or modified sequence opt1 from Blontuvetmab_HeavyChain
  source 1..1344: mol_type = other RNA
caggtgcagctgcagcagagccgcgccgagctcgtccggcccggcgcctccgtgaccctgagctgcaagccctccgggtacaccttcacggactacgaggtgcactgggtcaagcagacccccgtgcacggcctggagtggatcggggcgatcgaccccgagaccggcgggaccgccgacaaccagaagttcaagggcaaggccatcctcacggccgacaagagctccagcaccgcctacatggagctgcgctccctgaccagcgaggactccgcggtgtactactgcaccaacttcgtcgacgtgtggggcacggggaccaccgtgaccgtcagctccgccagcacgaccgccccctccgtgttcccgctcgcccccagctgcggctcccagagcgggtccaccgtggcgctggcctgcctggtcagcggctacttccccgagcccgtgaccgtgtcctggaacagcgggagcctcacgtccggcgtccacaccttcccgagcgtgctgcagtccagcggcctgtactccctcagctccatggtgaccgtccccagctcccggtggcccagcgagaccttcacgtgcaacgtggcccaccccgcctccaagaccaaggtggacaagccggtccccaagcgcgagaacgggcgggtgccccggcccccggactgccccaagtgccccgcccccgagatgctgggcgggccgagcgtgttcatcttcccgcccaagcccaaggacaccctgctcatcgcgcgcacccccgaggtcacgtgcgtggtcgtggacctggaccccgaggaccccgaggtgcagatctcctggttcgtcgacggcaagcagatgcagaccgccaagacccagccccgcgaggagcagttcaacggcacctaccgggtggtgagcgtcctgccgatcgggcaccaggactggctcaagggcaagcagttcacgtgcaaggtgaacaacaaggccctgccctcccccatcgagcgcaccatcagcaaggcccgggggcaggcccaccagccgtccgtgtacgtcctgccgcccagccgcgaggagctctccaagaacaccgtgagcctgacctgcctgatcaaggacttcttcccgcccgacatcgacgtggagtggcagagcaacggccagcaggagcccgagtccaagtaccggacgaccccgccccagctcgacgaggacgggagctacttcctgtactccaagctgagcgtcgacaagtcccgctggcagcggggcgacaccttcatctgcgcggtgatgcacgaggccctccacaaccactacacccagaagtccctgagccacagccccggcaag

SEQ ID NO: 7753 - RNA, 657 nt, synthetic construct
  misc_feature 1..657: note = derived and/or modified sequence opt1 from Blontuvetmab_LightChain
  source 1..657: mol_type = other RNA
gacgtggtcatgagccagtcccccagctccctggccgtgagcgtgggcgagaaggtcaccatgtcctgcaagagctcccagagcctcctgtactccgggaaccagaagaactacctggcctggtaccagcagaagccgggccagagcccccgcctcctgatctactgggcgtccacccgggagagcggggtgcccgaccgcttcacgggctccgggagcggcaccgacttcaccctgaccatctccagcgtgaaggccgaggacctcgccgtcttctactgccagcagtactacaactaccccctgacgttcggcgggggcacccacctgaccgtgctcgggcagccgaaggcctcccccagcgtgaccctgttcccgccctccagcgaggagctgggcgccaacaaggcgacgctcgtctgcctgatcagcgacttctacccctccggggtgaccgtggcctggaaggccgacggcagccccatcacccagggcgtcgagaccacgaagccctccaagcagagcaacaacaagtacgccgcgtccagctacctgtccctcacccccgacaagtggaagtcccacagcagcttctcctgcctggtgacccacgaggggagcaccgtggagaagaaggtcgccccggccgagtgctcc

SEQ ID NO: 7754 - RNA, 1332 nt, synthetic construct
  misc_feature 1..1332: note = derived and/or modified sequence opt1 from Blosozumab_HeavyChain1
  source 1..1332: mol_type = other RNA
caggtgcagctggtccagagcggcgccgaggtgaagaagcccggggcctccgtgaaggtcagctgcaaggtgtccggcttcccgatcaaggacaccttccagcactgggtgcgccaggcgcccgggaagggcctcgagtggatggggtggagcgaccccgagatcggcgacaccgagtacgcctccaagttccagggccgggtcacgatgaccgaggacaccagcaccgacacggcctacatggagctgtccagcctgcgctccgaggacaccgccgtgtactactgcgccaccggggacaccacgtacaagttcgacttctggggccaggggaccaccgtgaccgtcagctccgcgagcacgaagggcccctccgtgttcccgctcgccccctgcagccggtccaccagcgagtccaccgccgccctggggtgcctggtgaaggactacttccccgagcccgtcaccgtgagctggaactccggcgcgctcacgagcggcgtgcacaccttcccggccgtcctgcagagctccgggctgtacagcctctccagcgtggtgaccgtcccctccagctccctgggcaccaagacgtacacgtgcaacgtggaccacaagcccagcaacaccaaggtggacaagcgcgtcgagtccaagtacgggcccccgtgcccgccctgccccgcccccgagttcctgggcggccccagcgtgttcctcttcccgcccaagcccaaggacaccctgatgatctcccggacccccgaggtgacctgcgtcgtggtcgacgtgagccaggaggaccccgaggtgcagttcaactggtacgtcgacggggtggaggtgcacaacgccaagaccaagccccgcgaggagcagttcaactccacctaccgggtcgtgagcgtgctgacggtcctccaccaggactggctgaacggcaaggagtacaagtgcaaggtgtccaacaaggggctgccgagctccatcgagaagaccatcagcaaggccaagggccagccccgcgagccccaggtgtacaccctgcccccgtcccaggaggagatgaccaagaaccaggtcagcctcacgtgcctggtgaaggggttctaccccagcgacatcgcggtggagtgggagtccaacggccagcccgagaacaactacaagaccaccccgcccgtcctcgacagcgacggctccttcttcctgtacagccggctgaccgtggacaagtcccgctggcaggaggggaacgtgttcagctgctccgtcatgcacgaggccctccacaaccactacacgcagaagtccctgagcctgagcctcggc

SEQ ID NO: 7755 - RNA, 642 nt, synthetic construct
  misc_feature 1..642: note = derived and/or modified sequence opt1 from Blosozumab_LightChain1
  source 1..642: mol_type = other RNA
gacatccagatgacccagagcccctccagcctgtccgccagcgtgggcgaccgggtcaccatcacgtgcaaggcctcccaggacgtgcacaccgcggtggcctggtaccagcagaagccggggaaggcccccaagctcctgatctactgggccagcacccggtggaccggcgtcccctcccgcttcagcgggtccggcagcgggacggacttcaccctgaccatctccagcctccagcccgaggacttcgccacctactactgccagcagtactccgactacccgtggacgttcggcggcgggaccaaggtggagatcaagcggaccgtggcggcccccagcgtcttcatcttcccgccctccgacgagcagctcaagagcggcaccgcctccgtggtgtgcctgctgaacaacttctacccccgcgaggccaaggtccagtggaaggtggacaacgcgctgcagagcgggaactcccaggagagcgtgacggagcaggacagcaaggactccacctacagcctgtccagcaccctcaccctgtccaaggccgactacgagaagcacaaggtctacgcctgcgaggtgacgcaccagggcctgagctcccccgtgaccaagagcttcaaccgcggggagtgc

SEQ ID NO: 7756 - RNA, 1332 nt, synthetic construct
  misc_feature 1..1332: note = derived and/or modified sequence opt1 from Bococizumab_HeavyChain1
  source 1..1332: mol_type = other RNA
caggtgcagctggtccagagcggcgccgaggtgaagaagcccggggcctccgtgaaggtcagctgcaaggcgtccggctacaccttcaccagctactacatgcactgggtgcgccaggccccggggcagggcctcgagtggatgggggagatctcccccttcggcggccggacgaactacaacgagaagttcaagagccgcgtgaccatgacccgggacacctccacgagcaccgtctacatggagctgtccagcctgcgctccgaggacaccgccgtgtactactgcgcccgggagcgccccctctacgccagcgacctgtgggggcagggcaccacggtgaccgtctccagcgcgtccaccaaggggcccagcgtgttcccgctggccccctgctcccggagcacctccgagagcacggccgccctcggctgcctggtgaaggactacttccccgagcccgtcaccgtgagctggaactccggggcgctgaccagcggcgtgcacaccttcccggccgtcctccagtccagcggcctgtactccctgagctccgtggtgacggtccccagctccaacttcgggacccagacctacacgtgcaacgtggaccacaagcccagcaacaccaaggtggacaagaccgtcgagcgcaagtgctgcgtggagtgcccgccctgccccgccccgcccgtggccggcccctccgtcttcctcttcccgcccaagcccaaggacaccctgatgatcagccggacccccgaggtgacgtgcgtcgtggtggacgtctcccacgaggaccccgaggtgcagttcaactggtacgtggacggggtcgaggtgcacaacgccaagaccaagccccgcgaggagcagttcaacagcaccttccgggtggtctccgtgctgaccgtggtccaccaggactggctcaacggcaaggagtacaagtgcaaggtgagcaacaagggcctgccctccagcatcgagaagacgatctccaagaccaaggggcagccgcgcgagccccaggtgtacaccctgccgcccagccgggaggagatgaccaagaaccaggtcagcctcacgtgcctggtgaagggcttctacccctccgacatcgcggtggagtgggagagcaacgggcagcccgagaacaactacaagaccacgcccccgatgctggactccgacggcagcttcttcctctactccaagctgaccgtcgacaagagccgctggcagcaggggaacgtgttctcctgcagcgtgatgcacgaggccctgcacaaccactacacccagaagtccctcagcctgtcccccggcaag

SEQ ID NO: 7757 - RNA, 642 nt, synthetic construct
  misc_feature 1..642: note = derived and/or modified sequence opt1 from Bococizumab_LightChain1
  source 1..642: mol_type = other RNA
gacatccagatgacccagagcccctccagcctgtccgccagcgtgggcgaccgcgtcaccatcacgtgccgggcctcccaggggatcagctccgcgctcgcctggtaccagcagaagccgggcaaggcccccaagctgctgatctacagcgcctcctaccgctacaccggggtgcccagccggttctccggcagcgggtccggcaccgacttcaccttcacgatcagctccctccagcccgaggacatcgccacctactactgccagcagcgctacagcctgtggcggaccttcggccaggggaccaagctggagatcaagcgcacggtggcggccccgtccgtcttcatcttcccgcccagcgacgagcagctcaagtccggcaccgccagcgtggtgtgcctgctgaacaacttctacccccgggaggccaaggtccagtggaaggtggacaacgcgctccagagcgggaactcccaggagagcgtgaccgagcaggactccaaggacagcacctactccctgagctccacgctgaccctcagcaaggccgactacgagaagcacaaggtctacgcctgcgaggtgacccaccagggcctgtccagccccgtgaccaagtccttcaaccgcggggagtgc

SEQ ID NO: 7758 - RNA, 1338 nt, synthetic construct
  misc_feature 1..1338: note = derived and/or modified sequence opt1 from Brentuximab_vedotin_HeavyChain1
  source 1..1338: mol_type = other RNA
cagatccagctgcagcagagcggccccgaggtggtcaagccgggggcctccgtgaagatcagctgcaaggcctccggctacaccttcaccgactactacatcacgtgggtgaagcagaagcccgggcagggcctcgagtggatcgggtggatctaccccggcagcggcaacaccaagtacaacgagaagttcaaggggaaggcgaccctgaccgtcgacacgtccagctccaccgccttcatgcagctgagctccctcaccagcgaggacaccgccgtgtacttctgcgccaactacggcaactactggttcgcctactgggggcagggcacccaggtgaccgtctccgcggccagcaccaaggggccctccgtgttcccgctggcccccagctccaagagcacctccggcggcacggccgcgctggggtgcctcgtgaaggactacttccccgagcccgtcaccgtgagctggaactccggcgccctgaccagcggggtgcacaccttcccggccgtcctgcagagctccggcctctacagcctgtccagcgtggtgacggtcccctccagctccctgggcacccagacctacatctgcaacgtgaaccacaagcccagcaacaccaaggtggacaagaaggtcgagcccaagtcctgcgacaagacgcacacgtgcccgccctgccccgcccccgagctcctcgggggcccgagcgtgttcctgttcccgcccaagcccaaggacaccctgatgatctcccgcacccccgaggtgacgtgcgtcgtggtggacgtcagccacgaggaccccgaggtgaagttcaactggtacgtcgacggggtggaggtgcacaacgccaagaccaagccccgggaggagcagtacaactccacctaccgcgtcgtgagcgtgctgaccgtcctgcaccaggactggctcaacggcaaggagtacaagtgcaaggtgtccaacaaggcgctgcccgccccgatcgagaagacgatcagcaaggccaaggggcagccccgggagccccaggtgtacaccctgcccccgtcccgcgacgagctcaccaagaaccaggtcagcctgacctgcctggtgaagggcttctacccctccgacatcgccgtggagtgggagagcaacggccagcccgagaacaactacaagacgaccccgcccgtcctcgacagcgacgggtccttcttcctgtacagcaagctgaccgtggacaagtcccggtggcagcagggcaacgtgttcagctgctccgtcatgcacgaggccctccacaaccactacacccagaagtccctgagcctgagccccggg

SEQ ID NO: 7759 - RNA, 654 nt, synthetic construct
  misc_feature 1..654: note = derived and/or modified sequence opt1 from Brentuximab_vedotin_LightChain1
  source 1..654: mol_type = other RNA
gacatcgtgctgacccagagccccgcctccctcgccgtcagcctgggccagcgcgcgaccatctcctgcaaggccagccagtccgtggacttcgacggggacagctacatgaactggtaccagcagaagccgggccagccgcccaaggtgctgatctacgccgcctccaacctcgagagcgggatccccgcccggttctccggcagcgggtccggcacggacttcaccctgaacatccaccccgtcgaggaggaggacgcggccacctactactgccagcagagcaacgaggacccctggaccttcggcgggggcacgaagctggagatcaagcgcaccgtggccgccccctccgtgttcatcttcccgcccagcgacgagcagctcaagtccgggaccgcgagcgtcgtgtgcctgctgaacaacttctacccccgggaggccaaggtgcagtggaaggtcgacaacgccctccagtccggcaacagccaggagtccgtgaccgagcaggacagcaaggacagcacgtactccctgagctccaccctgaccctcagcaaggccgactacgagaagcacaaggtgtacgcctgcgaggtcacccaccaggggctgtccagccccgtgacgaagtccttcaaccgcggcgagtgc

SEQ ID NO: 7760 - RNA, 1335 nt, synthetic construct
  misc_feature 1..1335: note = derived and/or modified sequence opt1 from Briakinumab_HeavyChain1
  source 1..1335: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccttcatccggtacgacgggagcaacaagtactacgccgactccgtgaagggccgcttcaccatcagccgggacaactccaagaacacgctctacctgcagatgaacagcctgcgcgccgaggacaccgccgtctactactgcaagacccacgggtcccacgacaactggggccaggggaccatggtgacggtgagctccgcgagcaccaagggcccctccgtcttccccctcgcccccagctccaagagcacctccggcgggaccgccgccctgggctgcctggtgaaggactacttcccggagcccgtgacggtcagctggaacagcggggcgctcacctccggcgtgcacaccttccccgccgtgctgcagagctccggcctgtacagcctctccagcgtcgtgaccgtgccctccagctccctggggacgcagacctacatctgcaacgtcaaccacaagccgagcaacaccaaggtggacaagaaggtggagcccaagtcctgcgacaagacccacacgtgcccgccctgcccggcccccgagctgctcggcgggcccagcgtcttcctgttcccgcccaagcccaaggacaccctgatgatctcccggacccccgaggtgacctgcgtggtcgtggacgtcagccacgaggaccccgaggtgaagttcaactggtacgtggacggcgtcgaggtgcacaacgccaagacgaagccgcgcgaggagcagtacaactccacctaccgggtggtcagcgtgctcaccgtgctgcaccaggactggctgaacgggaaggagtacaagtgcaaggtctccaacaaggccctccccgcgcccatcgagaagaccatcagcaaggccaagggccagccccgcgagccccaggtgtacacgctgccgccctcccgggaggagatgaccaagaaccaggtgagcctgacctgcctcgtcaagggcttctaccccagcgacatcgccgtggagtgggagtccaacgggcagcccgagaacaactacaagaccacgccgcccgtgctggacagcgacggctccttcttcctgtacagcaagctcaccgtcgacaagtcccgctggcagcaggggaacgtgttcagctgctccgtgatgcacgaggccctgcacaaccactacacccagaagtccctgagcctcagccccggcaag

SEQ ID NO: 7761 - RNA, 651 nt, synthetic construct
  misc_feature 1..651: note = derived and/or modified sequence opt1 from Briakinumab_LightChain1
  source 1..651: mol_type = other RNA
cagagcgtgctgacccagcccccgtccgtcagcggcgcccccgggcagcgcgtgaccatctcctgcagcggctcccggagcaacatcgggtccaacacggtgaagtggtaccagcagctccccggcaccgcccccaagctgctgatctactacaacgaccagcgcccgagcggggtccccgaccggttctccggcagcaagtccggcaccagcgcgtccctcgccatcaccgggctgcaggccgaggacgaggccgactactactgccagagctacgaccgctacacgcaccccgccctcctgttcggcaccgggaccaaggtgaccgtgctgggccagcccaaggcggccccgtccgtcacgctgttcccgcccagctccgaggagctccaggccaacaaggccaccctggtgtgcctgatcagcgacttctaccccggggcggtgaccgtcgcctggaaggccgactccagccccgtgaaggccggcgtggagaccacgacccccagcaagcagtccaacaacaagtacgccgcgagctcctacctcagcctgacccccgagcagtggaagtcccaccggagctactcctgccaggtcacccacgagggcagcacggtggagaagaccgtggcccccaccgagtgctcc

SEQ ID NO: 7762 - RNA, 1326 nt, synthetic construct
  misc_feature 1..1326: note = derived and/or modified sequence opt1 from Brodalumab_HeavyChain1
  source 1..1326: mol_type = other RNA
caggtgcagctggtccagagcggcgccgaggtgaagaagcccggggcctccgtgaaggtcagctgcaaggcgtccggctacaccttcacccgctacgggatcagctgggtgcggcaggccccgggccaggggctcgagtggatgggctggatctccacgtacagcggcaacaccaactacgcccagaagctgcaggggcgcgtgaccatgaccacggacacctccaccagcaccgcctacatggagctgcggtccctccgcagcgacgacacggccgtctactactgcgcgcggcgccagctgtacttcgactactggggccaggggaccctggtgaccgtgtccagcgcctccaccaagggccccagcgtcttccccctcgccccctgctcccggagcacgtccgagagcaccgccgcgctggggtgcctggtgaaggactacttcccggagcccgtgaccgtctcctggaacagcggcgccctcaccagcggcgtgcacacgttccccgccgtgctgcagtccagcgggctgtactccctcagctccgtcgtgaccgtgcccagctccaacttcggcacccagacctacacgtgcaacgtcgaccacaagccgagcaacaccaaggtggacaagaccgtggagcgcaagtgctgcgtcgagtgcccgccctgccccgccccgcccgtggccgggccctccgtgttcctgttcccgcccaagcccaaggacaccctgatgatcagccggacgcccgaggtgacctgcgtcgtcgtggacgtgtcccacgaggaccccgaggtccagttcaactggtacgtggacggcgtggaggtccacaacgcgaagaccaagccgcgcgaggagcagttcaacagcaccttccgggtggtgtccgtcctcacggtggtgcaccaggactggctgaacggcaaggagtacaagtgcaaggtcagcaacaaggggctgcccgcccccatcgagaagaccatctccaagaccaagggccagccccgcgagccccaggtgtacaccctcccgcccagccgggaggagatgacgaagaaccaggtgtccctgacctgcctggtcaaggggttctaccccagcgacatcgccgtggagtgggagtccaacggccagcccgagaacaactacaagaccaccccgcccatgctcgacagcgacgggagcttcttcctgtactccaagctgacggtggacaagagccgctggcagcagggcaacgtcttctcctgcagcgtgatgcacgaggccctccacaaccactacacccagaagtccctgagcctgtcccccggcaag

SEQ ID NO: 7763 - RNA, 642 nt, synthetic construct
  misc_feature 1..642: note = derived and/or modified sequence opt1 from Brodalumab_LightChain1
  source 1..642: mol_type = other RNA
gagatcgtgatgacccagagccccgccaccctgtccgtcagcccgggcgagcgggccacgctctcctgccgggcgagccagtccgtgagctccaacctggcctggttccagcagaagcccgggcaggcgccccgccccctgatctacgacgccagcacccgggccaccggcgtgccggcccgcttctccgggagcggctccgggaccgacttcacgctcaccatcagctccctgcagagcgaggacttcgccgtctactactgccagcagtacgacaactggcccctgaccttcggcggcgggaccaaggtggagatcaagcggacggtggccgccccctccgtcttcatcttcccgcccagcgacgagcagctcaagtccggcaccgcgagcgtggtgtgcctgctgaacaacttctacccccgcgaggccaaggtccagtggaaggtggacaacgccctccagtccgggaacagccaggagagcgtgaccgagcaggactccaaggacagcacctactccctgagctccacgctgaccctcagcaaggccgactacgagaagcacaaggtctacgcctgcgaggtgacccaccagggcctgtccagccccgtgaccaagtccttcaaccgcggggagtgc

SEQ ID NO: 7764 - RNA, 756 nt, synthetic construct
  misc_feature 1..756: note = derived and/or modified sequence opt1 from Brolucizumab_HeavyChain1
  source 1..756: mol_type = other RNA
atggagatcgtgatgacccagagcccctccaccctgagcgcgtccgtcggcgaccgcgtgatcatcacgtgccaggccagcgagatcatccactcctggctcgcgtggtaccagcagaagccggggaaggcccccaagctgctgatctacctcgccagcaccctggcctccggcgtgcccagccggttctccgggagcggctccggggccgagttcaccctgaccatcagctccctccagcccgacgacttcgcgacgtactactgccagaacgtctacctggccagcaccaacggcgccaacttcggccaggggaccaagctgaccgtgctcggcgggggcgggggctccggcgggggcgggagcggcggcgggggctccgggggcgggggcagcgaggtgcagctggtcgagtccggcgggggcctggtgcagcccgggggcagcctccgcctgagctgcacggcctccgggttcagcctgaccgactactactacatgacctgggtgcggcaggcgccgggcaagggcctcgagtgggtcgggttcatcgaccccgacgacgacccctactacgccacctgggccaagggccgcttcacgatctcccgggacaacagcaagaacaccctgtacctgcagatgaactccctccgcgccgaggacaccgccgtgtactactgcgccgggggcgaccacaacagcgggtggggcctggacatctggggccaggggaccctggtgacggtctccagc

SEQ ID NO: 7765 - RNA, 756 nt, synthetic construct; identical to SEQ ID NO: 7764
  misc_feature 1..756: note = derived and/or modified sequence opt1 from Brolucizumab_scFv_fragment
  source 1..756: mol_type = other RNA

SEQ ID NO: 7766 - RNA, 1341 nt, synthetic construct
  misc_feature 1..1341: note = derived and/or modified sequence opt1 from Brontictuzumab_HeavyChain1
  source 1..1341: mol_type = other RNA
caggtgcagctggtccagagcggcgccgaggtgaagaagcccggggcctccgtgaagatcagctgcaaggtctccggctacaccctccgcgggtactggatcgagtgggtgcggcaggcgccgggcaaggggctggagtggatcggccagatcctgcccggcaccgggcgcacgaactacaacgagaagttcaagggccgggtgaccatgaccgccgacaccagcacggacaccgcctacatggagctctccagcctgcgctccgaggacaccgccgtctactactgcgcccggttcgacgggaactacggctactacgcgatggactactgggggcagggcaccacggtgaccgtgagctccgccagcaccaagggcccctccgtcttccccctggccccgtgcagccgctccaccagcgagtccacggccgcgctcgggtgcctggtgaaggactacttccccgagcccgtgaccgtcagctggaactccggcgccctgaccagcggggtgcacaccttccccgccgtgctccagtccagcggcctgtacagcctgtccagcgtcgtgacggtgccgtccagcaacttcggcacccagacctacacgtgcaacgtcgaccacaagccctccaacaccaaggtggacaagaccgtggagcggaagtgctgcgtcgagtgcccgccctgccccgccccgcccgtggccgggcccagcgtgttcctcttcccgcccaagcccaaggacaccctgatgatctcccgcacccccgaggtcacgtgcgtggtcgtggacgtgagccacgaggaccccgaggtccagttcaactggtacgtggacggcgtggaggtccacaacgcgaagaccaagccccgggaggagcagttcaactccaccttccgcgtggtgagcgtcctgaccgtggtgcaccaggactggctcaacgggaaggagtacaagtgcaaggtctccaacaagggcctgcccgcccccatcgagaagacgatcagcaagaccaaggggcagccgcgggagccccaggtgtacaccctgccgccctcccgcgaggagatgaccaagaaccaggtgagcctcacgtgcctggtcaagggcttctacccctccgacatcgccgtggagtgggagagcaacggccagcccgagaacaactacaagaccacgcccccgatgctggactccgacgggagcttcttcctctactccaagctgaccgtggacaagagccggtggcagcagggcaacgtcttcagctgctccgtgatgcacgaggccctgcacaaccactacacccagaagtccctcagcctgagccccgggaag

SEQ ID NO: 7767 - RNA, 645 nt, synthetic construct
  misc_feature 1..645: note = derived and/or modified sequence opt1 from Brontictuzumab_LightChain1
  source 1..645: mol_type = other RNA
caggccgtggtcacccaggagcccagcctgaccgtgtccccgggcgggacggtgaccctgacctgccgcagctccaccggcgccgtcacgaccagcaactacgcgaactggttccagcagaagcccgggcaggcgccccggaccctcatcggcgggaccaacaaccgcgcccccggcgtgccggcccggttctccggcagcctgctcgggggcaaggccgccctgacgctgtccggggcccagcccgaggacgaggccgagtactactgcgccctctggtacagcaaccactgggtgttcggcgggggcaccaagctgaccgtcctgggccagcccaaggcggccccctccgtgaccctcttcccgcccagctccgaggagctgcaggccaacaaggccacgctggtgtgcctcgtcagcgacttctaccccggggccgtgaccgtggcgtggaaggccgacggctcccccgtcaaggtgggggtggagaccaccaagccgagcaagcagtccaacaacaagtacgccgccagctcctacctgagcctgacgcccgagcagtggaagtcccaccgcagctacagctgccgggtcacccacgagggctccaccgtggagaagaccgtggcccccgcggagtgcagc

SEQ ID NO: 7768 - RNA, 1332 nt, synthetic construct
  misc_feature 1..1332: note = derived and/or modified sequence opt1 from BTT-1023_HeavyChain1
  source 1..1332: mol_type = other RNA
caggtgcagctggtcgagagcggcgggggcgtggtgcagcccgggcgctccctccggctgagctgcgccgcctccggcttcaccttcttcagctacgcgatgcactgggtccgccagacccccgggaagggcctggagtgggtggccgtgatctggttcgacggctccaacgagaactacgtcgacagcgtgaaggggcggttcacgatctcccgcgacaacagcaagaacaccctctacctgcagatgaacaccctgcgggccgaggacaccgccgtgtactactgcgcccgcgacgcgtggtcctacttcgactactggggccaggggacgctcgtcaccgtgagctccgccagcaccaagggcccctccgtgttccccctggccccctgcagccggtccaccagcgagtccacggccgcgctggggtgcctcgtcaaggactacttcccggagcccgtgaccgtgagctggaactccggcgccctgaccagcggcgtccacaccttccccgccgtgctgcagagctccgggctctacagcctgtccagcgtggtcacggtgccctccagctccctgggcaccaagacctacacgtgcaacgtggaccacaagccgagcaacaccaaggtcgacaagcgcgtggagtccaagtacgggccgccctgcccgccctgccccgcccccgagttcgccggcggccccagcgtgttcctcttcccgcccaagcccaaggacaccctgatgatctcccggacccccgaggtgacctgcgtcgtcgtggacgtgagccaggaggaccccgaggtccagttcaactggtacgtggacggggtggaggtccacaacgcgaagacgaagccccgcgaggagcagttcaactccacctaccgggtggtgagcgtcctgaccgtgctccaccaggactggctgaacggcaaggagtacaagtgcaaggtgtccaacaaggggctgcccagctccatcgagaagaccatcagcaaggccaagggccagccccgcgagccgcaggtctacacgctcccgccctcccaggaggagatgaccaagaaccaggtgagcctgacctgcctggtgaaggggttctaccccagcgacatcgccgtcgagtgggagtccaacggccagcccgagaacaactacaagaccacgccgcccgtgctcgacagcgacggctccttcttcctgtacagccggctgaccgtggacaagtcccgctggcaggaggggaacgtcttcagctgctccgtgatgcacgaggccctccacaaccactacacccagaagtccctgagcctgagcctcggcaag

SEQ ID NO: 7769 - RNA, 642 nt, synthetic construct
  misc_feature 1..642: note = derived and/or modified sequence opt1 from BTT-1023_LightChain1
  source 1..642: mol_type = other RNA
gtgatccagctgacccagagcccctccagcctctccgccagcgtcggcgaccgcgtgaccatcacgtgccgggcctcccaggggatcagccgcgcgctggcctggtaccagcagaagccgggcaaggggcccaagctgctcatctacgacgcctccagcctggagtccggcgtgcccagccggttctccgggagcggctccggcaccgacttcaccctgaccatcagctccctccagcccgaggacttcgccacgtactactgccagcagttcaacagctacccgctgaccttcgggggcgggaccaaggtcgagatcaagcgcaccgtggccgcgccctccgtgttcatcttcccgcccagcgacgagcagctgaagtccggcacggccagcgtcgtgtgcctcctgaacaacttctacccccgggaggccaaggtgcagtggaaggtcgacaacgccctgcagagcgggaactcccaggagagcgtgaccgagcaggactccaaggacagcacctactccctcagctccaccctgacgctgagcaaggcggactacgagaagcacaaggtgtacgcctgcgaggtcacccaccagggcctctccagccccgtgaccaagtccttcaaccgcggcgagtgc

SEQ ID NO: 7770 - RNA, 1341 nt, synthetic construct
  misc_feature 1..1341: note = derived and/or modified sequence opt1 from Burosumab_HeavyChain1
  source 1..1341: mol_type = other RNA
caggtgcagctggtccagagcggcgccgaggtgaagaagcccggggcctccgtgaaggtcagctgcaaggcgtccggctacaccttcaccaaccactacatgcactgggtgcgccaggccccggggcagggcctcgagtggatggggatcatcaaccccatcagcggctccacgagcaacgcccagaagttccagggccgggtgaccatgacccgcgacacctccacgagcaccgtctacatggagctgtccagcctgcggtccgaggacaccgccgtgtactactgcgcccgcgacatcgtggacgcgttcgacttctgggggcagggcaccatggtcacggtgagctccgccagcaccaaggggccctccgtgttccccctcgccccgagctccaagagcacctccggcgggaccgccgcgctgggctgcctggtcaaggactacttccccgagcccgtgacggtgagctggaacagcggcgccctcacctccggggtccacaccttccccgccgtgctgcagagctccggcctgtacagcctctccagcgtggtcaccgtgccgtccagctccctggggacgcagacctacatctgcaacgtgaaccacaagcccagcaacaccaaggtcgacaagaaggtggagcccaagtcctgcgacaagacccacacgtgcccgccctgccccgcccccgagctgctcggcggccccagcgtgttcctgttcccgcccaagcccaaggacaccctgatgatctcccggacccccgaggtgacctgcgtcgtcgtggacgtgagccacgaggacccggaggtcaagttcaactggtacgtggacggggtggaggtccacaacgccaagacgaagccccgcgaggagcagtacaactccacctaccgggtggtgagcgtcctcaccgtgctgcaccaggactggctgaacggcaaggagtacaagtgcaaggtgtccaacaaggcgctccccgcccccatcgagaagaccatcagcaaggccaaggggcagccgcgcgagccccaggtctacacgctgccgccctcccgggacgagctgaccaagaaccaggtgagcctgacctgcctcgtgaagggcttctaccccagcgacatcgccgtcgagtgggagtccaacgggcagcccgagaacaactacaagaccacgcccccggtgctggacagcgacggctccttcttcctctacagcaagctgaccgtggacaagtcccgctggcagcagggcaacgtcttcagctgctccgtgatgcacgaggccctgcacaaccactacacccagaagtccctcagcctgagccccgggaag

SEQ ID NO: 7771 - RNA, 639 nt, synthetic construct
  misc_feature 1..639: note = derived and/or modified sequence opt1 from Burosumab_LightChain1
  source 1..639: mol_type = other RNA
gccatccagctgacccagagcccctccagcctctccgccagcgtgggcgaccgggtcaccatcacgtgccgggcgtcccaggggatcagctccgccctggtgtggtaccagcagaagccgggcaaggcccccaagctgctcatctacgacgccagctccctggagagcggggtgccctcccgcttcagcggctccgggagcggcaccgacttcaccctgaccatctccagcctccagcccgaggacttcgccacgtactactgccagcagttcaacgactacttcaccttcggcccggggaccaaggtcgacatcaagcggaccgtggcggccccctccgtgttcatcttcccgcccagcgacgagcagctgaagtccggcacggccagcgtcgtgtgcctgctcaacaacttctacccccgcgaggccaaggtgcagtggaaggtcgacaacgcgctgcagagcgggaactcccaggagagcgtgaccgagcaggactccaaggacagcacctactccctgagctccaccctcacgctgagcaaggccgactacgagaagcacaaggtgtacgcctgcgaggtcacccaccagggcctgtccagccccgtgaccaagtccttcaaccgcggggagtgc

SEQ ID NO: 7772 - RNA, 1344 nt, synthetic construct
  misc_feature 1..1344: note = derived and/or modified sequence opt1 from Canakinumab_HeavyChain1
  source 1..1344: mol_type = other RNA
caggtgcagctggtcgagagcggcgggggcgtggtgcagcccgggcgctccctccggctgagctgcgccgcctccggcttcaccttcagcgtctacgggatgaactgggtgcgccaggcgccgggcaagggcctggagtgggtggccatcatctggtacgacggggacaaccagtactacgccgactccgtcaagggccggttcaccatcagccgcgacaactccaagaacacgctctacctgcagatgaacgggctgcgggccgaggacaccgccgtgtactactgcgcgcgcgacctccggaccggccccttcgactactgggggcagggcaccctggtgacggtcagctccgccagcaccaagggcccctccgtgttccccctggccccgagctccaagagcacctccgggggcaccgccgcgctcgggtgcctggtgaaggactacttccccgagcccgtcacggtgagctggaactccggcgccctgaccagcggcgtgcacaccttccccgccgtcctccagtccagcgggctgtacagcctgtccagcgtggtgaccgtcccgtccagctccctcggcacgcagacctacatctgcaacgtgaaccacaagcccagcaacaccaaggtggacaagcgcgtcgagcccaagtcctgcgacaagacccacacgtgcccgccctgccccgcccccgagctgctcgggggccccagcgtgttcctgttcccgcccaagcccaaggacaccctgatgatctcccggacccccgaggtgacctgcgtcgtggtcgacgtgagccacgaggacccggaggtgaagttcaactggtacgtcgacggggtggaggtgcacaacgccaagacgaagccccgcgaggagcagtacaactccacctaccgggtcgtgagcgtgctgaccgtcctccaccaggactggctgaacggcaaggagtacaagtgcaaggtgtccaacaaggcgctgcccgcccccatcgagaagaccatcagcaaggccaagggccagccgcgcgagccccaggtgtacacgctcccgccctcccgggaggagatgaccaagaaccaggtcagcctgacctgcctggtgaaggggttctacccctccgacatcgccgtggagtgggagagcaacggccagcccgagaacaactacaagaccacgcccccggtcctcgactccgacgggagcttcttcctgtacagcaagctgaccgtggacaagtcccgctggcagcagggcaacgtgttcagctgctccgtcatgcacgaggccctccacaaccactacacccagaagtccctgagcctgagccccgggaag

SEQ ID NO: 7773 - RNA, 1344 nt, synthetic construct; identical to SEQ ID NO: 7772
  misc_feature 1..1344: note = derived and/or modified sequence opt1 from Canakinumab_HeavyChain
  source 1..1344: mol_type = other RNA

SEQ ID NO: 7774 - RNA, 642 nt, synthetic construct
  misc_feature 1..642: note = derived and/or modified sequence opt1 from Canakinumab_LightChain1
  source 1..642: mol_type = other RNA
gagatcgtgctgacccagagccccgacttccagtccgtcaccccgaaggagaaggtgacgatcacgtgccgcgccagccagtccatcggcagctccctccactggtaccagcagaagcccgaccagagccccaagctgctgatcaagtacgcctcccagagcttctccggggtgcccagccggttctccggcagcgggtccggcaccgacttcaccctcaccatcaacagcctggaggcggaggacgccgccgcctactactgccaccagtccagctccctgccgttcaccttcgggcccggcaccaaggtcgacatcaagcgcaccgtggccgcgcccagcgtgttcatcttcccgccctccgacgagcagctcaagagcggcacggccagcgtcgtgtgcctgctgaacaacttctacccccgggaggccaaggtgcagtggaaggtcgacaacgccctccagtccgggaacagccaggagtccgtgaccgagcaggacagcaaggactccacctacagcctgtccagcaccctgacgctctccaaggcggactacgagaagcacaaggtgtacgcctgcgaggtcacccaccagggcctgagctcccccgtgaccaagagcttcaaccgcggggagtgc

SEQ ID NO: 7775 - RNA, 642 nt, synthetic construct; identical to SEQ ID NO: 7774
  misc_feature 1..642: note = derived and/or modified sequence opt1 from Canakinumab_LightChain
  source 1..642: mol_type = other RNA

SEQ ID NO: 7776 - RNA, 1182 nt, synthetic construct
  misc_feature 1..1182: note = derived and/or modified sequence opt1 from Canakinumab_LightChain_variant_8836_L
  source 1..1182: mol_type = other RNA
caggtgcagctggtcgagagcggcgggggcgtggtgcagcccgggcgctccctccggctgagctgcgccgcctccggcttcaccttcagcgtctacgggatgaactgggtgcgccaggcgccgggcaagggcctggagtgggtggccatcatctggtacgacggggacaaccagtactacgccgactccgtcaagggccggttcaccatcagccgcgacaactccaagaacacgctctacctgcagatgaacgggctgcgggccgaggacaccgccgtgtactactgcgcgcgcgacctccggaccggccccttcgactactgggggcagggcaccctggtgacggtcagctccgccagcaccaagggcccctccgtgttccccctggccccgagctccaagagcacctccgggggcaccgccgcgctcgggtgcctggtgaaggactacttccccgagcccgtcacggtgagctggaactccggcgccctgaccagcggcgtgcacaccttccccgccgtcctccagtccagcgggctggagatcgtgctgacccagagcccggacttccagtccgtgacgcccaaggagaaggtcaccatcacgtgccgcgccagccagtccatcggcagctccctccactggtaccagcagaagcccgaccagagccccaagctgctgatcaagtacgcctcccagagcttctccggggtgccgagccggttctccggcagcgggtccggcaccgacttcaccctcaccatcaacagcctggaggcggaggacgccgccgcctactactgccaccagtccagctccctgcccttcaccttcggccccgggaccaaggtggacatcaagcgcacggtcgccgcgcccagcgtgttcatcttcccgccctccgacgagcagctcaagagcggcaccgccagcgtggtctgcctgctgaacaacttctacccccgggaggccaaggtgcagtggaaggtcgacaacgccctccagtccgggaacagccaggagtccgtgaccgagcaggacagcaaggactccacctacagcctgtccagcacgctgaccctctccaaggccgactacgagaagcacaaggtgtacgcgtgcgaggtcacccaccagggcctgagctcccccgtgaccaagagcttcaaccgcggggagtgc

SEQ ID NO: 7777 - RNA, 1197 nt, synthetic construct
  misc_feature 1..1197: note = derived and/or modified sequence opt1 from Cantuzumab_HeavyChain1
  source 1..1197: mol_type = other RNA
atcgacaccaccacgggcgagcccacctacgcccagaagttccaggggcgcatcgccttcagcctggagacctccgcgagcaccgcctacctccagatcaagtccctcaagagcgaggacacggccacctacttctgcgcccggcgcggcccgtacaactggtacttcgacgtgtgggggcagggcaccaccgtcacggtgtccagcgcctccaccaaggggcccagcgtgttccccctggcgccctccagcaagtccaccagcggcggcaccgccgccctggggtgcctggtcaaggactacttcccggagcccgtgacggtgtcctggaacagcggcgccctgacctccggggtccacaccttccccgcggtgctccagagctccggcctgtacagcctgtccagcgtggtcaccgtgcccagctccagcctcgggacgcagacctacatctgcaacgtgaaccacaagccgtccaacaccaaggtcgacaagaaggtggagcccaagagctgcgacaagacccacacgtgcccgccctgccccgcccccgagctgctgggcggcccctccgtgttcctcttcccgcccaagcccaaggacaccctgatgatcagccggacccccgaggtgacctgcgtcgtggtcgacgtgtcccacgaggaccccgaggtgaagttcaactggtacgtcgacggggtggaggtgcacaacgccaagacgaagccgcgcgaggagcagtacaacagcacctaccgggtcgtgtccgtcctgaccgtgctccaccaggactggctgaacggcaaggagtacaagtgcaaggtgagcaacaaggccctgcccgcccccatcgagaagaccatctccaaggcgaaggggcagccccgcgagccgcaggtctacacgctcccgcccagccgggacgagctgaccaagaaccaggtgtccctgacctgcctcgtgaagggcttctaccccagcgacatcgccgtcgagtgggagtccaacggccagcccgagaacaactacaagaccacgccgcccgtgctggacagcgacgggtccttcttcctgtacagcaagctcaccgtggacaagtcccgctggcagcagggcaacgtcttcagctgcagcgtgatgcacgaggccctgcacaaccactacacccagaagtccctgagcctctcccccgggaag

SEQ ID NO: 7778 - RNA, 1347 nt, synthetic construct
  misc_feature 1..1347: note = derived and/or modified sequence opt1 from Cantuzumab_HeavyChain
  source 1..1347: mol_type = other RNA
caggtgcagctggtccagagcggcgccgaggtgaagaagcccggggagaccgtgaagatctcctgcaaggccagcgactacaccttcacgtactacggcatgaactgggtcaagcaggcgccggggcagggcctcaagtggatggggtggatcgacaccaccaccggcgagcccacgtacgcccagaagttccagggccgcatcgccttctccctggagaccagcgcctccaccgcctacctgcagatcaagagcctcaagtccgaggacaccgcgacgtacttctgcgcccggcgcgggccctacaactggtacttcgacgtgtggggccaggggaccaccgtgaccgtcagctccgccagcacgaagggcccctccgtgttcccgctggcccccagctccaagagcacctccgggggcaccgcggccctgggctgcctcgtgaaggactacttccccgagcccgtcaccgtgagctggaactccggggccctgacgagcggcgtgcacaccttcccggccgtcctgcagtccagcgggctctacagcctgtccagcgtggtgaccgtcccctccagctccctgggcacccagacgtacatctgcaacgtgaaccacaagcccagcaacaccaaggtggacaagaaggtcgagcccaagtcctgcgacaagacccacacgtgcccgccctgccccgcccccgagctcctgggcgggccgagcgtgttcctgttcccgcccaagcccaaggacaccctcatgatctcccggacccccgaggtgacctgcgtcgtggtggacgtcagccacgaggaccccgaggtgaagttcaactggtacgtcgacggcgtggaggtgcacaacgcgaagaccaagccccgcgaggagcagtacaactccacgtaccgggtcgtgagcgtgctgaccgtcctgcaccaggactggctcaacgggaaggagtacaagtgcaaggtgtccaacaaggccctgcccgccccgatcgagaagaccatcagcaaggccaagggccagccccgcgagccccaggtgtacaccctgcccccgtcccgggacgagctcacgaagaaccaggtcagcctgacctgcctggtgaaggggttctacccctccgacatcgccgtggagtgggagagcaacggccagcccgagaacaactacaagaccaccccgcccgtcctcgactccgacggcagcttcttcctgtacagcaagctgacggtggacaagtcccgctggcagcaggggaacgtgttcagctgctccgtcatgcacgaggcgctccacaaccactacacccagaagtccctgagcctgagccccggcaag

SEQ ID NO: 7779 - RNA, 657 nt, synthetic construct
  misc_feature 1..657: note = derived and/or modified sequence opt1 from Cantuzumab_LightChain1
  source 1..657: mol_type = other RNA
gacatcgtgatgacccagagccccctgtccgtcccggtgacccccggcgagcccgtgagcatctcctgccgcagctccaagagcctcctgcactccaacgggaacacgtacctgtactggttcctccagcggcccggccagagcccgcagctgctgatctaccgcatgtccaacctcgtcagcggggtgcccgaccggttctccggcagcgggtccggcaccgccttcaccctgcgcatcagccgggtggaggccgaggacgtcggcgtgtactactgcctgcagcacctcgagtaccccttcaccttcgggcccggcacgaagctggagctgaagcgcaccgtggcggccccgtccgtcttcatcttcccgcccagcgacgagcagctcaagtccgggaccgccagcgtggtgtgcctgctgaacaacttctacccccgggaggccaaggtccagtggaaggtggacaacgccctccagtccggcaacagccaggagagcgtgaccgagcaggactccaaggacagcacgtactccctgagctccaccctgaccctcagcaaggcggactacgagaagcacaaggtctacgcctgcgaggtgacccaccaggggctgtccagccccgtgacgaagtccttcaaccgcggcgagtgc

SEQ ID NO: 7780 - RNA, 1344 nt, synthetic construct
  misc_feature 1..1344: note = derived and/or modified sequence opt1 from Cantuzumab_mertansine_HeavyChain1
  source 1..1344: mol_type = other RNA
gtgcagctggtccagagcggcgccgaggtgaagaagcccggggagaccgtgaagatctcctgcaaggccagcgactacaccttcacgtactacggcatgaactgggtcaagcaggcgccggggcagggcctcaagtggatggggtggatcgacaccaccaccggcgagcccacgtacgcccagaagttccagggccgcatcgccttctccctggagaccagcgcctccaccgcctacctgcagatcaagagcctcaagtccgaggacaccgcgacgtacttctgcgcccggcgcgggccctacaactggtacttcgacgtgtggggccaggggaccaccgtgaccgtcagctccgccagcacgaagggcccctccgtgttcccgctggcccccagctccaagagcacctccgggggcaccgcggccctgggctgcctcgtgaaggactacttccccgagcccgtcaccgtgagctggaactccggggccctgacgagcggcgtgcacaccttcccggccgtcctgcagtccagcgggctctacagcctgtccagcgtggtgaccgtcccctccagctccctgggcacccagacgtacatctgcaacgtgaaccacaagcccagcaacaccaaggtggacaagaaggtcgagcccaagtcctgcgacaagacccacacgtgcccgccctgccccgcccccgagctcctgggcgggccgagcgtgttcctgttcccgcccaagcccaaggacaccctcatgatctcccggacccccgaggtgacctgcgtcgtggtggacgtcagccacgaggaccccgaggtgaagttcaactggtacgtcgacggcgtggaggtgcacaacgcgaagaccaagccccgcgaggagcagtacaactccacgtaccgggtcgtgagcgtgctgaccgtcctgcaccaggactggctcaacgggaaggagtacaagtgcaaggtgtccaacaaggccctgcccgccccgatcgagaagaccatcagcaaggccaagggccagccccgcgagccccaggtgtacaccctgcccccgtcccgggacgagctcacgaagaaccaggtcagcctgacctgcctggtgaaggggttctacccctccgacatcgccgtggagtgggagagcaacggccagcccgagaacaactacaagaccaccccgcccgtcctcgactccgacggcagcttcttcctgtacagcaagctgacggtggacaagtcccgctggcagcaggggaacgtgttcagctgctccgtcatgcacgaggcgctccacaaccactacacccagaagtccctgagcctgagccccggcaag

SEQ ID NO: 7781 - RNA, 657 nt, synthetic construct; identical to SEQ ID NO: 7779
  misc_feature 1..657: note = derived and/or modified sequence opt1 from Cantuzumab_mertansine_LightChain1
  source 1..657: mol_type = other RNA

SEQ ID NO: 7782 - RNA, 1347 nt, synthetic construct; identical to SEQ ID NO: 7778
  misc_feature 1..1347: note = derived and/or modified sequence opt1 from Cantuzumab_ravtansine_HeavyChain1
  source 1..1347: mol_type = other RNA

SEQ ID NO: 7783 - RNA, 657 nt, synthetic construct; identical to SEQ ID NO: 7779
  misc_feature 1..657: note = derived and/or modified sequence opt1 from Cantuzumab_ravtansine_LightChain1
  source 1..657: mol_type = other RNA

SEQ ID NO: 7784 - RNA, 777 nt, synthetic construct
  misc_feature 1..777: note = derived and/or modified sequence opt1 from Caplacizumab
  source 1..777: mol_type = other RNA
gaggtgcagctggtcgagagcggcgggggcctcgtgcagcccgggggctccctgcgcctgagctgcgccgcctccgggcggaccttcagctacaacccgatgggctggttccgccaggcgcccggcaaggggcgggagctcgtggccgccatctcccgcaccggcgggagcacgtactaccccgactccgtcgagggccggttcaccatcagccgcgacaacgccaagcggatggtgtacctgcagatgaactccctgcgcgccgaggacaccgcggtgtactactgcgccgccgccggggtccgggcggaggacggccgcgtgcggaccctccccagcgagtacacgttctggggccaggggacccaggtgaccgtctccagcgccgccgccgaggtgcagctggtggagtccggcgggggcctggtccagccgggcgggagcctccgcctgtcctgcgccgcgagcggccggaccttctcctacaaccccatggggtggttccgccaggcccccggcaaggggcgggagctggtggccgccatcagccgcacgggcggctccacctactaccccgacagcgtggaggggcggttcaccatcagccgcgacaacgccaagcggatggtctacctccagatgaactccctgcgcgcggaggacaccgccgtgtactactgcgccgccgccggcgtgcgggcggaggacgggcgcgtccgcacgctgccgagcgagtacaccttctggggccaggggacccaggtgaccgtgtccagc

SEQ ID NO: 7785 - RNA, 777 nt, synthetic construct; identical to SEQ ID NO: 7784
  misc_feature 1..777: note = derived and/or modified sequence opt1 from Caplacizumab_HeavyChain1
  source 1..777: mol_type = other RNA

SEQ ID NO: 7786 - RNA, 777 nt, synthetic construct; identical to SEQ ID NO: 7784
  misc_feature 1..777: note = derived and/or modified sequence opt1 from Caplacizumab_HeavyChain1
  source 1..777: mol_type = other RNA

SEQ ID NO: 7787 - RNA, 1347 nt, synthetic construct
  misc_feature 1..1347: note = derived and/or modified sequence opt1 from Carlumab_HeavyChain1
  source 1..1347: mol_type = other RNA
caggtgcagctggtccagagcggcgccgaggtgaagaagcccgggtccagcgtgaaggtctcctgcaaggccagcggcgggaccttctccagctacggcatctcctgggtgcgccaggcgccggggcagggcctcgagtggatgggcgggatcatccccatcttcggcaccgccaactacgcccagaagttccaggggcgggtgacgatcaccgccgacgagagcacctccaccgcctacatggagctgagctccctgcgcagcgaggacacggcggtctactactgcgcccggtacgacggcatctacggggagctcgacttctggggccagggcaccctggtgaccgtgtccagcgcctccaccaaggggcccagcgtcttccccctggccccgtccagcaagtccacgagcggcgggaccgcggccctcggctgcctggtgaaggactacttccccgagcccgtgaccgtcagctggaactccggcgccctgaccagcggggtgcacacgttccccgccgtgctccagtccagcggcctgtactccctgagctccgtcgtgaccgtgccgagctccagcctcgggacccagacctacatctgcaacgtcaaccacaagccctccaacacgaaggtggacaagaaggtggagcccaagagctgcgacaagacccacacgtgcccgccctgccccgcccccgagctgctgggcgggccctccgtcttcctcttcccgcccaagcccaaggacaccctgatgatcagccgcacccccgaggtgacctgcgtggtcgtggacgtctcccacgaggacccggaggtgaagttcaactggtacgtggacggcgtcgaggtgcacaacgcgaagaccaagccccgggaggagcagtacaacagcacctaccgcgtggtctccgtgctgacggtgctccaccaggactggctgaacggcaaggagtacaagtgcaaggtcagcaacaaggccctgcccgcccccatcgagaagaccatctccaaggccaaggggcagccgcgggagccccaggtgtacaccctcccgcccagccgcgacgagctgaccaagaaccaggtgagcctgacgtgcctcgtcaagggcttctacccctccgacatcgccgtggagtgggagagcaacgggcagcccgagaacaactacaagaccacgcccccggtgctggactccgacggcagcttcttcctgtactccaagctcaccgtcgacaagagccggtggcagcaggggaacgtgttctcctgcagcgtgatgcacgaggcgctgcacaaccactacacccagaagtccctgagcctctcccccggcaag

SEQ ID NO: 7788 - RNA, 648 nt, synthetic construct
  misc_feature 1..648: note = derived and/or modified sequence opt1 from Carlumab_LightChain1
  source 1..648: mol_type = other RNA
gagatcgtgctgacccagagccccgccaccctctccctgagcccgggcgagcgcgccacgctgtcctgccgggcgagccagtccgtcagcgacgcctacctcgcctggtaccagcagaagcccgggcaggcgccccgcctgctgatctacgacgcctccagccgggccaccggcgtgcccgcccgcttctccgggagcggctccgggaccgacttcaccctcacgatcagctccctggagccggaggacttcgccgtgtactactgccaccagtacatccagctgcacagcttcaccttcggccagggcaccaaggtcgagatcaagcggaccgtggccgcgccctccgtgttcatcttcccgcccagcgacgagcagctcaagtccgggacggccagcgtcgtgtgcctgctgaacaacttctacccccgcgaggccaaggtgcagtggaaggtcgacaacgccctccagtccggcaacagccaggagagcgtgaccgagcaggactccaaggacagcacctactccctgagctccaccctgacgctcagcaaggccgactacgagaagcacaaggtgtacgcgtgcgaggtcacccaccaggggctgtccagccccgtgaccaagtccttcaaccggggcgagtgc

SEQ ID NO: 7789 - RNA, 1353 nt, synthetic construct
  misc_feature 1..1353: note = derived and/or modified sequence opt1 from Cergutuzumab_amunaleukin_HeavyChain1
  source 1..1353: mol_type = other RNA
caggtgcagctggtccagagcggcgccgaggtgaagaagcccggggcctccgtgaaggtcagctgcaaggcgtccggctacaccttcaccgagttcgggatgaactgggtgcgccaggccccgggccaggggctcgagtggatgggctggatcaacacgaagaccggcgaggccacctacgtggaggagttcaaggggcgggtcaccttcacgaccgacaccagcacctccacggcctacatggagctgcgcagcctgcggtccgacgacaccgccgtgtactactgcgcgcgctgggacttcgcctactacgtggaggccatggactactggggccaggggaccaccgtcacggtgagctccgccagcaccaagggcccctccgtgttccccctcgcgcccagctccaagagcacctccgggggcaccgccgccctgggctgcctggtcaaggactacttcccggagcccgtgacggtgagctggaactccggggccctcaccagcggcgtccacaccttccccgccgtgctgcagtccagcgggctgtacagcctctccagcgtggtcaccgtgccctccagctccctgggcacgcagacctacatctgcaacgtgaaccacaagccgagcaacaccaaggtcgacaagaaggtggagcccaagtcctgcgacaagacccacacgtgcccgccctgccccgcgcccgaggccgccggcgggcccagcgtgttcctgttcccgcccaagcccaaggacaccctcatgatctcccggacccccgaggtgacctgcgtcgtcgtggacgtgagccacgaggaccccgaggtcaagttcaactggtacgtggacggcgtggaggtccacaacgccaagacgaagccgcgcgaggagcagtacaactccacctaccgggtggtgagcgtcctgaccgtgctgcaccaggactggctcaacgggaaggagtacaagtgcaaggtgtccaacaaggccctgggcgcgcccatcgagaagaccatcagcaaggccaaggggcagccccgcgagccccaggtctgcacgctgccgccctcccgggacgagctcaccaagaaccaggtgagcctgtcctgcgccgtgaagggcttctaccccagcgacatcgccgtcgagtgggagtccaacggccagcccgagaacaactacaagaccaccccgcccgtgctggacagcgacgggagcttcttcctcgtgtccaagctgacggtcgacaagagccgctggcagcagggcaacgtgttctcctgcagcgtgatgcacgaggccctgcacaaccactacacccagaagtccctcagcctgtcccccgggaag

SEQ ID NO: 7790 - RNA, 1794 nt, synthetic construct
  misc_feature 1..1794: note = derived and/or modified sequence opt1 from Cergutuzumab_amunaleukin_HeavyChain2
  source 1..1794: mol_type = other RNA
caggtgcagctggtccagagcggcgccgaggtgaagaagcccggggcctccgtgaaggtcagctgcaaggcgtccggctacaccttcaccgagttcgggatgaactgggtgcgccaggccccgggccaggggctcgagtggatgggctggatcaacacgaagaccggcgaggccacctacgtggaggagttcaaggggcgggtcaccttcacgaccgacaccagcacctccacggcctacatggagctgcgcagcctgcggtccgacgacaccgccgtgtactactgcgcgcgctgggacttcgcctactacgtggaggccatggactactggggccaggggaccaccgtcacggtgagctccgccagcaccaagggcccctccgtgttccccctcgcgcccagctccaagagcacctccgggggcaccgccgccctgggctgcctggtcaaggactacttcccggagcccgtgacggtgagctggaactccggggccctcaccagcggcgtccacaccttccccgccgtgctgcagtccagcgggctgtacagcctctccagcgtggtcaccgtgccctccagctccctgggcacgcagacctacatctgcaacgtgaaccacaagccgagcaacaccaaggtcgacaagaaggtggagcccaagtcctgcgacaagacccacacgtgcccgccctgccccgcgcccgaggccgccggcgggcccagcgtgttcctgttcccgcccaagcccaaggacaccctcatgatctcccggacccccgaggtgacctgcgtcgtcgtggacgtgagccacgaggaccccgaggtcaagttcaactggtacgtggacggcgtggaggtccacaacgccaagacgaagccgcgcgaggagcagtacaactccacctaccgggtggtgagcgtcctgaccgtgctgcaccaggactggctcaacgggaaggagtacaagtgcaaggtgtccaacaaggccctgggcgcgcccatcgagaagaccatcagcaaggccaaggggcagccccgcgagccccaggtctacacgctgccgccctgccgggacgagctcaccaagaaccaggtgtccctgtggtgcctggtgaagggcttctaccccagcgacatcgccgtcgagtgggagtccaacggccagcccgagaacaactacaagaccaccccgcccgtgctcgacagcgacgggtccttcttcctgtacagcaagctgacggtggacaagagccgctggcagcagggcaacgtcttctcctgcagcgtgatgcacgaggccctccacaaccactacacccagaagtccctgagcctgtcccccgggggcgggggcggcagcgggggcgggggctccgggggcggcgggagcgccccggcgtccagctccaccaagaagacccagctccagctggagcacctcctgctggacctgcagatgatcctcaacggcatcaacaactacaagaaccccaagctgacccggatgctgacggccaagttcgccatgcccaagaaggccaccgagctcaagcacctccagtgcctggaggaggagctgaagcccctggaggaggtgctgaacggggcccagagcaagaacttccacctccgcccgcgggacctgatctccaacatcaacgtcatcgtgctggagctcaagggcagcgagaccaccttcatgtgcgagtacgcggacgagacggccaccatcgtggagttcctgaaccgctggatcaccttcgcccagtccatcatcagcaccctgacg

SEQ ID NO: 7791 - RNA, 645 nt, synthetic construct
  misc_feature 1..645: note = derived and/or modified sequence opt1 from Cergutuzumab_amunaleukin_LightChain1
  source 1..645: mol_type = other RNA
gacatccagatgacgcagagcccctccagcctgtccgccagcgtgggcgaccgcgtcaccatcacgtgcaaggcctccgcggccgtggggacctacgtggcctggtaccagcagaagccgggcaaggcccccaagctcctgatctacagcgcctcctaccggaagcgcggggtccccagccggttctccggcagcgggtccggcaccgacttcaccctgacgatcagctccctccagcccgaggacttcgcgacctactactgccaccagtactacacctacccgctgttcaccttcggccaggggacgaagctggagatcaagcgcaccgtggccgcccccagcgtgttcatcttcccgccctccgacgagcagctcaagagcggcaccgcctccgtcgtgtgcctgctgaacaacttctacccccgggaggcgaaggtgcagtggaaggtcgacaacgccctccagagcgggaactcccaggagagcgtgaccgagcaggacagcaaggactccacgtacagcctgtccagcaccctgaccctctccaaggccgactacgagaagcacaaggtgtacgcctgcgaggtcacccaccagggcctgagctcccccgtgaccaagagcttcaaccgcggggagtgc

SEQ ID NO: 7792 - RNA, 687 nt, synthetic construct
  misc_feature 1..687: note = derived and/or modified sequence opt1 from Certolizumab_pegol_HeavyChain1
  source 1..687: mol_type = other RNA
gaggtgcagctggtcgagagcggcgggggcctcgtgcagcccgggggctccctgcgcctgagctgcgccgcctccgggtacgtgttcaccgactacggcatgaactgggtccggcaggcgccgggcaaggggctcgagtggatgggctggatcaacacctacatcggggagcccatctacgccgacagcgtgaagggccgcttcaccttctccctggacaccagcaagtccaccgcctacctgcagatgaacagcctccgggccgaggacaccgccgtgtactactgcgcgcgcgggtaccggtcctacgccatggactactggggccagggcacgctggtcaccgtgagctccgccagcaccaaggggccctccgtgttccccctggccccgagctccaagagcacctccggcgggacggcggccctcggctgcctggtcaaggactacttccccgagcccgtgaccgtgagctggaactccggcgccctgaccagcggggtccacaccttccccgccgtgctccagagctccggcctgtacagcctgtccagcgtggtcacggtgccgtccagctccctcgggacccagacctacatctgcaacgtgaaccacaagcccagcaacaccaaggtcgacaagaaggtggagcccaagtcctgcgacaagacgcacacgtgcgccgcg

SEQ ID NO: 7793 - RNA, 687 nt, synthetic construct; identical to SEQ ID NO: 7792
  misc_feature 1..687: note = derived and/or modified sequence opt1 from Certolizumab_pegol_HeavyChain
  source 1..687: mol_type = other RNA

SEQ ID NO: 7794 - RNA, 642 nt, synthetic construct
  misc_feature 1..642: note = derived and/or modified sequence opt1 from Certolizumab_pegol_LightChain1
  source 1..642: mol_type = other RNA
gacatccagatgacccagagcccctccagcctgtccgccagcgtgggcgaccgcgtcaccatcacgtgcaaggcctcccagaacgtggggaccaacgtggcgtggtaccagcagaagccgggcaaggcccccaaggccctcatctacagcgcctccttcctgtacagcggggtcccctaccggttctccggcagcgggtccggcaccgacttcaccctgacgatcagctccctccagcccgaggacttcgccacctactactgccagcagtacaacatctacccgctgaccttcggccaggggaccaaggtggagatcaagcgcacggtggcggcccccagcgtcttcatcttcccgccctccgacgagcagctcaagagcggcaccgcctccgtggtgtgcctgctgaacaacttctacccccgggaggccaaggtccagtggaaggtggacaacgcgctgcagagcgggaactcccaggagagcgtgaccgagcaggacagcaaggactccacctacagcctctccagcacgctgaccctgtccaaggccgactacgagaagcacaaggtctacgcctgcgaggtgacccaccagggcctcagctcccccgtgaccaagagcttcaaccgcggggagtgc

SEQ ID NO: 7795 - RNA, 642 nt, synthetic construct; identical to SEQ ID NO: 7794
  misc_feature 1..642: note = derived and/or modified sequence opt1 from Certolizumab_pegol_LightChain
  source 1..642: mol_type = other RNA

SEQ ID NO: 7796 - RNA, 1356 nt, synthetic construct
  misc_feature 1..1356: note = derived and/or modified sequence opt1 from Cetuximab_HeavyChain
  source 1..1356: mol_type = other RNA
caggtgcagctgaagcagagcggccccgggctcgtccagccctcccagagcctgtccatcacgtgcaccgtgagcggcttctccctgaccaactacggggtgcactgggtccgccagagccccggcaaggggctcgagtggctgggcgtgatctggtccggcgggaacaccgactacaacacccccttcaccagccggctgtccatcaacaaggacaacagcaagtcccaggtgttcttcaagatgaacagcctccagtccaacgacacggccatctactactgcgcccgcgcgctgacctactacgactacgagttcgcctactggggccaggggaccctggtcaccgtgagcgccgcctccacgaagggccccagcgtgttcccgctcgccccctccagcaagtccaccagcgggggcaccgcggccctgggctgcctggtcaaggactacttccccgagcccgtgaccgtgagctggaactccggggccctcacgagcggcgtccacaccttcccggccgtgctgcagtccagcgggctgtactccctcagctccgtggtcaccgtgcccagctccagcctgggcacccagacgtacatctgcaacgtgaaccacaagccctccaacaccaaggtcgacaagcgggtggagcccaagagcccgaagtcctgcgacaagacccacacgtgcccgccctgccccgcgcccgagctgctcggcgggcccagcgtgttcctgttcccgcccaagcccaaggacaccctgatgatctcccgcacccccgaggtgacctgcgtcgtggtcgacgtgagccacgaggaccccgaggtcaagttcaactggtacgtggacggcgtggaggtccacaacgccaagaccaagccccgggaggagcagtacaactccacgtaccgcgtggtgagcgtcctcaccgtgctgcaccaggactggctgaacgggaaggagtacaagtgcaaggtgtccaacaaggccctcccggcccccatcgagaagaccatcagcaaggccaagggccagccccgggagccccaggtctacaccctgccgcccagccgcgacgagctgacgaagaaccaggtgtccctgacctgcctcgtgaaggggttctaccccagcgacatcgcggtcgagtgggagtccaacggccagccggagaacaactacaagaccaccccgcccgtgctggacagcgacggctccttcttcctctacagcaagctgacggtggacaagtcccggtggcagcaggggaacgtcttcagctgctccgtgatgcacgaggccctgcacaaccactacacccagaagtccctcagcctgagccccggcaag

SEQ ID NO: 7797 - RNA, 1347 nt, synthetic construct
  misc_feature 1..1347: note = derived and/or modified sequence opt1 from Cetuximab_HeavyChain_variant
  source 1..1347: mol_type = other RNA
caggtgcagctgaagcagagcggccccgggctcgtccagccgtcccagagcctgtccatcacgtgcaccgtgagcggcttctccctgaccaactacggggtgcactgggtccgccagagccccggcaaggggctcgagtggctgggcgtgatctggtccggcgggaacaccgactacaacacccccttcaccagccggctgtccatcaacaaggacaacagcaagtcccaggtgttcttcaagatgaacagcctccagtccaacgacacggccatctactactgcgcccgcgcgctgacctactacgactacgagttcgcctactggggccaggggaccctggtcaccgtgagcgccgcctccacgaagggccccagcgtgttcccgctcgccccctccagcaagtccaccagcgggggcaccgcggccctgggctgcctggtcaaggactacttccccgagcccgtgaccgtgagctggaactccggggccctcacgagcggcgtccacaccttcccggccgtgctgcagtccagcgggctgtactccctcagctccgtggtcaccgtgcccagctccagcctgggcacccagacgtacatctgcaacgtgaaccacaagccctccaacaccaaggtcgacaagaaggtggagcccaagagctgcgacaagacccacacgtgcccgccctgccccgcgcccgagctgctcggcgggccgtccgtgttcctgttcccgcccaagcccaaggacaccctgatgatcagccggacccccgaggtgacctgcgtcgtggtcgacgtgtcccacgaggaccccgaggtcaagttcaactggtacgtggacggcgtggaggtccacaacgccaagaccaagccccgcgaggagcagtacaacagcacgtaccgggtggtgtccgtcctcaccgtgctgcaccaggactggctgaacgggaaggagtacaagtgcaaggtgagcaacaaggccctccccgccccgatcgagaagaccatctccaaggccaagggccagccccgcgagccccaggtctacaccctgcccccgagccgggacgagctgacgaagaaccaggtgagcctgacctgcctcgtgaaggggttctacccctccgacatcgcggtcgagtgggagagcaacggccagcccgagaacaactacaagaccaccccgcccgtgctggactccgacggcagcttcttcctctactccaagctgacggtggacaagagccgctggcagcaggggaacgtcttctcctgcagcgtgatgcacgaggccctgcacaaccactacacccagaagtccctcagcctgtcccccggcaag

SEQ ID NO: 7798 - RNA, 639 nt, synthetic construct
  misc_feature 1..639: note = derived and/or modified sequence opt1 from Cetuximab_LightChain
  source 1..639: mol_type = other RNA
gacatcctgctcacccagagccccgtgatcctgtccgtcagcccgggcgagcgggtgtccttcagctgccgggcctcccagagcatcgggaccaacatccactggtaccagcagcgcacgaacggcagcccccggctgctcatcaagtacgccagcgagtccatcagcgggatcccctcccgcttcagcggctccgggagcggcaccgacttcaccctgtccatcaacagcgtggagtccgaggacatcgcggactactactgccagcagaacaacaactggcccaccacgttcggcgccgggaccaagctggagctcaagcggaccgtcgccgccccgagcgtgttcatcttcccgccctccgacgagcagctgaagtccggcaccgccagcgtggtctgcctgctcaacaacttctacccccgcgaggcgaaggtgcagtggaaggtggacaacgccctgcagtccgggaacagccaggagtccgtcacggagcaggacagcaaggactccacctacagcctgtccagcaccctcaccctgtccaaggccgactacgagaagcacaaggtgtacgcctgcgaggtgacgcaccagggcctgagctcccccgtcaccaagagcttcaaccgcggggcg

SEQ ID NO: 7799 - RNA, 642 nt, synthetic construct
  misc_feature 1..642: note = derived and/or modified sequence opt1 from Cetuximab_LightChain_variant
  source 1..642: mol_type = other RNA
gacatcctgctcacccagagccccgtgatcctgtccgtcagcccgggcgagcgggtgtccttcagctgccgggcctcccagagcatcgggaccaacatccactggtaccagcagcgcacgaacggcagcccccggctgctcatcaagtacgccagcgagtccatcagcgggatcccctcccgcttcagcggctccgggagcggcaccgacttcaccctgtccatcaacagcgtggagtccgaggacatcgcggactactactgccagcagaacaacaactggcccaccacgttcggcgccgggaccaagctggagctcaagcggaccgtcgccgccccgagcgtgttcatcttcccgccctccgacgagcagctgaagtccggcaccgccagcgtggtctgcctgctcaacaacttctacccccgcgaggcgaaggtgcagtggaaggtggacaacgccctgcagtccgggaacagccaggagtccgtcacggagcaggacagcaaggactccacctacagcctgtccagcaccctcaccctgtccaaggccgactacgagaagcacaaggtgtacgcctgcgaggtgacgcaccagggcctgagctcccccgtcaccaagagcttcaaccgcggggagtgc

SEQ ID NO: 7800 - RNA, 675 nt, synthetic construct
  misc_feature 1..675: note = derived and/or modified sequence opt1 from Citatuzumab_bogatox_HeavyChain1
  source 1..675: mol_type = other RNA
caccaccaccaccaccacgaggtgcagctggtccagagcggccccgggctcgtgcagccgggcgggtccgtgcgcatcagctgcgccgcctccggctacaccttcaccaactacgggatgaactgggtcaagcaggcgcccggcaagggcctggagtggatggggtggatcaacacgtacaccggcgagagcacctacgccgactccttcaaggggcggttcaccttcagcctggacacgtccgccagcgccgcctacctccagatcaactccctgcgcgcggaggacaccgccgtgtactactgcgcccggttcgccatcaagggcgactactgggggcagggcaccctgctcaccgtgagctccgcgagcacgaagggcccctccgtcttccccctggccccgagctccaagagcacctccgggggcaccgccgccctggggtgcctcgtgaaggactacttccccgagcccgtgaccgtcagctggaactccggcgccctgacgagcggcgtgcacaccttccccgcggtgctgcagagctccgggctctacagcctgtccagcgtcgtgaccgtgccgtccagctccctgggcacccagacgtacatctgcaacgtcaaccacaagcccagcaacaccaaggtggacaagaaggtggagcccaagtcctgc

SEQ ID NO: 7801 - RNA, 1443 nt, synthetic construct
  misc_feature 1..1443: note = derived and/or modified sequence opt1 from Citatuzumab_bogatox_LightChain1
  source 1..1443: mol_type = other RNA
gacatccagatgacccagagcccctccagcctgtccgccagcgtgggcgaccgcgtcaccatcacgtgccggtccaccaagagcctcctgcactccaacgggatcacctacctgtactggtaccagcagaagccgggcaaggcccccaagctcctgatctaccagatgagcaacctggcgtccggggtgcccagccgcttctccagctccggcagcgggaccgacttcacgctcaccatctccagcctgcagcccgaggacttcgccacctactactgcgcccagaacctggagatcccgcggaccttcggccagggcacgaaggtggagctcaagcgcaccgtcgccgccccctccgtgttcatcttcccgcccagcgacgagcagctgaagtccgggaccgcgagcgtggtctgcctgctcaacaacttctacccccgggaggccaaggtgcagtggaaggtggacaacgccctgcagagcggcaactcccaggagagcgtcaccgagcaggactccaaggacagcacgtactccctgagctccaccctcaccctgagcaaggccgactacgagaagcacaaggtgtacgcgtgcgaggtgacccaccaggggctgtccagccccgtcacgaagtccttcaaccgcggcgagtgcacccggcaccgccagccccgggggtgggagcagctctacaacaccgtgagcttcaacctgggcgaggcctacgagtaccccaccttcatccaggacctgcgcaacgagctcgccaagggcacgccggtgtgccagctgcccgtcaccctgcagaccatcgccgacgacaagcggttcgtgctcgtggacatcaccacgacctccaagaagaccgtcaaggtggccatcgacgtgaccgacgtctacgtggtggggtaccaggacaagtgggacggcaaggaccgcgcggtcttcctggacaaggtgcccacggtcgccaccagcaagctgttccccggggtgaccaaccgggtgaccctcacgttcgacggctcctaccagaagctggtcaacgccgccaaggccgaccgcaaggcgctggagctcggcgtgaacaagctggagttcagcatcgaggccatccacgggaagaccatcaacggccaggaggccgccaagttcttcctgatcgtgatccagatggtctccgaggccgcgcggttcaagtacatcgagaccgaggtggtggaccgcgggctctacggcagcttcaagccgaacttcaaggtcctgaacctggagaacaactggggcgacatctccgacgccatccacaagagcagcccccagtgcaccacgatcaaccccgccctccagctgatctcccccagcaacgacccgtgggtggtgaacaaggtctcccagatcagccccgacatggggatcctgaagttcaagtccagcaag

SEQ ID NO: 7802 - RNA, 1380 nt, synthetic construct
  misc_feature 1..1380: note = derived and/or modified sequence opt1 from Cixutumumab_HeavyChain1
  source 1..1380: mol_type = other RNA
gaggtgcagctggtccagagcggcgccgaggtgaagaagcccgggtccagcgtgaaggtctcctgcaaggccagcggcgggaccttctccagctacgcgatctcctgggtgcgccaggccccgggccaggggctcgagtggatgggcggcatcatccccatcttcgggaccgccaactacgcccagaagttccagggccgggtgacgatcaccgccgacaagagcacctccaccgcgtacatggagctgagctccctgcgcagcgaggacacggccgtctactactgcgcccgggcgcccctccgcttcctggagtggtccacccaggaccactactactactactacatggacgtgtgggggaagggcaccaccgtgacggtcagctccgccagcaccaaggggccctccgtgttcccgctggcccccagctccaagagcaccagcggcggcaccgccgccctcgggtgcctggtgaaggactacttccccgagcccgtcacggtgtcctggaacagcggcgccctgacctccggggtgcacaccttcccggcggtcctccagagctccggcctgtacagcctgtccagcgtggtgaccgtcccctccagctccctcggcacgcagacctacatctgcaacgtgaaccacaagcccagcaacaccaaggtggacaagaaggtcgagcccaagtcctgcgacaagacccacacgtgcccgccctgccccgcccccgagctgctcgggggcccgagcgtgttcctcttcccgcccaagcccaaggacaccctgatgatctcccggacccccgaggtgacctgcgtcgtggtcgacgtgagccacgaggaccccgaggtgaagttcaactggtacgtcgacggggtggaggtgcacaacgccaagacgaagccccgcgaggagcagtacaactccacctaccgggtcgtgagcgtgctgaccgtcctccaccaggactggctgaacggcaaggagtacaagtgcaaggtgtccaacaaggccctgcccgccccgatcgagaagaccatcagcaaggcgaaggggcagccccgcgagccccaggtgtacacgctgcccccgagccgggaggagatgaccaagaaccaggtctccctgacctgcctggtgaagggcttctaccccagcgacatcgccgtggagtgggagtccaacggccagcccgagaacaactacaagaccacgccgcccgtcctcgacagcgacgggtccttcttcctgtacagcaagctgaccgtggacaagtcccgctggcagcagggcaacgtgttcagctgctccgtcatgcacgaggccctccacaaccactacacccagaagtccctgagcctgagccccgggaag

SEQ ID NO: 7803 - RNA, 642 nt, synthetic construct
  misc_feature 1..642: note = derived and/or modified sequence opt1 from Cixutumumab_LightChain1
  source 1..642: mol_type = other RNA
agctccgagctgacccaggaccccgccgtgagcgtcgccctcggccagaccgtgcgcatcacgtgccagggggactccctgcggagctactacgcgacctggtaccagcagaagccgggccaggcccccatcctggtgatctacggggagaacaagcgcccctccggcatccccgaccggttcagcgggtccagctccggcaacaccgccagcctcaccatcacgggcgcccaggccgaggacgaggcggactactactgcaagtcccgcgacgggagcggccagcacctggtcttcgggggcgggaccaagctgaccgtgctcggccagccgaaggccgccccctccgtgaccctgttcccgcccagctccgaggagctgcaggccaacaaggcgacgctcgtctgcctgatcagcgacttctaccccggcgccgtgaccgtggcctggaaggccgactccagccccgtcaaggccggggtggagaccaccacgccctccaagcagagcaacaacaagtacgcggccagctcctacctgagcctcacccccgagcagtggaagtcccaccggagctactcctgccaggtgacccacgagggcagcaccgtcgagaagacggtggccccggccgagtgctcc

SEQ ID NO: 7804 - RNA, 1350 nt, synthetic construct
  misc_feature 1..1350: note = derived and/or modified sequence opt1 from Clazakizumab_HeavyChain1
  source 1..1350: mol_type = other RNA
gaggtgcagctggtcgagagcggcgggggcctcgtgcagcccgggggctccctgcgcctgagctgcgccgcctccgggttcagcctctccaactactacgtgacctgggtccggcaggcgccgggcaagggcctggagtgggtggggatcatctacggcagcgacgagaccgcctacgccacgtccgccatcgggcgcttcaccatcagccgggacaactccaagaacaccctgtacctccagatgaacagcctgcgcgccgaggacaccgcggtgtactactgcgcccgggacgactccagcgactgggacgccaagttcaacctgtggggccaggggacgctcgtcaccgtgtccagcgcctccaccaagggccccagcgtgttccccctggcgccctccagcaagtccaccagcggcgggacggccgccctgggctgcctcgtcaaggactacttcccggagcccgtgaccgtgagctggaactccggggccctgaccagcggcgtccacaccttccccgccgtgctgcagtccagcggcctctactccctgagctccgtggtcacggtgcccagctccagcctggggacccagacctacatctgcaacgtgaaccacaagccgtccaacaccaaggtcgacaagcgcgtggagcccaagagctgcgacaagacgcacacgtgcccgccctgccccgcgcccgagctcctgggcgggccctccgtgttcctgttcccgcccaagcccaaggacaccctcatgatcagccggacccccgaggtgacctgcgtcgtggtcgacgtgtcccacgaggaccccgaggtcaagttcaactggtacgtggacggcgtggaggtccacaacgccaagaccaagccgcgcgaggagcagtacgccagcacctaccgggtggtgtccgtcctgaccgtgctgcaccaggactggctcaacgggaaggagtacaagtgcaaggtgagcaacaaggccctgcccgcccccatcgagaagacgatctccaaggcgaagggccagccccgcgagccgcaggtctacaccctgccgcccagccgggaggagatgaccaagaaccaggtgagcctgacctgcctcgtgaagggcttctacccctccgacatcgccgtcgagtgggagagcaacgggcagcccgagaacaactacaagacgaccccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtcccccggcaag

SEQ ID NO: 7805 - RNA, 651 nt, synthetic construct
  misc_feature 1..651: note = derived and/or modified sequence opt1 from Clazakizumab_LightChain1
  source 1..651: mol_type = other RNA
gccatccagatgacccagagcccctccagcctgtccgccagcgtgggcgaccgcgtcaccatcacgtgccaggcgtcccagagcatcaacaacgagctctcctggtaccagcagaagccggggaaggcccccaagctgctgatctaccgggccagcaccctcgcctccggcgtgcccagccgcttctccgggagcggctccgggaccgacttcaccctgacgatcagctccctgcagcccgacgacttcgccacctactactgccagcagggctacagcctccggaacatcgacaacgcgttcggcgggggcaccaaggtggagatcaagcgcaccgtcgccgccccgtccgtgttcatcttcccgcccagcgacgagcagctgaagtccgggacggccagcgtggtctgcctgctcaacaacttctacccccgggaggcgaaggtgcagtggaaggtggacaacgccctgcagagcggcaactcccaggagagcgtcaccgagcaggactccaaggacagcacctactccctgagctccaccctcacgctgagcaaggccgactacgagaagcacaaggtgtacgcctgcgaggtgacccaccaggggctgtccagccccgtcaccaagtccttcaaccgcggcgagtgc

SEQ ID NO: 7806 - RNA, 1347 nt, synthetic construct
  misc_feature 1..1347: note = derived and/or modified sequence opt1 from Clivatuzumab_tetraxetan_HeavyChain1
  source 1..1347: mol_type = other RNA
caggtgcagctgcagcagagcggcgccgaggtcaagaagcccggggcctccgtgaaggtgagctgcgaggcgtccggctacaccttcccgagctacgtcctccactgggtgaagcaggcccccgggcagggcctggagtggatcgggtacatcaacccctacaacgacggcacccagtacaacgagaagttcaagggcaaggccacgctgacccgcgacacctccatcaacaccgcctacatggagctcagccggctgcgctccgacgacacggccgtgtactactgcgcgcgggggttcggcgggagctacggcttcgcctactgggggcagggcaccctggtcaccgtgtccagcgcctccaccaagggccccagcgtgttcccgctcgccccctccagcaagtccacgagcgggggcaccgcggccctggggtgcctggtcaaggactacttccccgagcccgtgaccgtgtcctggaacagcggcgccctcacctccggcgtccacacgttcccggccgtgctgcagagcagcgggctgtactccctcagctccgtggtcaccgtgcccagctccagcctgggcacccagacctacatctgcaacgtgaaccacaagccctccaacacgaaggtcgacaagcgcgtggagcccaagagctgcgacaagacccacacgtgcccgccctgccccgcccccgagctgctcgggggcccgtccgtgttcctgttcccgcccaagcccaaggacaccctgatgatcagccggacccccgaggtgacctgcgtcgtggtcgacgtgtcccacgaggaccccgaggtcaagttcaactggtacgtggacggggtggaggtccacaacgcgaagaccaagccccgcgaggagcagtacaacagcacctaccgggtggtgtccgtcctcacggtgctgcaccaggactggctgaacggcaaggagtacaagtgcaaggtgagcaacaaggccctccccgccccgatcgagaagaccatctccaaggccaagggccagccccgcgagccccaggtctacaccctgcccccgagccgggaggagatgaccaagaaccaggtgtccctgacgtgcctcgtgaaggggttctaccccagcgacatcgccgtcgagtgggagtccaacggccagcccgagaacaactacaagaccaccccgcccgtgctggacagcgacgggagcttcttcctgtactccaagctcaccgtggacaagagccgctggcagcagggcaacgtcttctcctgcagcgtgatgcacgaggcgctgcacaaccactacacgcagaagtccctgagcctctcccccgggaag

SEQ ID NO: 7807 - RNA, 645 nt, synthetic construct
  misc_feature 1..645: note = derived and/or modified sequence opt1 from Clivatuzumab_tetraxetan_LightChain1
  source 1..645: mol_type = other RNA
gacatccagctgacccagagcccctccagcctctccgccagcgtgggcgaccgcgtcaccatgacgtgctccgccagctccagcgtgtccagctcctacctgtactggtaccagcagaagccggggaaggcgcccaagctgtggatctacagcacctccaacctcgccagcggcgtgcccgcccggttctccgggagcggctccgggaccgacttcaccctgacgatcagctccctgcagcccgaggacagcgccagctacttctgccaccagtggaaccgctacccgtacaccttcggcggcgggacccggctcgagatcaagcgcaccgtcgccgcgccctccgtgttcatcttcccgcccagcgacgagcagctgaagtccggcacggccagcgtggtctgcctgctcaacaacttctacccccgggaggccaaggtgcagtggaaggtggacaacgccctgcagtccgggaacagccaggagtccgtcaccgagcaggacagcaaggactccacctacagcctgtccagcaccctcacgctgtccaaggcggactacgagaagcacaaggtgtacgcctgcgaggtgacccaccagggcctgagctcccccgtcaccaagagcttcaaccgcggggagtgc

SEQ ID NO: 7808 - RNA, 1335 nt, synthetic construct
  misc_feature 1..1335: note = derived and/or modified sequence opt1 from Codrituzumab_HeavyChain1
  source 1..1335: mol_type = other RNA
caggtgcagctggtccagagcggcgccgaggtgaagaagcccggggcctccgtgaaggtcagctgcaaggcgtccggctacaccttcaccgactacgagatgcactgggtgcgccaggccccggggcagggcctcgagtggatgggggccctggaccccaagacgggcgacaccgcctacagccagaagttcaagggccgggtgaccctgaccgccgacaagtccacgagcaccgcgtacatggagctctccagcctgacctccgaggacaccgccgtctactactgcacgcgcttctacagctacacctactgggggcagggcaccctggtgaccgtgtccagcgcctccacgaaggggcccagcgtcttccccctcgccccgtccagcaagtccaccagcggcgggaccgcggccctgggctgcctggtgaaggactacttccccgagcccgtgaccgtctcctggaacagcggcgccctcacgagcggggtgcacaccttccccgccgtgctgcagtccagcggcctgtactccctcagctccgtcgtgaccgtgccgagctccagcctggggacccagacgtacatctgcaacgtcaaccacaagccctccaacaccaaggtggacaagaaggtggagcccaagagctgcgacaagacccacacgtgcccgccctgccccgcccccgagctgctcggcggcccctccgtcttcctgttcccgcccaagcccaaggacaccctgatgatcagccggacccccgaggtgacctgcgtggtcgtggacgtctcccacgaggacccggaggtgaagttcaactggtacgtggacggggtcgaggtgcacaacgcgaagaccaagccccgcgaggagcagtacaacagcacgtaccgggtggtctccgtgctcaccgtgctgcaccaggactggctgaacggcaaggagtacaagtgcaaggtcagcaacaaggccctccccgcccccatcgagaagaccatctccaaggccaaggggcagccgcgcgagccccaggtgtacaccctgccgcccagccgggacgagctgacgaagaaccaggtgtccctgacctgcctcgtcaagggcttctaccccagcgacatcgccgtggagtgggagagcaacgggcagcccgagaacaactacaagaccacgcccccggtgctggactccgacggcagcttcttcctctactccaagctgaccgtcgacaagagccgctggcagcagggcaacgtgttctcctgcagcgtgatgcacgaggcgctgcacaaccactacacccagaagtccctcagcctgtcccccgggaag

SEQ ID NO: 7809 - RNA, 657 nt, synthetic construct
  misc_feature 1..657: note = derived and/or modified sequence opt1 from Codrituzumab_LightChain1
  source 1..657: mol_type = other RNA
gacgtggtcatgacccagagccccctgtccctcccggtgacccccggcgagcccgccagcatctcctgccggagctcccagagcctggtgcactccaaccggaacacgtacctgcactggtacctccagaagcccgggcagagcccgcagctgctgatctacaaggtctccaaccgcttcagcggcgtgcccgaccggttctccgggagcggctccgggaccgacttcaccctcaagatcagccgcgtggaggccgaggacgtcggcgtgtactactgctcccagaacacccacgtgccgcccacgttcggccaggggaccaagctggagatcaagcggaccgtcgcggcccccagcgtgttcatcttcccgccctccgacgagcagctcaagagcggcaccgcctccgtggtctgcctgctgaacaacttctacccccgcgaggccaaggtgcagtggaaggtggacaacgccctgcagagcgggaacagccaggagtccgtcacggagcaggacagcaaggactccacctacagcctctccagcaccctgaccctgtccaaggcggactacgagaagcacaaggtgtacgcctgcgaggtgacgcaccagggcctcagctcccccgtcaccaagagcttcaaccgcggggagtgc

SEQ ID NO: 7810 - RNA, 1350 nt, synthetic construct
  misc_feature 1..1350: note = derived and/or modified sequence opt1 from Coltuximab_ravtansine_HeavyChain1
  source 1..1350: mol_type = other RNA
caggtgcagctggtccagcccggcgccgaggtggtgaagcccggggccagcgtcaagctctcctgcaagaccagcggctacaccttcacgtccaactggatgcactgggtgaagcaggcgcccgggcagggcctggagtggatcggggagatcgaccccagcgactcctacaccaactacaaccagaacttccagggcaaggccaagctgaccgtggacaagagcacctccacggcctacatggaggtcagctccctccgcagcgacgacaccgccgtgtactactgcgcccggggctccaacccctactactacgcgatggactactgggggcagggcaccagcgtgaccgtctccagcgcctccacgaaggggccgagcgtgttccccctggccccctccagcaagtccaccagcggcgggaccgccgcgctgggctgcctcgtgaaggactacttccccgagccggtcaccgtgagctggaactccggcgccctgacgagcggggtgcacaccttccccgccgtcctgcagtccagcggcctctactccctgagctccgtggtgaccgtccccagctccagcctggggacccagacgtacatctgcaacgtgaaccacaagccctccaacaccaaggtggacaagaaggtcgagcccaagagctgcgacaagacccacacgtgcccgccctgccccgccccggagctcctgggcggcccctccgtgttcctgttcccgcccaagcccaaggacaccctcatgatcagccgcacccccgaggtgacctgcgtcgtggtcgacgtgtcccacgaggaccccgaggtgaagttcaactggtacgtcgacggggtggaggtgcacaacgccaagaccaagccccgggaggagcagtacaacagcacgtaccgcgtcgtgtccgtgctgaccgtcctgcaccaggactggctcaacggcaaggagtacaagtgcaaggtgagcaacaaggcgctgccggcccccatcgagaagaccatctccaaggccaaggggcagccccgggagccccaggtgtacaccctgccgcccagccgcgacgagctcacgaagaaccaggtcagcctgacctgcctggtgaagggcttctacccctccgacatcgccgtggagtgggagagcaacgggcagccggagaacaactacaagaccaccccgcccgtcctcgactccgacggcagcttcttcctgtactccaagctgacggtggacaagagccggtggcagcagggcaacgtgttctcctgcagcgtcatgcacgaggccctccacaaccactacacccagaagtccctgagcctgtcccccgggaag

SEQ ID NO: 7811 - RNA, 633 nt, synthetic construct
  misc_feature 1..633: note = derived and/or modified sequence opt1 from Coltuximab_ravtansine_LightChain1
  source 1..633: mol_type = other RNA
gagatcgtgctgacccagagccccgccatcatgtccgccagcccgggcgagcgcgtcaccatgacgtgctccgcgagctccggggtgaactacatgcactggtaccagcagaagcccggcaccagcccccggcgctggatctacgacacctccaagctcgccagcggggtgcccgcccggttctccggcagcgggtccggcaccgactacagcctgacgatctccagcatggagccggaggacgccgccacctactactgccaccagcgcggctcctacaccttcgggggcgggaccaagctggagatcaagcggacggtcgcggcccccagcgtgttcatcttcccgccctccgacgagcagctcaagagcggcaccgcctccgtggtctgcctgctgaacaacttctacccccgcgaggccaaggtgcagtggaaggtggacaacgcgctccagagcgggaacagccaggagtccgtcaccgagcaggacagcaaggactccacctacagcctgtccagcacgctgaccctctccaaggccgactacgagaagcacaaggtgtacgcctgcgaggtgacccaccagggcctgagctcccccgtcaccaagagcttcaaccggggcgagtgc

SEQ ID NO: 7812 - RNA, 1356 nt, synthetic construct
  misc_feature 1..1356: note = derived and/or modified sequence opt1 from Conatumumab_CV_HeavyChain
  source 1..1356: mol_type = other RNA
caggtgcagctgcaggagagcggccccgggctcgtcaagccgtcccagaccctgagcctgacctgcacggtgtccggcgggagcatctccagcggcgactacttctggtcctggatccgccagctccccgggaagggcctggagtggatcggccacatccacaacagcgggaccacctactacaacccctccctcaagagccgggtgaccatctccgtcgacacgagcaagaagcagttctccctccgcctgagctccgtgaccgccgccgacaccgcggtgtactactgcgcccgggaccgcggcggggactactactacggcatggacgtctgggggcagggcaccacggtgaccgtgagctccgccagcaccaagggcccctccgtcttcccgctggcccccagcagcaagtccaccagcgggggcacggccgcgctcgggtgcctggtgaaggactacttccccgagcccgtgaccgtctcctggaacagcggcgccctgacctccggcgtgcacaccttcccggccgtgctccagagctccgggctgtacagcctgtccagcgtcgtgacggtgccctccagctccctcggcacccagacctacatctgcaacgtcaaccacaagcccagcaacaccaaggtggacaagcgggtggagcccaagtcctgcgacaagacgcacacgtgcccgccctgccccgcccccgagctgctcgggggcccgagcgtcttcctgttcccgcccaagcccaaggacaccctgatgatctcccgcacccccgaggtgacctgcgtggtcgtggacgtcagccacgaggaccccgaggtgaagttcaactggtacgtggacggggtcgaggtgcacaacgcgaagaccaagccccgggaggagcagtacaactccacctaccgcgtggtcagcgtgctgaccgtgctccaccaggactggctgaacggcaaggagtacaagtgcaaggtcagcaacaaggccctgcccgccccgatcgagaagacgatctccaaggccaagggccagccccgggagccccaggtgtacaccctgcccccgagccgcgaggagatgaccaagaaccaggtgtccctgacctgcctggtcaaggggttctaccccagcgacatcgccgtggagtgggagtccaacggccagcccgagaacaactacaagacgaccccgcccgtgctcgacagcgacgggtccttcttcctgtacagcaagctgaccgtcgacaagtcccggtggcagcagggcaacgtgttcagctgctccgtgatgcacgaggcgctccacaaccactacacccagaagtccctgagcctgagccccgggaag

SEQ ID NO: 7813 - RNA, 645 nt, synthetic construct
  misc_feature 1..645: note = derived and/or modified sequence opt1 from Conatumumab_CV_LightChain
  source 1..645: mol_type = other RNA
gagatcgtgctgacccagagccccggcaccctctccctgagcccgggggagcgcgccacgctgtcctgccgggccagccagggcatctcccgcagctacctcgcgtggtaccagcagaagcccgggcaggccccctccctgctgatctacggcgccagctcccgggccaccgggatccccgaccgcttcagcggctccggcagcgggaccgacttcaccctcacgatctcccggctggagccggaggacttcgccgtctactactgccagcagttcggcagctccccctggaccttcgggcagggcaccaaggtggagatcaagcgcaccgtggcggcccccagcgtcttcatcttcccgccctccgacgagcagctcaagagcgggacggcctccgtggtgtgcctgctgaacaacttctacccccgggaggccaaggtccagtggaaggtggacaacgcgctgcagagcggcaacagccaggagtccgtgaccgagcaggacagcaaggactccacctacagcctctccagcaccctgacgctgtccaaggccgactacgagaagcacaaggtctacgcctgcgaggtgacccaccagggcctcagctcccccgtgaccaagagcttcaaccgcggggagtgc

SEQ ID NO: 7814 - RNA, 1356 nt, synthetic construct; identical to SEQ ID NO: 7812
  misc_feature 1..1356: note = derived and/or modified sequence opt1 from Conatumumab_HeavyChain1
  source 1..1356: mol_type = other RNA

SEQ ID NO: 7815 - RNA, 1356 nt, synthetic construct; identical to SEQ ID NO: 7812
  misc_feature 1..1356: note = derived and/or modified sequence opt1 from Conatumumab_HeavyChain
  source 1..1356: mol_type = other RNA

SEQ ID NO: 7816 - RNA, 645 nt, synthetic construct; identical to SEQ ID NO: 7813
  misc_feature 1..645: note = derived and/or modified sequence opt1 from Conatumumab_LightChain1
  source 1..645: mol_type = other RNA

SEQ ID NO: 7817 - RNA, 645 nt, synthetic construct; identical to SEQ ID NO: 7813
  misc_feature 1..645: note = derived and/or modified sequence opt1 from Conatumumab_LightChain
  source 1..645: mol_type = other RNA

SEQ ID NO: 7818 - RNA, 1344 nt, synthetic construct
  misc_feature 1..1344: note = derived and/or modified sequence opt1 from Concizumab_HeavyChain1
  source 1..1344: mol_type = other RNA
gaggtgcagctggtcgagagcggcgggggcctcgtgaagcccgggggctccctgcgcctgagctgcgccgcctccgggttcaccttcagcaactacgcgatgtcctgggtgcggcagaccccggagaagcgcctcgagtgggtcgccacgatcagccggtccggcagctactcctacttccccgacagcgtgcagggccgcttcaccatctcccgggacaacgccaagaacagcctgtacctgcagatgaactccctccgcgccgaggacaccgccgtgtactactgcgcgcggctcgggggctacgacgagggggacgccatggacagctggggccaggggaccacggtcaccgtgtccagcgcctccaccaagggccccagcgtgttccccctggccccgtgctcccgcagcaccagcgagtccacggcggccctcggctgcctggtcaaggactacttccccgagcccgtgaccgtgagctggaactccggggccctgaccagcggcgtccacaccttccccgccgtgctccagtccagcgggctgtactccctgagctccgtggtcacggtgccgagctccagcctcggcaccaagacctacacgtgcaacgtggaccacaagccctccaacaccaaggtcgacaagcgggtggagagcaagtacggcccgccctgcccgccctgccccgcccccgagttcctcgggggcccctccgtgttcctgttcccgcccaagcccaaggacaccctgatgatcagccgcacccccgaggtgacctgcgtcgtggtcgacgtgtcccaggaggaccccgaggtccagttcaactggtacgtggacggggtggaggtccacaacgcgaagacgaagccccgggaggagcagttcaacagcacctaccgcgtggtgtccgtcctgaccgtgctgcaccaggactggctcaacggcaaggagtacaagtgcaaggtgagcaacaaggggctgcccagctccatcgagaagaccatcagcaaggccaagggccagccgcgggagccccaggtctacacgctgccgccctcccaggaggagatgaccaagaaccaggtgagcctgacctgcctggtgaagggcttctacccctccgacatcgccgtcgagtgggagagcaacgggcagcccgagaacaactacaagaccacgcccccggtgctggactccgacggcagcttcttcctctactcccgcctgaccgtggacaagagccggtggcaggaggggaacgtcttctcctgcagcgtgatgcacgaggccctgcacaaccactacacccagaagtccctcagcctgtccctgggcaag

SEQ ID NO: 7819 - RNA, 657 nt, synthetic construct
  misc_feature 1..657: note = derived and/or modified sequence opt1 from Concizumab_LightChain1
  source 1..657: mol_type = other RNA
gacatcgtgatgacccagacgcccctgagcctctccgtcaccccgggccagcccgccagcatctcctgcaagagctcccagagcctgctggagtccgacgggaagacctacctcaactggtacctgcagaagcccggccagagcccccagctgctcatctacctggtgtccatcctggacagcggggtgccggaccgcttctccggcagcgggtccggcaccgacttcaccctcaagatcagccgggtcgaggccgaggacgtgggcgtgtactactgcctgcaggcgacgcacttcccccagaccttcgggggcgggaccaaggtcgagatcaagcgcaccgtggccgccccctccgtgttcatcttcccgcccagcgacgagcagctgaagtccggcacggccagcgtcgtgtgcctcctgaacaacttctacccccgggaggccaaggtgcagtggaaggtcgacaacgcgctgcagtccgggaacagccaggagagcgtgaccgagcaggactccaaggacagcacctactccctcagctccaccctgacgctgagcaaggccgactacgagaagcacaaggtgtacgcctgcgaggtcacccaccagggcctctccagccccgtgaccaagtccttcaaccgcggcgagtgc

SEQ ID NO: 7820 - RNA, 1314 nt, synthetic construct
  misc_feature 1..1314: note = derived and/or modified sequence opt1 from Crenezumab_HeavyChain1
  source 1..1314: mol_type = other RNA
gaggtgcagctggtcgagagcggcgggggcctcgtgcagcccgggggctccctgcgcctgagctgcgccgcctccgggttcaccttcagctcctacggcatgagctgggtgcggcaggcgcccggcaaggggctcgagctggtcgcctccatcaacagcaacggcgggtccacctactaccccgacagcgtgaagggccgcttcacgatctcccgggacaacgccaagaacagcctgtacctccagatgaactccctgcgcgccgaggacaccgccgtgtactactgcgcgagcggggactactggggccagggcaccaccgtcacggtgtccagcgcctccaccaaggggcccagcgtgttccccctggccccgtgctcccggagcaccagcgagtccaccgccgcgctcggctgcctggtcaaggactacttccccgagcccgtgacggtgagctggaactccggggccctgaccagcggcgtccacaccttccccgccgtgctccagtccagcggcctgtactccctgagctccgtggtcaccgtgccgagctccagcctcgggacgaagacctacacgtgcaacgtggaccacaagccctccaacaccaaggtcgacaagcgcgtggagagcaagtacggcccgccctgcccgccctgccccgcccccgagttcctcgggggcccgtccgtgttcctgttcccgcccaagcccaaggacaccctcatgatcagccggacccccgaggtgacctgcgtcgtggtcgacgtgtcccaggaggaccccgaggtccagttcaactggtacgtggacggggtggaggtccacaacgccaagaccaagccccgcgaggagcagttcaacagcacgtaccgggtggtgtccgtcctgaccgtgctgcaccaggactggctcaacggcaaggagtacaagtgcaaggtgagcaacaagggcctgcccagctccatcgagaagaccatcagcaaggcgaaggggcagccgcgcgagccccaggtctacaccctgccgccctcccaggaggagatgacgaagaaccaggtgagcctgacctgcctggtgaagggcttctacccctccgacatcgccgtcgagtgggagagcaacgggcagcccgagaacaactacaagaccaccccgcccgtgctggactccgacggcagcttcttcctctactcccggctgacggtggacaagagccgctggcaggaggggaacgtcttctcctgcagcgtgatgcacgaggccctgcacaaccactacacccagaagtccctcagcctgtccctgggc

SEQ ID NO: 7821 - RNA, 657 nt, synthetic construct
  misc_feature 1..657: note = derived and/or modified sequence opt1 from Crenezumab_LightChain1
  source 1..657: mol_type = other RNA
gacatcgtgatgacccagagccccctgtccctcccggtcacccccggcgagcccgccagcatctcctgccgcagctcccagagcctggtgtactccaacggggacacgtacctgcactggtacctccagaagcccggccagagcccgcagctgctgatctacaaggtgtccaaccggttcagcggggtccccgaccgcttctccggcagcgggtccggcaccgacttcaccctcaagatcagccgggtggaggccgaggacgtgggcgtctactactgctcccagagcacccacgtgccctggacgttcgggcagggcaccaaggtggagatcaagcgcaccgtcgcggccccctccgtgttcatcttcccgcccagcgacgagcagctgaagtccgggaccgccagcgtggtctgcctgctcaacaacttctacccccgggaggccaaggtgcagtggaaggtggacaacgccctgcagagcggcaactcccaggagagcgtcacggagcaggactccaaggacagcacctactccctgagctccaccctcaccctgagcaaggcggactacgagaagcacaaggtgtacgcctgcgaggtgacgcaccaggggctgtccagccccgtcaccaagtccttcaaccgcggcgagtgc

SEQ ID NO: 7822 - RNA, 1365 nt, synthetic construct
  misc_feature 1..1365: note = derived and/or modified sequence opt1 from Crotedumab_HeavyChain1
  source 1..1365: mol_type = other RNA
gaggtgcagctggtcgagagcggcgggggcctcgtgcagcccgggggctccctgcgcctgagctgcgccgcctccgggttcaccttcagcaactacctcatgaactgggtgcggcaggcgcccggcaagggcctggagtggctggccaacatccaggaggacgggatcgagaagtactacgtcgactccgtgaagggccgcttcaccatcagccgggacaacgccaagaactccctctacctgcagatgaacagcctgcgcgccgaggacacggccgtgtactactgcgcgcgggagccctcccactacgacatcctcaccgggtacgactactactacggcatggacgtctgggggcagggcaccaccgtgacggtgagctccgccagcaccaagggcccctccgtcttccccctggccccgtgcagccgctccaccagcgagtccaccgccgcgctggggtgcctcgtgaaggactacttccccgagcccgtgacggtcagcaacaactccggcgccctgaccagcggggtgcacaccttccccgccgtgctgcagagctccggcctctacagcctgtccagcgtcgtgaccgtgccgtccagctccctgggcacgaagacctacacgtgcaacgtcgaccacaagcccagcaacaccaaggtggacaagcgggtggagtccaagtacgggccgccctgcccgccctgccccgcccccgagttcctcggcgggccgagcgtcttcctgttcccgcccaagcccaaggacaccctgatgatctcccgcacccccgaggtgacctgcgtggtcgtggacgtcagccaggaggaccccgaggtgcagttcaactggtacgtggacggcgtcgaggtgcacaacgccaagaccaagccccgggaggagcagttcaactccacgtaccgcgtggtcagcgtgctcaccgtgctgcaccaggactggctgaacgggaaggagtacaagtgcaaggtctccaacaagggcctccccagctccatcgagaagaccatcagcaaggcgaagggccagccgcgggagccccaggtgtacaccctgccgccctcccaggaggagatgacgaagaaccaggtgagcctgacctgcctcgtcaaggggttctaccccagcgacatcgccgtggagtgggagtccaacggccagcccgagaacaactacaagaccaccccgcccgtgctggacagcgacgggtccttcttcctgtacagccgcctcacggtcgacaagtcccggtggcaggagggcaacgtgttcagctgctccgtgatgcacgaggccctgcacaaccactacacccagaagtccctgagcctcagcctggggaag

SEQ ID NO: 7823 - RNA, 1365 nt, synthetic construct
  misc_feature 1..1365: note = derived and/or modified sequence opt1 from Crotedumab_HeavyChain2
  source 1..1365: mol_type = other RNA
gaggtgcagctggtcgagagcggcgggggcctcgtgcagcccgggggctccctgcacctgagctgcgccgcctccgggttcaccttcagcaactacctcatgaactgggtgcgccaggcgcccggcaagggcctggagtggctggccaacatccaggaggacgggatcgagaagtactacgtcgactccgtgaagggccggttcaccatcagccgcgacaacgccaagaactccctctacctgcagatgaacagcctgcgggccgaggacacggccgtgtactactgcgcgcgcgagccctcccactacgacatcctcaccgggtacgactactactacggcatggacgtctgggggcagggcaccaccgtgacggtgagctccgccagcaccaagggcccctccgtcttccccctggccccgtgcagccggtccaccagcgagtccaccgccgcgctggggtgcctcgtgaaggactacttccccgagcccgtgacggtcagcaacaactccggcgccctgaccagcggggtgcacaccttccccgccgtgctgcagagctccggcctctacagcctgtccagcgtcgtgaccgtgccgtccagctccctgggcacgaagacctacacgtgcaacgtcgaccacaagcccagcaacaccgaggtggacgagcgcgtggagtccaagtacgggccgccctgcccgccctgccccgcccccgagttcctcggcgggccgagcgtcttcctgttcccgcccaagcccaaggacaccctgatgatctcccggacccccgaggtgacctgcgtggtcgtggacgtcagccaggaggaccccgaggtgcagttcaactggtacgtggacggcgtcgaggtgcacaacgccaagaccaagccccgcgaggagcagttctggtccacgtaccgggtggtcagcgtgctcaccgtgctgcaccaggactggctgaacgggaaggagtacaagtgcaaggtctccaacaagggcctccccagctccatcgagaagaccatcagcaaggcgaagggccagccgcgcgagccccaggtgtacaccctgccgccctcccaggaggagatgacgaagaaccaggtgagcctgacctgcctcgtcaaggggttctaccccagcgacatcgccgtggagtgggagtccaacggccagcccgagaacaactacaagaccaccccgcccgtgctggacagcgacgggtccttcttcctgtacagccggctcacggtcgacgagtcccgctggcaggagcacaacgtgttcagctgctccgtgatgcacgaggccctgcacaaccactacacccagaagtccctgagcctcagcctgggcaag

SEQ ID NO: 7824 - RNA, 642 nt, synthetic construct
  misc_feature 1..642: note = derived and/or modified sequence opt1 from Crotedumab_LightChain1
  source 1..642: mol_type = other RNA
gacatccagatgacccagagcccctccagcctgtccgccagcgtgggcgaccgcgtcaccatcacgtgccgggcctcccaggggatccgcaacgacctcggctggtaccagcagaagccggggaaggcgcccaagcggctgatctacgccgccagctccctgcagagcggcgtgccctcccgcttcagcgggtccggcagcggcaccgagttcatcctcaccgtgtccagcctgcagcccgaggacttcgccacctactactgcctgcagtacaacgagaacccgttcacgttcgggcccggcaccaaggtcgacatcaagcggaccgtggccgcgccctccgtgttcatcttcccgcccagcgacgagcagctcaagtccgggaccgccagcgtcgtgtgcctgctgaacaacttctacccccgcgaggccaaggtgcagtggaaggtcgacaacgccctccagtccggcaacagccaggagagcgtgacggagcaggactccaaggacagcacctactccctgagctccaccctgaccctcagcaaggcggactacgaggagcacaaggtgtacgcctgcgaggtcacgcaccaggggctgtccagccccgtgaccaagtccttcaaccggggcgagtgc

SEQ ID NO: 7825 - RNA, 642 nt, synthetic construct
  misc_feature 1..642: note = derived and/or modified sequence opt1 from Crotedumab_LightChain2
  source 1..642: mol_type = other RNA
gacatccagatgacccagagcccctccagcctgtccgccagcgtgggcgaccgcgtcaccatcacgtgccgggcctcccaggggatccgcaacgacctcggctggtaccagcagaagccggggaaggcgcccaagcggctgatctacgccgccagctccctgcagagcggcgtgccctcccgcttcagcgggtccggcagcggcaccgagttcatcctcaccgtgtccagcctgcagcccgaggacttcgccacctactactgcctgcagtacaactccaacccgttcacgttcgggcccggcaccaaggtcgacatcaagcggaccgtggccgcgcccagcgtgttcatcttcccgccctccgacgagcagctcaagagcgggaccgcctccgtcgtgtgcctgctgaacaacttctacccccgcgaggccaaggtgcagaacaaggtcgacaacgccctccagagcggcaacagccaggagtccgtgacggagcaggacagcaaggactccacctacagcctgtccagcaccctgaccctctccgaggcggactacgagaagcacaaggtgtacgcctgcgaggtcacgcaccaggggctgagctcccccgtgaccaagagcttcaaccggggcgagtgc

SEQ ID NO: 7826 - RNA, 1332 nt, synthetic construct
  misc_feature 1..1332: note = derived and/or modified sequence opt1 from Dacetuzumab_HeavyChain1
  source 1..1332: mol_type = other RNA
gaggtgcagctggtcgagagcggcgggggcctcgtgcagcccgggggctccctgcgcctgagctgcgccgcctccgggtacagcttcaccggctactacatccactgggtgcggcaggcgccgggcaaggggctcgagtgggtcgcccgcgtgatccccaacgccggcgggacctcctacaaccagaagttcaagggccggttcacgctgagcgtggacaactccaagaacaccgcctacctgcagatgaacagcctccgcgccgaggacaccgcggtctactactgcgcccgggaggggatctactggtggggccagggcaccctggtgacggtgtccagcgcctccaccaaggggcccagcgtcttccccctggccccgtccagcaagtccaccagcggcgggaccgcggccctcggctgcctggtgaaggactacttccccgagcccgtgacggtctcctggaacagcggcgccctgacctccggggtgcacaccttccccgccgtgctccagagcagcggcctgtactccctgagctccgtcgtgaccgtgccgagctccagcctcgggacgcagacctacatctgcaacgtcaaccacaagccctccaacaccaaggtggacaagaaggtggagcccaagagctgcgacaagacccacacgtgcccgccctgccccgcccccgagctgctgggcgggccctccgtcttcctcttcccgcccaagcccaaggacaccctgatgatcagccgcacccccgaggtgacctgcgtggtcgtggacgtctcccacgaggacccggaggtgaagttcaactggtacgtggacggcgtcgaggtgcacaacgcgaagacgaagccccgggaggagcagtacaacagcacctaccgcgtggtctccgtgctgaccgtgctccaccaggactggctgaacggcaaggagtacaagtgcaaggtcagcaacaaggccctgcccgcccccatcgagaagaccatctccaaggccaaggggcagccgcgggagccccaggtgtacacgctcccgcccagccgcgaggagatgaccaagaaccaggtgtccctgacctgcctggtcaagggcttctaccccagcgacatcgccgtggagtgggagtccaacgggcagcccgagaacaactacaagaccacgcccccggtgctcgacagcgacggcagcttcttcctgtactccaagctgaccgtcgacaagagccggtggcagcaggggaacgtgttctcctgcagcgtgatgcacgaggcgctccacaaccactacacccagaagtccctgagcctgtcccccggcaag

SEQ ID NO: 7827 - RNA, 657 nt, synthetic construct
  misc_feature 1..657: note = derived and/or modified sequence opt1 from Dacetuzumab_LightChain1
  source 1..657: mol_type = other RNA
gacatccagatgacccagagcccctccagcctgtccgccagcgtgggcgaccgcgtcaccatcacgtgccggtccagccagtccctcgtgcacagcaacgggaacaccttcctgcactggtaccagcagaagccgggcaaggcccccaagctgctcatctacaccgtgtccaaccgcttcagcggggtcccctcccggttcagcggctccgggagcggcaccgacttcacgctgaccatctccagcctgcagcccgaggacttcgcgacctacttctgctcccagaccacgcacgtgccgtggaccttcggccaggggaccaaggtggagatcaagcgcaccgtcgccgcccccagcgtgttcatcttcccgccctccgacgagcagctcaagagcggcacggccagcgtggtctgcctgctgaacaacttctacccccgggaggccaaggtgcagtggaaggtggacaacgcgctccagtccgggaacagccaggagtccgtcaccgagcaggacagcaaggactccacctacagcctgtccagcaccctgacgctctccaaggccgactacgagaagcacaaggtgtacgcctgcgaggtgacccaccagggcctgagctcccccgtcaccaagagcttcaaccgcggggagtgc

SEQ ID NO: 7828 - RNA, 318 nt, synthetic construct
  misc_feature 1..318: note = derived and/or modified sequence opt1 from Dacliximab_LightChain_VJ-Region
  source 1..318: mol_type = other RNA
gacatccagatgacccagagcccctccaccctgagcgcctccgtgggcgaccgcgtcacgatcacgtgcagcgcctccagctccatcagctacatgcactggtaccagcagaagccggggaaggcgcccaagctcctgatctacaccacctccaacctggccagcggcgtgcccgcccggttctccgggagcggctccgggaccgagttcaccctcaccatcagctccctgcagcccgacgacttcgccacctactactgccaccagcgcagcacgtacccgctgaccttcggccagggcaccaaggtggaggtcaag

SEQ ID NO: 7829 - RNA, 348 nt, synthetic construct
  misc_feature 1..348: note = derived and/or modified sequence opt1 from Dacliximab_gamma2-Chain_VDJ-Region
  source 1..348: mol_type = other RNA
caggtgcagctggtccagagcggcgccgaggtgaagaagcccgggtccagcgtgaaggtctcctgcaaggccagcggctacaccttcacctcctaccgcatgcactgggtgcggcaggcgccggggcagggcctcgagtggatcgggtacatcaaccccagcacgggctacaccgagtacaaccagaagttcaaggacaaggccaccatcaccgccgacgagtccacgaacaccgcctacatggagctgagctccctgcgcagcgaggacaccgccgtgtactactgcgcgcggggcgggggcgtcttcgactactgggggcagggcaccctcgtgacggtgtccagc

SEQ ID NO: 7830 - RNA, 1326 nt, synthetic construct
  misc_feature 1..1326: note = derived and/or modified sequence opt1 from Daclizumab_HeavyChain
  source 1..1326: mol_type = other RNA
caggtgcagctggtccagagcggcgccgaggtgaagaagcccgggtccagcgtgaaggtctcctgcaaggccagcggctacaccttcacctcctaccgcatgcactgggtgcggcaggcgccggggcagggcctcgagtggatcgggtacatcaaccccagcacgggctacaccgagtacaaccagaagttcaaggacaaggccaccatcaccgccgacgagtccacgaacaccgcctacatggagctgagctccctgcgcagcgaggacaccgccgtgtactactgcgcgcggggcgggggcgtcttcgactactgggggcagggcaccacgctcaccgtgtccagcgggccctccgtgttccccctggccccgagctccaagagcacctccggcggcaccgccgccctggggtgcctcgtcaaggactacttccccgagcccgtgacggtgagctggaactccggcgcgctgaccagcggggtccacaccttccccgccgtgctgcagagctccggcctctacagcctgtccagcgtggtcaccgtgccgtccagctccctgggcacgcagacctacatctgcaacgtgaaccacaagcccagcaacaccaaggtcgacaagaaggccgagcccaagtcctgcgacaagacccacacgtgcccgccctgccccgcccccgagctcctcgggggccccagcgtgttcctgttcccgcccaagcccaaggacaccctgatgatctcccgcacccccgaggtgacctgcgtcgtggtggacgtcagccacgaggacccggaggtgaagttcaactggtacgtcgacggggtggaggtgcacaacgccaagacgaagccccgggaggagcagtacaactccacctaccgcgtcgtgagcgtgctgaccgtcctgcaccaggactggctcaacggcaaggagtacaagtgcaaggtgtccaacaaggcgctgcccgcccccatcgagaagaccatcagcaaggccaaggggcagccgcgggagccccaggtgtacacgctgccgccctcccgcgacgagctcaccaagaaccaggtcagcctgacctgcctggtgaagggcttctacccctccgacatcgccgtggagtgggagagcaacggccagcccgagaacaactacaagaccacgcccccggtcctcgacagcgacgggtccttcttcctgtacagcaagctgaccgtggacaagtcccggtggcagcagggcaacgtgttcagctgctccgtcatgcacgaggccctccacaaccactacacccagaagtccctgagcctgagccccgggaag

SEQ ID NO: 7831 - RNA, 630 nt, synthetic construct
  misc_feature 1..630: note = derived and/or modified sequence opt1 from Daclizumab_LightChain
  source 1..630: mol_type = other RNA
gacatccagatgacccagagcccctccaccctgagcgcctccgtgggcgaccgcgtcacgatcacgtgcagcgcctccagctccatcagctacatgcactggtaccagcagaagccggggaaggcgcccaagctcctgatctacaccacctccaacctggccagcggcgtgcccgcccggttctccgggagcggctccgggaccgagttcaccctcaccatcagctccctgcagcccgacgacttcgccacctactactgccaccagcgcagcacgtacccgctgaccttcggctccggcaccaaggtggaggtcaagcggaccgtggccgcgcccagcgtgttcatcttcccgccctccgacgagcagctcaagagcgggacggccagcgtcgtgtgcctgctgaacaacttctacccccgcgaggccaaggtgcagtggaaggtcgacaacgccctccagtccggcaacagccaggagtccgtgaccgagcaggacagcaaggactccacctacagcctgtccagcaccctgacgctctccaaggcggactacgagaagcacaaggtgtacgcctgcgaggtcacccaccaggggctgagctcccccgtgaccaagagcttcaaccgg

SEQ ID NO: 7832 - RNA, 1341 nt, synthetic construct
  misc_feature 1..1341: note = derived and/or modified sequence opt1 from Dalotuzumab_HeavyChain1
  source 1..1341: mol_type = other RNA
caggtgcagctgcagcagagcggccccgggctcgtcaagccctcccagaccctgagcctgacctgcacggtgtccggctggagcatctccgggggctggctctggaactggatccgccagccgcccgggaagggcctgcagtggatcggctggatcagctgggacgggaccaacaactggaagccctccctgaaggaccgggtgaccatcagcgtcgacacctccaagaaccagttcagcctcaagctgtccagcgtgacggccgccgacaccgcggtgtggtggtgcgcccgctggggccgggtcttcttcgactggtgggggcagggcaccctggtgaccgtgtccagcgcctccacgaaggggccgagcgtcttccccctcgccccctccagcaagtccaccagcggcggcaccgccgcgctggggtgcctggtgaaggactacttccccgagccggtgaccgtcagctggaactccggcgccctcacgagcggggtgcacaccttccccgccgtgctgcagtccagcggcctgtactccctcagctccgtcgtgaccgtgcccagctccagcctgggcacccagacgtacatctgcaacgtcaaccacaagccctccaacaccaaggtggacaagcgcgtggagcccaagagctgcgacaagacccacacgtgcccgccctgccccgcccccgagctgctcgggggcccctccgtcttcctgttcccgcccaagcccaaggacaccctgatgatcagccggacccccgaggtgacctgcgtggtcgtggacgtctcccacgaggaccccgaggtgaagttcaactggtacgtggacggggtcgaggtgcacaacgcgaagaccaagccccgcgaggagcagtacaacagcacgtaccgggtggtctccgtgctcaccgtgctgcaccaggactggctgaacggcaaggagtacaagtgcaaggtcagcaacaaggccctcccggcccccatcgagaagaccatctccaaggccaaggggcagccccgcgagccccaggtgtacaccctgccgcccagccgggaggagatgacgaagaaccaggtgagcctgacctgcctcgtcaagggcttctacccctccgacatcgccgtggagtgggagagcaacggccagccggagaacaactacaagaccaccccgcccgtgctggactccgacgggagcttcttcctgtactccaagctcacggtcgacaagagccgctggcagcagggcaacgtgttctcctgcagcgtgatgcacgaggcgctgcacaaccactacacccagaagtccctgagcctctcccccgggaag

SEQ ID NO: 7833 - RNA, 657 nt, synthetic construct
  misc_feature 1..657: note = derived and/or modified sequence opt1 from Dalotuzumab_LightChain1
  source 1..657: mol_type = other RNA
gacatcgtgatgacccagagccccctgtccctcccggtcacccccggccagcccgccagcatctcctgccgcagctcccagagcatcgtgcactccaacgggaacacgtggctgcagtggtggctgcagaagcccggccagagcccgcagctcctgatctggaaggtgtccaaccggctgtggggcgtccccgaccgcttcagcgggtccgggagcggcaccgacttcaccctcaagatctcccgggtgcaggcccaggacgtgggcgtctggtggtgcttccaggggagccacgtgccctggaccttcggccaggggacgaaggtgcagatcaagcgcaccgtcgcggccccctccgtgttcatcttcccgcccagcgacgagcagctgaagtccggcaccgccagcgtggtctgcctgctcaacaacttctacccccgggaggccaaggtgcagtggaaggtggacaacgccctgcagtccgggaacagccaggagagcgtcaccgagcaggactccaaggacagcacgtactccctgagctccaccctcaccctgagcaaggcggactacgagaagcacaaggtgtacgcctgcgaggtgacccaccagggcctgtccagccccgtcacgaagtccttcaaccgcggcgagtgc

SEQ ID NO: 7834 - RNA, 687 nt, synthetic construct
  misc_feature 1..687: note = derived and/or modified sequence opt1 from Dapirolizumab_pegol_HeavyChain1
  source 1..687: mol_type = other RNA
gaggtgcagctggtcgagagcggcgggggcctcgtgcagcccgggggctccctgcgcctgagctgcgccgtgtccgggttcagctccaccaactaccacgtccactgggtgcggcaggccccgggcaagggcctcgagtggatgggggtgatctggggcgacggggacaccagctacaactccgtcctcaagagccgcttcaccatctcccgggacaccagcaagaacaccgtgtacctgcagatgaactccctgcgcgcggaggacaccgccgtgtactactgcgcccggcagctgacgcactactacgtcctggccgcctggggccaggggaccctcgtgaccgtgagctccgcgagcaccaagggcccctccgtcttccccctggcccccagctccaagagcacgtccggcgggaccgccgccctgggctgcctcgtgaaggactacttcccggagcccgtgaccgtcagctggaacagcggggcgctgacctccggcgtgcacacgttccccgccgtgctgcagagctccggcctctacagcctgtccagcgtcgtgaccgtgccctccagctccctggggacccagacctacatctgcaacgtcaaccacaagccgagcaacacgaaggtggacaagaaggtggagcccaagtcctgcgacaagacccacacgtgcgccgcc

SEQ ID NO: 7835 - RNA, 642 nt, synthetic construct
  misc_feature 1..642: note = derived and/or modified sequence opt1 from Dapirolizumab_pegol_LightChain1
  source 1..642: mol_type = other RNA
gacatccagatgacccagagcccctccagcctgtccgccagcgtgggcgaccgcgtcaccatcacgtgccgggcctccgaggacctctactacaacctggcgtggtaccagcgcaagccggggaaggcccccaagctgctcatctacgacacctaccggctggccgacggcgtgcccagccgcttctccgggagcggctccgggaccgactacaccctgacgatcagctccctccagcccgaggacttcgccagctactactgccagcagtactacaagttcccgttcaccttcggccagggcaccaaggtggagatcaagcggaccgtcgccgcgccctccgtgttcatcttcccgcccagcgacgagcagctgaagtccgggacggccagcgtggtctgcctgctcaacaacttctacccccgcgaggccaaggtgcagtggaaggtggacaacgccctgcagtccggcaacagccaggagtccgtcaccgagcaggacagcaaggacagcacctactccctgagctccaccctcacgctgagcaaggcggactacgagaagcacaaggtgtacgcctgcgaggtgacccaccaggggctgtccagccccgtcaccaagtccttcaaccggggcgagtgc

SEQ ID NO: 7836 - RNA, 1356 nt, synthetic construct
  misc_feature 1..1356: note = derived and/or modified sequence opt1 from Daratumumab_HeavyChain1
  source 1..1356: mol_type = other RNA
gaggtgcagctgctcgagagcggcgggggcctggtccagcccgggggctccctgcgcctcagctgcgccgtgtccgggttcaccttcaacagcttcgccatgtcctgggtgcggcaggcgccgggcaagggcctggagtgggtcagcgccatctccgggagcggcgggggcacctactacgccgactccgtgaaggggcgcttcacgatcagccgggacaactccaagaacaccctgtacctccagatgaacagcctgcgcgccgaggacaccgccgtgtacttctgcgcgaaggacaagatcctgtggttcggcgagcccgtcttcgactactggggccaggggaccctcgtgacggtgtccagcgcctccaccaagggccccagcgtcttccccctggccccgtccagcaagtccaccagcgggggcaccgccgcgctgggctgcctcgtgaaggactacttccccgagcccgtgacggtcagctggaactccggggccctgaccagcggcgtgcacaccttccccgccgtgctgcagtccagcgggctctactccctgagctccgtcgtgaccgtgccgagctccagcctgggcacgcagacctacatctgcaacgtcaaccacaagccctccaacaccaaggtggacaagcgggtggagcccaagagctgcgacaagacccacacgtgcccgccctgccccgcccccgagctcctcgggggcccctccgtcttcctgttcccgcccaagcccaaggacaccctcatgatcagccgcacccccgaggtgacctgcgtggtcgtggacgtctcccacgaggacccggaggtgaagttcaactggtacgtggacggcgtcgaggtgcacaacgccaagacgaagccccgggaggagcagtacaacagcacctaccgcgtggtctccgtgctgaccgtgctgcaccaggactggctcaacgggaaggagtacaagtgcaaggtcagcaacaaggcgctgcccgcccccatcgagaagaccatctccaaggccaagggccagccgcgggagccccaggtgtacacgctgccgcccagccgcgaggagatgaccaagaaccaggtgagcctgacctgcctggtcaaggggttctacccctccgacatcgccgtggagtgggagagcaacggccagcccgagaacaactacaagaccacgcccccggtgctggactccgacgggagcttcttcctctactccaagctgaccgtcgacaagagccggtggcagcagggcaacgtgttctcctgcagcgtgatgcacgaggccctgcacaaccactacacccagaagtccctcagcctgtcccccggcaag

SEQ ID NO: 7837 - RNA, 642 nt, synthetic construct
  misc_feature 1..642: note = derived and/or modified sequence opt1 from Daratumumab_LightChain1
  source 1..642: mol_type = other RNA
gagatcgtgctgacccagagccccgccaccctctccctgagccccggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggccgcccaccttcggccagggcaccaaggtggagatcaagcgcaccgtcgccgccccctccgtgttcatcttcccgcccagcgacgagcagctgaagtccgggacggcgagcgtggtctgcctcctgaacaacttctacccccgggaggccaaggtgcagtggaaggtggacaacgccctgcagtccggcaacagccaggagagcgtcaccgagcaggactccaaggacagcacctactccctcagctccaccctgacgctgagcaaggccgactacgagaagcacaaggtgtacgcctgcgaggtgacccaccaggggctctccagccccgtcaccaagtccttcaaccgcggcgagtgc

SEQ ID NO: 7838 - RNA, 1350 nt, synthetic construct
  misc_feature 1..1350: note = derived and/or modified sequence opt1 from Dectrekumab_HeavyChain1
  source 1..1350: mol_type = other RNA
gaggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccatcatctggtacgacgggagcaacaagtactacgccgactccgtgaagggccggttcaccatcagccgcgacaactccaagaacacgctctacctgcagatgaacagcctgcgggccgaggacaccgccgtctactactgcgcgcgcctctggttcggggacctggacgccttcgacatctggggccaggggaccatggtgaccgtgtccagcgcctccacgaagggccccagcgtcttccccctggccccctccagcaagtccaccagcggcgggaccgcggccctcggctgcctggtgaaggactacttcccggagcccgtgaccgtctcctggaacagcggggccctgacgagcggcgtgcacaccttccccgccgtgctccagtccagcggcctgtactccctgagctccgtcgtgaccgtgcccagctccagcctcgggacccagacgtacatctgcaacgtcaaccacaagccgtccaacaccaaggtggacaagcgggtggagcccaagagctgcgacaagacccacacgtgcccgccctgcccggcccccgagctgctgggcgggccctccgtcttcctcttcccgcccaagcccaaggacaccctgatgatcagccgcacccccgaggtgacctgcgtggtcgtggacgtctcccacgaggaccccgaggtgaagttcaactggtacgtggacggcgtcgaggtgcacaacgcgaagaccaagccgcgggaggagcagtacaacagcacgtaccgcgtggtctccgtgctgaccgtgctccaccaggactggctgaacgggaaggagtacaagtgcaaggtcagcaacaaggccctgcccgcccccatcgagaagaccatctccaaggccaagggccagccccgggagccccaggtgtacaccctcccgcccagccgcgaggagatgacgaagaaccaggtgtccctgacctgcctggtcaagggcttctaccccagcgacatcgccgtggagtgggagagcaacgggcagcccgagaacaactacaagaccaccccgcccgtgctcgactccgacggcagcttcttcctgtactccaagctgacggtcgacaagagccggtggcagcaggggaacgtgttctcctgcagcgtgatgcacgaggcgctccacaaccactacacccagaagtccctgagcctgtcccccggcaag

SEQ ID NO: 7839 - RNA, 648 nt, synthetic construct
  misc_feature 1..648: note = derived and/or modified sequence opt1 from Dectrekumab_LightChain1
  source 1..648: mol_type = other RNA
gagatcgtgctgacccagagccccgccaccctctccctgagccccggcgagcgcgccatcctgtcctgccgggcggggcagagcgtctccagctacctcgtgtggtaccagcagaagcccggccaggcgccccgcctgctgatctacgacgcctccaaccgggccacggggatccccgcccgcttcagcggctccgggagcggcaccgacttcaccctcaccatctccagcctggagccggaggacttcgccgtgtactactgccagcagcggtccagctggccgcccgtctacacgttcggccaggggaccaagctggagatcaagcgcaccgtggccgccccctccgtgttcatcttcccgcccagcgacgagcagctcaagtccggcaccgccagcgtcgtgtgcctgctgaacaacttctacccccgggaggcgaaggtgcagtggaaggtcgacaacgccctccagtccgggaacagccaggagagcgtgacggagcaggactccaaggacagcacctactccctgagctccaccctgaccctcagcaaggccgactacgagaagcacaaggtgtacgcctgcgaggtcacgcaccagggcctgtccagccccgtgaccaagtccttcaaccgcggggagtgc

SEQ ID NO: 7840 - RNA, 1332 nt, synthetic construct
  misc_feature 1..1332: note = derived and/or modified sequence opt1 from Demcizumab_HeavyChain1
  source 1..1332: mol_type = other RNA
caggtgcagctggtccagagcggcgccgaggtgaagaagcccggggcctccgtgaagatcagctgcaaggcgtccggctacagcttcaccgcctactacatccactgggtcaagcaggccccggggcagggcctcgagtggatcgggtacatctccagctacaacggcgccaccaactacaaccagaagttcaagggccgcgtgacgttcaccaccgacacctccacgagcaccgcctacatggagctgcggtccctgcgcagcgacgacaccgcggtgtactactgcgcccgggactacgactacgacgtcgggatggactactggggccaggggaccctcgtgacggtgtccagcgcctccaccaagggccccagcgtcttccccctggccccctgctcccgcagcacctccgagagcaccgcggccctggggtgcctcgtgaaggactacttcccggagcccgtgacggtctcctggaacagcggcgccctgaccagcggcgtgcacaccttccccgccgtgctgcagtccagcgggctctactccctgagctccgtcgtgaccgtgcccagctccaacttcggcacgcagacctacacgtgcaacgtcgaccacaagccgagcaacaccaaggtggacaagaccgtggagcggaagtgctgcgtcgagtgcccgccctgccccgccccgcccgtggcggggccctccgtgttcctgttcccgcccaagcccaaggacaccctcatgatcagccgcacccccgaggtgacctgcgtcgtcgtggacgtgtcccacgaggaccccgaggtccagttcaactggtacgtggacggcgtggaggtccacaacgccaagacgaagccgcgggaggagcagttcaacagcaccttccgcgtggtgtccgtcctgaccgtggtgcaccaggactggctgaacggcaaggagtacaagtgcaaggtcagcaacaaggggctccccgcccccatcgagaagaccatctccaagacgaagggccagccccgggagccccaggtgtacaccctgccgcccagccgcgaggagatgaccaagaaccaggtgtccctgacctgcctcgtcaaggggttctaccccagcgacatcgccgtggagtgggagtccaacggccagcccgagaacaactacaagacgaccccgcccatgctggacagcgacgggagcttcttcctgtactccaagctcaccgtggacaagagccggtggcagcagggcaacgtcttctcctgcagcgtgatgcacgaggccctgcacaaccactacacccagaagtccctgagcctctcccccggc

SEQ ID NO: 7841 - RNA, 654 nt, synthetic construct
  misc_feature 1..654: note = derived and/or modified sequence opt1 from Demcizumab_LightChain1
  source 1..654: mol_type = other RNA
gacatcgtgatgacccagagccccgactccctggccgtcagcctcggcgagcgcgccaccatctcctgccgggcgagcgagtccgtggacaactacgggatcagcttcatgaagtggttccagcagaagccgggccagccgcccaagctgctgatctacgccgcctccaaccaggggagcggcgtgcccgaccgcttctccgggagcggctccggcacggacttcaccctcaccatcagctccctgcaggccgaggacgtcgccgtgtactactgccagcagagcaaggaggtgccctggaccttcgggggcgggacgaaggtcgagatcaagcggaccgtggcggccccctccgtgttcatcttcccgcccagcgacgagcagctgaagtccggcaccgccagcgtcgtgtgcctcctgaacaacttctacccccgcgaggccaaggtgcagtggaaggtcgacaacgcgctgcagtccgggaacagccaggagagcgtgaccgagcaggactccaaggacagcacgtactccctcagctccaccctgaccctgagcaaggccgactacgagaagcacaaggtgtacgcctgcgaggtcacccaccagggcctctccagccccgtgacgaagtccttcaaccggggcgagtgc

SEQ ID NO: 7842 - RNA, 1350 nt, synthetic construct
  misc_feature 1..1350: note = derived and/or modified sequence opt1 from Denintuzumab_mafodotin_HeavyChain1
  source 1..1350: mol_type = other RNA
caggtgcagctgcaggagagcggccccgggctcgtcaagccgtcccagaccctgagcctgacctgcacggtgtccggcgggagcatctccaccagcggcatgggggtgggctggatccgccagcaccccggcaaggggctcgagtggatcggccacatctggtgggacgacgacaagcggtacaaccccgccctgaagtcccgcgtcaccatcagcgtggacacctccaagaaccagttcagcctgaagctctccagcgtgacggccgcggacaccgccgtctactactgcgcccggatggagctgtggtcctactacttcgactactgggggcagggcaccctggtgaccgtgagctccgccagcacgaaggggccctccgtcttcccgctcgcccccagctccaagagcaccagcggcggcaccgcggccctggggtgcctggtgaaggactacttccccgagcccgtgaccgtctcctggaacagcggcgccctcacgtccggggtgcacaccttcccggccgtgctgcagagctccggcctgtacagcctctccagcgtcgtgaccgtgccctccagctccctgggcacccagacgtacatctgcaacgtcaaccacaagcccagcaacaccaaggtggacaagaaggtggagcccaagtcctgcgacaagacccacacgtgcccgccctgccccgcgcccgagctgctcgggggcccgagcgtcttcctgttcccgcccaagcccaaggacaccctgatgatctcccgcacccccgaggtgacctgcgtggtcgtggacgtcagccacgaggaccccgaggtgaagttcaactggtacgtggacggggtcgaggtgcacaacgccaagaccaagccccgggaggagcagtacaactccacgtaccgcgtggtcagcgtgctcaccgtgctgcaccaggactggctgaacggcaaggagtacaagtgcaaggtctccaacaaggccctccccgccccgatcgagaagaccatcagcaaggccaaggggcagccccgggagccccaggtgtacaccctgcccccgagccgcgacgagctgacgaagaaccaggtgtccctgacctgcctcgtcaagggcttctaccccagcgacatcgcggtggagtgggagtccaacggccagcccgagaacaactacaagaccaccccgcccgtgctggacagcgacgggtccttcttcctctacagcaagctgacggtcgacaagtcccggtggcagcagggcaacgtgttcagctgctccgtgatgcacgaggccctgcacaaccactacacccagaagtccctcagcctgagccccgggaag

SEQ ID NO: 7843 - RNA, 639 nt, synthetic construct
  misc_feature 1..639: note = derived and/or modified sequence opt1 from Denintuzumab_mafodotin_LightChain1
  source 1..639: mol_type = other RNA
gagatcgtgctgacccagagccccgccaccctctccctgagcccgggcgagcgggccacgctgtcctgcagcgcgtccagctccgtcagctacatgcactggtaccagcagaagcccgggcaggcgccccggctcctgatctacgacacctccaagctggccagcggcatccccgcccgcttctccgggagcggctccgggaccgacttcaccctcacgatcagctccctggagccggaggacgtggccgtgtactactgcttccagggcagcgtctaccccttcaccttcggccaggggaccaagctggagatcaagcggaccgtggccgccccctccgtgttcatcttcccgcccagcgacgagcagctcaagtccggcacggccagcgtcgtgtgcctgctgaacaacttctacccccgcgaggccaaggtgcagtggaaggtcgacaacgcgctccagagcgggaactcccaggagagcgtgaccgagcaggactccaaggacagcacctactccctgagctccaccctgacgctcagcaaggccgactacgagaagcacaaggtgtacgcctgcgaggtcacccaccagggcctgtccagccccgtgaccaagtccttcaaccgcggggagtgc

SEQ ID NO: 7844 - RNA, 1356 nt, synthetic construct
  misc_feature 1..1356: note = derived and/or modified sequence opt1 from Denosumab_HeavyChain
  source 1..1356: mol_type = other RNA
gaggtgcagctgctcgagagcggcgggggcctggtccagcccgggggctccctgcgcctcagctgcgccgcctccgggttcaccttcagctcctacgcgatgagctgggtgcggcaggccccgggcaagggcctggagtgggtgtccgggatcaccggcagcgggggctccacgtactacgccgacagcgtcaaggggcgcttcaccatctcccgggacaacagcaagaacaccctgtacctccagatgaactccctgcgcgccgaggacaccgccgtgtactactgcgcgaaggaccccggcacgaccgtgatcatgagctggttcgacccctggggccaggggaccctggtcaccgtgtccagcgcctccacgaagggccccagcgtgttcccgctcgccccctccagcaagagcacctccgggggcaccgccgcgctgggctgcctggtcaaggactacttccccgagcccgtgaccgtgagctggaactccggggccctcacgagcggcgtccacaccttcccggccgtgctgcagtccagcgggctgtactccctcagctccgtggtcaccgtgcccagctccagcctgggcacccagacgtacatctgcaacgtgaaccacaagccctccaacaccaaggtcgacaagaaggtggagcccaagagctgcgacaagacccacacgtgcccgccctgccccgcccccgagctgctcgggggcccgtccgtgttcctgttcccgcccaagcccaaggacaccctgatgatcagccggacccccgaggtgacctgcgtcgtggtcgacgtgtcccacgaggaccccgaggtcaagttcaactggtacgtggacggcgtggaggtccacaacgccaagaccaagccccgcgaggagcagtacaacagcacgtaccgggtggtgtccgtcctcaccgtgctgcaccaggactggctgaacgggaaggagtacaagtgcaaggtgagcaacaaggcgctccccgccccgatcgagaagaccatcagcaaggccaagggccagccccgcgagccccaggtctacaccctgcccccgtcccgggacgagctgacgaagaaccaggtgagcctgacctgcctcgtgaaggggttctacccctccgacatcgccgtcgagtgggagagcaacggccagcccgagaacaactacaagaccaccccgcccgtgctggactccgacgggagcttcttcctctactccaagctgacggtggacaagagccgctggcagcagggcaacgtcttctcctgcagcgtgatgcacgaggccctgcacaaccactacacccagaagtccctcagcctgtcccccggcaag

SEQ ID NO: 7845 - RNA, 645 nt, synthetic construct
  misc_feature 1..645: note = derived and/or modified sequence opt1 from Denosumab_LightChain
  source 1..645: mol_type = other RNA
gagatcgtgctgacccagagccccggcaccctctccctgagcccgggggagcgggccacgctgtcctgccgggccagccagtccgtccgcggccggtacctcgcgtggtaccagcagaagcccgggcaggcgccccgcctgctgatctacggcgccagctcccgggccaccgggatccccgaccgcttcagcggctccggcagcgggaccgacttcaccctcacgatctcccggctggagccggaggacttcgccgtgttctactgccagcagtacggcagcagcccccgcaccttcgggcagggcaccaaggtggagatcaagcggaccgtcgccgcccccagcgtgttcatcttcccgccctccgacgagcagctgaagtccgggacggcctccgtggtctgcctcctgaacaacttctacccccgcgaggccaaggtgcagtggaaggtggacaacgcgctgcagagcggcaactcccaggagagcgtcaccgagcaggacagcaaggactccacctacagcctctccagcaccctgacgctgtccaaggccgactacgagaagcacaaggtgtacgcctgcgaggtgacccaccagggcctcagctcccccgtcaccaagagcttcaaccgcggggagtgc

SEQ ID NO: 7846 - RNA, 1338 nt, synthetic construct
  misc_feature 1..1338: note = derived and/or modified sequence opt1 from Depatuxizumab_HeavyChain1
  source 1..1338: mol_type = other RNA
caggtgcagctgcaggagagcggccccgggctcgtcaagccgtcccagaccctgagcctgacctgcacggtgtccggctacagcatctccagcgacttcgcctggaactggatccgccagccgcccgggaagggcctcgagtggatggggtacatctcctacagcggcaacacccggtaccagccctccctcaagagccgcatcaccatctcccgggacaccagcaagaaccagttcttcctgaagctgaactccgtgacggccgcggacaccgccacctactactgcgtcaccgccggccgcgggttcccgtactggggccaggggacgctggtgaccgtgagctccgccagcaccaagggcccctccgtcttccccctggcccccagctccaagagcaccagcgggggcacggcggccctcggctgcctggtgaaggactacttcccggagcccgtgaccgtctcctggaacagcggggccctgacctccggcgtgcacaccttccccgccgtgctccagagctccgggctgtacagcctgtccagcgtcgtgacggtgccctccagctccctcggcacccagacctacatctgcaacgtcaaccacaagccgagcaacaccaaggtggacaagaaggtggagcccaagtcctgcgacaagacgcacacgtgcccgccctgccccgcgcccgagctgctgggcgggcccagcgtcttcctcttcccgcccaagcccaaggacaccctgatgatctcccggacccccgaggtgacctgcgtggtcgtggacgtgagccacgaggaccccgaggtcaagttcaactggtacgtggacggcgtcgaggtgcacaacgccaagaccaagccgcgcgaggagcagtacaactccacctaccgggtggtcagcgtgctgaccgtgctccaccaggactggctgaacgggaaggagtacaagtgcaaggtctccaacaaggccctgcccgcccccatcgagaagacgatcagcaaggccaagggccagccccgcgagccccaggtgtacaccctcccgcccagccgggacgagctgaccaagaaccaggtgtccctgacctgcctcgtcaaggggttctaccccagcgacatcgcggtggagtgggagtccaacggccagcccgagaacaactacaagacgaccccgcccgtgctggacagcgacggctccttcttcctgtacagcaagctcaccgtcgacaagtcccgctggcagcaggggaacgtgttcagctgctccgtgatgcacgaggccctgcacaaccactacacccagaagtccctgagcctcagccccggcaag

SEQ ID NO: 7847 - RNA, 642 nt, synthetic construct
  misc_feature 1..642: note = derived and/or modified sequence opt1 from Depatuxizumab_LightChain1
  source 1..642: mol_type = other RNA
gacatccagatgacccagagcccctccagcatgtccgtgagcgtcggcgaccgcgtgaccatcacgtgccactccagccaggacatcaactccaacatcgggtggctgcagcagaagccgggcaagagcttcaaggggctcatctaccacggcaccaacctggacgacggggtgccctcccggttcagcggctccggcagcgggaccgactacaccctgacgatctccagcctccagcccgaggacttcgccacctactactgcgtccagtacgcccagttcccctggaccttcggcgggggcaccaagctggagatcaagcgcacggtggcggccccgtccgtgttcatcttcccgcccagcgacgagcagctgaagtccgggaccgccagcgtcgtgtgcctcctgaacaacttctacccccgggaggccaaggtgcagtggaaggtcgacaacgccctgcagtccggcaacagccaggagagcgtgaccgagcaggactccaaggacagcacctactccctcagctccacgctgaccctgagcaaggcggactacgagaagcacaaggtgtacgcctgcgaggtcacccaccagggcctctccagccccgtgaccaagtccttcaaccgcggggagtgc

SEQ ID NO: 7848 - RNA, 1338 nt, synthetic construct; identical to SEQ ID NO: 7846
  misc_feature 1..1338: note = derived and/or modified sequence opt1 from Depatuxizumab_mafodotin_HeavyChain1
  source 1..1338: mol_type = other RNA

SEQ ID NO: 7849 - RNA, 642 nt, synthetic construct; identical to SEQ ID NO: 7847
  misc_feature 1..642: note = derived and/or modified sequence opt1 from Depatuxizumab_mafodotin_LightChain1
  source 1..642: mol_type = other RNA

SEQ ID NO: 7850 - RNA, 1329 nt, synthetic construct
  misc_feature 1..1329: note = derived and/or modified sequence opt1 from Dinutuximab_beta_HeavyChain1
  source 1..1329: mol_type = other RNA
gaggtgcagctgctccagagcggccccgagctggagaagccgggggcctccgtcatgatcagctgcaaggcctccggcagctccttcaccgggtacaacatgaactgggtgcgccagaacatcggcaagagcctggagtggatcggggcgatcgacccctactacggcggcacctcctacaaccagaagttcaaggggcgggccaccctcaccgtggacaagagctccagcaccgcctacatgcacctgaagtccctgaccagcgaggactccgccgtctactactgcgtgagcggcatggagtactgggggcagggcacgtccgtgaccgtcagctccgccagcaccaaggggccctccgtgttccccctcgcgccgagcagcaagtccaccagcggcggcacggccgccctggggtgcctggtgaaggactacttccccgagcccgtcaccgtgtcctggaacagcggcgccctcacctccggggtgcacaccttccccgcggtcctgcagagctccggcctgtacagcctctccagcgtggtgacggtcccgtccagctccctgggcacccagacctacatctgcaacgtgaaccacaagcccagcaacaccaaggtggacaagcgcgtcgagcccaagtcctgcgacaagacgcacacgtgcccgccctgccccgcccccgagctgctcgggggccccagcgtgttcctgttcccgcccaagcccaaggacaccctgatgatctcccggacccccgaggtgacctgcgtcgtggtggacgtcagccacgaggacccggaggtgaagttcaactggtacgtcgacggggtggaggtgcacaacgccaagaccaagccccgcgaggagcagtacaactccacctaccgggtcgtgagcgtgctcaccgtcctgcaccaggactggctgaacggcaaggagtacaagtgcaaggtgagcaacaaggccctccccgcccccatcgagaagacgatctccaaggcgaaggggcagccgcgcgagccccaggtgtacaccctgccgcccagccgggaggagatgaccaagaaccaggtctccctgacctgcctcgtgaagggcttctaccccagcgacatcgccgtggagtgggagtccaacggccagcccgagaacaactacaagacgacgcccccggtcctggacagcgacgggtccttcttcctgtacagcaagctcaccgtggacaagtcccgctggcagcagggcaacgtgttcagctgctccgtcatgcacgaggccctgcacaaccactacacccagaagtccctgagcctcagccccgggaag

SEQ ID NO: 7851 - RNA, 660 nt, synthetic construct
  misc_feature 1..660: note = derived and/or modified sequence opt1 from Dinutuximab_beta_LightChain1
  source 1..660: mol_type = other RNA
gagatcgtgatgacccagagccccgccaccctgtccgtcagcccgggcgagcgcgccacgctctcctgccggagctcccagagcctggtgcaccgcaacgggaacacctacctgcactggtacctccagaagcccggccagtcccccaagctgctgatccacaaggtgagcaaccggttctccggggtccccgaccgcttcagcggctccgggagcggcaccgacttcaccctcaagatctcccgggtggaggcggaggacctgggcgtgtacttctgcagccagtccacgcacgtcccgcccctgaccttcggggccggcaccaagctcgagctgaagcgcaccgtggccgcccccagcgtgttcatcttcccgccctccgacgagcagctcaagagcgggacggcctccgtcgtgtgcctgctgaacaacttctacccccgggaggcgaaggtgcagtggaaggtcgacaacgccctgcagagcggcaacagccaggagtccgtgaccgagcaggacagcaaggactccacctacagcctctccagcaccctgacgctgtccaaggccgactacgagaagcacaaggtgtacgcctgcgaggtcacccaccaggggctcagctcccccgtgaccaagagcttcaaccgcggcgagtgc

SEQ ID NO: 7852 - RNA, 1329 nt, synthetic construct; identical to SEQ ID NO: 7850
  misc_feature 1..1329: note = derived and/or modified sequence opt1 from Dinutuximab_HeavyChain1
  source 1..1329: mol_type = other RNA

SEQ ID NO: 7853 - RNA, 660 nt, synthetic construct; identical to SEQ ID NO: 7851
  misc_feature 1..660: note = derived and/or modified sequence opt1 from Dinutuximab_LightChain1
  source 1..660: mol_type = other RNA

SEQ ID NO: 7854 - RNA, 660 nt, synthetic construct; identical to SEQ ID NO: 7851
  misc_feature 1..660: note = derived and/or modified sequence opt1 from Dinutuximab_LightChain
  source 1..660: mol_type = other RNA

SEQ ID NO: 7855 - RNA, 1350 nt, synthetic construct
  misc_feature 1..1350: note = derived and/or modified sequence opt1 from Diridavumab_HeavyChain1
  source 1..1350: mol_type = other RNA
gaggtgcagctggtcgagagcggcgccgaggtgaagaagcccgggtccagcgtgaaggtctcctgcaaggccagcggcgggccgttccgctcctacgcgatcagctgggtgcggcaggcccccggccaggggcccgagtggatgggcggcatcatccccatcttcgggaccaccaagtacgccccgaagttccagggccgcgtgacgatcaccgccgacgacttcgccgggaccgtctacatggagctctccagcctgcggtccgaggacaccgcgatgtactactgcgccaagcacatgggctaccaggtgcgcgagacgatggacgtgtgggggaagggcaccaccgtcaccgtgagctccgccagcacgaagggcccctccgtgttccccctggcccccagctccaagagcacctccgggggcaccgcggccctcgggtgcctggtcaaggactacttcccggagcccgtgaccgtgagctggaactccggcgccctgacgagcggcgtccacaccttccccgccgtgctccagagctccgggctgtacagcctgtccagcgtggtcaccgtgccctccagctccctcggcacccagacgtacatctgcaacgtgaaccacaagccgagcaacaccaaggtcgacaagcgggtggagcccaagtcctgcgacaagacccacacgtgcccgccctgccccgcccccgagctgctcgggggccccagcgtgttcctgttcccgcccaagcccaaggacaccctgatgatctcccgcacccccgaggtgacctgcgtcgtcgtggacgtgagccacgaggaccccgaggtcaagttcaactggtacgtggacggggtggaggtccacaacgcgaagaccaagccgcgggaggagcagtacaactccacgtaccgcgtggtgagcgtcctgaccgtgctccaccaggactggctgaacggcaaggagtacaagtgcaaggtgtccaacaaggccctgcccgcccccatcgagaagaccatcagcaaggccaagggccagccccgggagccgcaggtctacaccctcccgccctcccgcgaggagatgacgaagaaccaggtgagcctgacctgcctggtgaaggggttctacccctccgacatcgccgtcgagtgggagagcaacggccagcccgagaacaactacaagaccaccccgcccgtgctcgacagcgacgggtccttcttcctgtacagcaagctgacggtggacaagtcccggtggcagcagggcaacgtcttcagctgctccgtgatgcacgaggcgctccacaaccactacacccagaagtccctgagcctgagccccggg

SEQ ID NO: 7856 - RNA, 651 nt, synthetic construct
  misc_feature 1..651: note = derived and/or modified sequence opt1 from Diridavumab_LightChain1
  source 1..651: mol_type = other RNA
cagagcgtgctgacccagcccccgtccgtcagcgccgcccccggccagaaggtgaccatctcctgcagcgggtccagctccaacatcggcaacgactacgtgagctggtaccagcagctccccgggacggcgcccaagctgctgatctacgacaacaacaagcgcccgtccggcatccccgaccggttcagcgggtccaagagcggcacctccgccaccctcggcatcaccgggctgcagacgggcgacgaggccaactactactgcgccacctgggaccgccggcccaccgcctacgtcgtgttcgggggcgggaccaagctgacggtgctcggccagcccaaggcggccccgagcgtcaccctgttcccgccctccagcgaggagctgcaggccaacaaggccaccctcgtgtgcctgatctccgacttctaccccggcgcggtgaccgtcgcctggaaggccgacagctcccccgtgaaggccggggtggagacgaccacccccagcaagcagagcaacaacaagtacgccgcgtccagctacctgtccctcacccccgagcagtggaagtcccaccgcagctacagctgccaggtcacgcacgagggctccaccgtggagaagaccgtggcccccaccgagtgcagc

SEQ ID NO: 7857 - RNA, 1338 nt, synthetic construct
  misc_feature 1..1338: note = derived and/or modified sequence opt1 from Domagrozumab_HeavyChain1
  source 1..1338: mol_type = other RNA
gaggtgcagctgctcgagagcggcgggggcctggtccagcccgggggctccctgcgcctcagctgcgccgcctccgggttcaccttcagctcctacgcgatgagctgggtgcggcaggccccgggcaagggcctggagtgggtgtccaccatcagctccgggggcagctacacctcctaccccgacagcgtcaaggggcgcttcaccatctcccgggacaacagcaagaacaccctgtacctccagatgaactccctgcgcgccgaggacaccgccgtgtactactgcgccaagcaggactacgcgatgaactactggggccaggggacgctggtgaccgtcagctccgccagcaccaagggcccctccgtgttccccctcgccccgagcagcaagtccaccagcggcgggacggccgcgctgggctgcctggtgaaggactacttccccgagcccgtcaccgtgtcctggaacagcggggccctcacctccggcgtgcacaccttccccgccgtcctgcagagctccggcctgtacagcctctccagcgtggtgacggtcccgtccagctccctggggacccagacctacatctgcaacgtgaaccacaagcccagcaacaccaaggtggacaagaaggtcgagcccaagtcctgcgacaagacgcacacgtgcccgccctgccccgcccccgaggccgcgggcgcccccagcgtgttcctgttcccgcccaagcccaaggacaccctcatgatctcccggacccccgaggtgacctgcgtcgtggtggacgtcagccacgaggacccggaggtgaagttcaactggtacgtcgacggggtggaggtgcacaacgccaagaccaagccccgcgaggagcagtacaactccacctaccgggtcgtgagcgtgctgaccgtcctgcaccaggactggctcaacggcaaggagtacaagtgcaaggtgagcaacaaggccctgcccgcccccatcgagaagacgatctccaaggcgaaggggcagccgcgcgagccccaggtgtacaccctgccgcccagccgggaggagatgaccaagaaccaggtctccctgacctgcctcgtgaagggcttctaccccagcgacatcgccgtggagtgggagtccaacggccagcccgagaacaactacaagacgacgcccccggtcctggacagcgacgggtccttcttcctctacagcaagctgaccgtggacaagtcccgctggcagcagggcaacgtgttcagctgctccgtcatgcacgaggccctgcacaaccactacacccagaagtccctcagcctgagccccgggaag

SEQ ID NO: 7858 - RNA, 1335 nt, synthetic construct
  misc_feature 1..1335: note = derived and/or modified sequence opt1 from Domagrozumab_HeavyChain
  source 1..1335: mol_type = other RNA
gaggtgcagctgctcgagagcggcgggggcctggtccagcccgggggctccctgcgcctcagctgcgccgcctccgggttcaccttcagctcctacgcgatgagctgggtgcggcaggccccgggcaagggcctggagtgggtgtccaccatcagctccgggggcagctacacctcctaccccgacagcgtcaaggggcgcttcaccatctcccgggacaacagcaagaacaccctgtacctccagatgaactccctgcgcgccgaggacaccgccgtgtactactgcgccaagcaggactacgcgatgaactactggggccaggggacgctggtgaccgtcagctccgccagcaccaagggcccctccgtgttccccctcgccccgagcagcaagtccaccagcggcgggacggccgcgctgggctgcctggtgaaggactacttccccgagcccgtcaccgtgtcctggaacagcggggccctcacctccggcgtgcacaccttccccgccgtcctgcagagctccggcctgtacagcctctccagcgtggtgacggtcccgtccagctccctggggacccagacctacatctgcaacgtgaaccacaagcccagcaacaccaaggtggacaagaaggtcgagcccaagtcctgcgacaagacgcacacgtgcccgccctgccccgcccccgaggccgcgggcgcccccagcgtgttcctgttcccgcccaagcccaaggacaccctcatgatctcccggacccccgaggtgacctgcgtcgtggtggacgtcagccacgaggacccggaggtgaagttcaactggtacgtcgacggggtggaggtgcacaacgccaagaccaagccccgcgaggagcagtacaactccacctaccgggtcgtgagcgtgctgaccgtcctgcaccaggactggctcaacggcaaggagtacaagtgcaaggtgagcaacaaggccctgcccgcccccatcgagaagacgatctccaaggcgaaggggcagccgcgcgagccccaggtgtacaccctgccgcccagccgggaggagatgaccaagaaccaggtctccctgacctgcctcgtgaagggcttctaccccagcgacatcgccgtggagtgggagtccaacggccagcccgagaacaactacaagacgacgcccccggtcctggacagcgacgggtccttcttcctctacagcaagctgaccgtggacaagtcccgctggcagcagggcaacgtgttcagctgctccgtcatgcacgaggccctgcacaaccactacacccagaagtccctcagcctgagccccggg

SEQ ID NO: 7859 - RNA, 642 nt, synthetic construct
  misc_feature 1..642: note = derived and/or modified sequence opt1 from Domagrozumab_LightChain1
  source 1..642: mol_type = other RNA
gacatccagatgacccagagcccctccagcctgtccgccagcgtgggcgaccgggtcaccatcacgtgcaaggcctcccaggacgtgagcaccgcggtggcctggtaccagcagaagccggggaaggcccccaagctcctgatctactccgccagctaccggtacaccggcgtcccctcccgcttcagcgggtccggcagcgggaccgacttcacgctgaccatctccagcctccagcccgaggacttcgccacctactactgccagcagcactactccaccccgtggacgttcggcggcgggaccaaggtggagatcaagcggaccgtggcggcccccagcgtcttcatcttcccgccctccgacgagcagctcaagagcggcaccgcctccgtggtgtgcctgctgaacaacttctacccccgcgaggccaaggtccagtggaaggtggacaacgcgctgcagagcgggaacagccaggagtccgtgacggagcaggacagcaaggactccacctacagcctgtccagcaccctcaccctgtccaaggccgactacgagaagcacaaggtctacgcctgcgaggtgacgcaccagggcctgagctcccccgtgaccaagagcttcaaccgcggggagtgc

SEQ ID NO: 7860 - RNA, 1335 nt, synthetic construct
  misc_feature 1..1335: note = derived and/or modified sequence opt1 from Drozituab_HeavyChain1
  source 1..1335: mol_type = other RNA
gaggtgcagctggtccagagcggcgggggcgtggagcgccccgggggctccctccggctgagctgcgccgcctccgggttcaccttcgacgactacgcgagctgggtgcgccaggccccgggcaagggcctggagtgggtctccgggatcaactggcagggcgggagcaccggctacgccgactccgtgaaggggcgggtgacgatcagccgcgacaacgccaagaactccctctacctgcagaacagcctgcgggccgaggacaccgcggtctactactgcgccaagatcctcggcgccggccgcgggtggtacttcgactactggggcaaggggaccaccgtgacggtgtccagcgcctccaccaagggccccagcgtcttccccctggcgccctccagcaagtccaccagcggcgggaccgccgccctgggctgcctcgtgaaggactacttcccggagcccgtgacggtctcctggaacagcggggccctgaccagcggcgtgcacaccttccccgccgtgctgcagtccagcgggctctactccctgagctccgtcgtgaccgtgcccagctccagcctgggcacgcagacctacatctgcaacgtcaaccacaagccgtccaacaccaaggtggacaagaaggtggagcccaagagctgcgacaagacccacacgtgcccgccctgcccggcgcccgagctcctgggcgggccctccgtcttcctgttcccgcccaagcccaaggacaccctcatcagccggacccccgaggtgacctgcgtggtcgtggacgtctcccacgaggaccccgaggtgaagttcaactggtacgtggacggcgtcgaggtgcacaacgccaagacgaagccgcgcgaggagcagtacaacagcacctaccgggtggtctccgtgctgaccgtgctgcaccaggactggctcaacgggaaggagtacaagtgcaaggtcagcaacaaggccctgcccgcccccatcgagaagaccatctccaaggccaagggccagccccgcgagccccaggtgtacacgctgccgcccagccgggaggagaccaagaaccaggtgtccctgacctgcctcgtcaaggggttctaccccagcgacatcgcggtggagtgggagagcaacggccagcccgagaacaactacaagaccacgccgcccgtgctggactccgacggcagcttcttcctctactccaagctgaccgtcgacaagagccgctggcagcaggggaacgtgttctcctgcagcgtgcacgaggccctgcacaaccactacacccagaagtccctcagcctgtcccccggc

SEQ ID NO: 7861 - RNA, 639 nt, synthetic construct
  misc_feature 1..639: note = derived and/or modified sequence opt1 from Drozituab_LightChain1
  source 1..639: mol_type = other RNA
agcgagctgacccaggaccccgccgtgtccgtcgccctcggccagaccgtgcgcatcacgtgcagcggggactccctgcggagctactacgcgtcctggtaccagcagaagccgggccaggcccccgtgctggtcatctacggggccaacaaccgccccagcggcatccccgaccggttctccgggagctccagcggcaacaccgcctccctcaccatcaccggcgcccaggcggaggacgaggccgactactactgcaacagcgccgactccagcgggaaccacgtggtgttcggcgggggcacgaagctgaccgtcctggggcagccgaaggccgcgccctccgtgaccctcttcccgcccagctccgaggagctgcaggccaacaaggccaccctggtgtgcctcatcagcgacttctaccccggcgccgtcacggtggcctggaaggcggactccagccccgtgaaggccggcgtcgagaccaccacccccagcaagcagtccaacaacaagtacgccgccagctcctacctgagcctgacgcccgagcagtggaagtcccacaagagctactcctgccaggtgacccacgaggggagcaccgtggagaagaccgtcgccccgacggagtgctcc

SEQ ID NO: 7862 - RNA, 1353 nt, synthetic construct
  misc_feature 1..1353: note = derived and/or modified sequence opt1 from Drozitumab_HeavyChain1
  source 1..1353: mol_type = other RNA
gaggtgcagctggtccagagcggcgggggcgtggagcgccccgggggctccctccggctgagctgcgccgcctccgggttcaccttcgacgactacgcgatgagctgggtgcgccaggccccgggcaagggcctggagtgggtctccgggatcaactggcagggcgggagcaccggctacgccgactccgtgaaggggcgggtgacgatcagccgcgacaacgccaagaactccctctacctgcagatgaacagcctgcgggccgaggacaccgcggtctactactgcgccaagatcctcggcgccggccgcgggtggtacttcgactactggggcaaggggaccaccgtgacggtgtccagcgcctccaccaagggccccagcgtcttccccctggcgccctccagcaagtccaccagcggcgggaccgccgccctgggctgcctcgtgaaggactacttcccggagcccgtgacggtctcctggaacagcggggccctgaccagcggcgtgcacaccttccccgccgtgctgcagtccagcgggctctactccctgagctccgtcgtgaccgtgcccagctccagcctgggcacgcagacctacatctgcaacgtcaaccacaagccgtccaacaccaaggtggacaagaaggtggagcccaagagctgcgacaagacccacacgtgcccgccctgcccggcgcccgagctcctgggcgggccctccgtcttcctgttcccgcccaagcccaaggacaccctcatgatcagccggacccccgaggtgacctgcgtggtcgtggacgtctcccacgaggaccccgaggtgaagttcaactggtacgtggacggcgtcgaggtgcacaacgccaagacgaagccgcgcgaggagcagtacaacagcacctaccgggtggtctccgtgctgaccgtgctgcaccaggactggctcaacgggaaggagtacaagtgcaaggtcagcaacaaggccctgcccgcccccatcgagaagaccatctccaaggccaagggccagccccgcgagccccaggtgtacacgctgccgcccagccgggaggagatgaccaagaaccaggtgtccctgacctgcctcgtcaaggggttctaccccagcgacatcgcggtggagtgggagagcaacggccagcccgagaacaactacaagaccacgccgcccgtgctggactccgacggcagcttcttcctctactccaagctgaccgtcgacaagagccgctggcagcaggggaacgtgttctcctgcagcgtgatgcacgaggccctgcacaaccactacacccagaagtccctcagcctgtcccccggcaag

SEQ ID NO: 7863 - RNA, 639 nt, synthetic construct; identical to SEQ ID NO: 7861
  misc_feature 1..639: note = derived and/or modified sequence opt1 from Drozitumab_LightChain1
  source 1..639: mol_type = other RNA

SEQ ID NO: 7864 - RNA, 1353 nt, synthetic construct
  misc_feature 1..1353: note = derived and/or modified sequence opt1 from Duligotumab_HeavyChain1
  source 1..1353: mol_type = other RNA
gaggtgcagctggtcgagagcggcgggggcctcgtgcagcccgggggctccctgcgcctgagctgcgccgcctccgggttcaccctcagcggcgactggatccactgggtgcggcaggcgccgggcaaggggctggagtgggtcggcgagatctccgccgccgggggctacaccgactacgccgacagcgtgaaggggcgcttcacgatctccgccgacaccagcaagaacaccgcgtacctgcagatgaactccctccgggccgaggacaccgccgtgtactactgcgcccgcgagagccgggtctccttcgaggcggccatggactactggggccagggcacgctggtgaccgtgagctccgccagcaccaaggggccctccgtcttccccctggcccccagctccaagagcacctccggcgggacggccgcgctcggctgcctggtgaaggactacttcccggagcccgtgaccgtcagctggaacagcggcgccctgacctccggggtgcacaccttccccgccgtgctccagagctccggcctgtacagcctgtccagcgtcgtgacggtgccctccagctccctcgggacccagacctacatctgcaacgtcaaccacaagccgagcaacaccaaggtggacaagaaggtggagcccaagtcctgcgacaagacgcacacgtgcccgccctgcccggcccccgagctgctgggcgggcccagcgtcttcctcttcccgcccaagcccaaggacaccctgatgatctcccgcacccccgaggtgacctgcgtggtcgtggacgtcagccacgaggaccccgaggtgaagttcaactggtacgtggacggcgtcgaggtgcacaacgccaagaccaagccgcgggaggagcagtacaactccacctaccgcgtggtcagcgtgctgaccgtgctccaccaggactggctgaacggcaaggagtacaagtgcaaggtctccaacaaggcgctgcccgcccccatcgagaagacgatcagcaaggccaaggggcagccccgggagccccaggtgtacaccctcccgccctcccgcgaggagatgaccaagaaccaggtgagcctgacctgcctggtcaagggcttctaccccagcgacatcgccgtggagtgggagtccaacgggcagcccgagaacaactacaagacgaccccgcccgtgctcgacagcgacggctccttcttcctgtacagcaagctgaccgtcgacaagtcccggtggcagcaggggaacgtgttcagctgctccgtgatgcacgaggccctccacaaccactacacccagaagtccctgagcctgagccccggcaag

SEQ ID NO: 7865 - RNA, 642 nt, synthetic construct
  misc_feature 1..642: note = derived and/or modified sequence opt1 from Duligotumab_LightChain1
  source 1..642: mol_type = other RNA
gacatccagatgacccagagcccctccagcctgtccgccagcgtgggcgaccgcgtcaccatcacgtgccgggcctcccagaacatcgcgaccgacgtggcctggtaccagcagaagccggggaaggcccccaagctcctgatctacagcgcctccttcctgtacagcggcgtgccctcccgcttcagcgggtccggcagcgggaccgacttcaccctcacgatctccagcctgcagcccgaggacttcgccacctactactgccagcagtccgagccggagccctacaccttcggccagggcaccaaggtcgagatcaagcggacggtggcggcccccagcgtgttcatcttcccgccctccgacgagcagctcaagagcgggaccgcctccgtcgtgtgcctgctgaacaacttctacccccgcgaggccaaggtgcagtggaaggtcgacaacgcgctgcagagcggcaacagccaggagtccgtgaccgagcaggacagcaaggactccacctacagcctctccagcacgctgaccctgtccaaggccgactacgagaagcacaaggtgtacgcctgcgaggtcacccaccaggggctcagctcccccgtgaccaagagcttcaaccggggcgagtgc

SEQ ID NO: 7866 - RNA, 1353 nt, synthetic construct; identical to SEQ ID NO: 7864
  misc_feature 1..1353: note = derived and/or modified sequence opt1 from Duligotuzumab_HeavyChain1
  source 1..1353: mol_type = other RNA

SEQ ID NO: 7867 - RNA, 642 nt, synthetic construct; identical to SEQ ID NO: 7865
  misc_feature 1..642: note = derived and/or modified sequence opt1 from Duligotuzumab_LightChain1
  source 1..642: mol_type = other RNA

SEQ ID NO: 7868 - RNA, 1353 nt, synthetic construct
  misc_feature 1..1353: note = derived and/or modified sequence opt1 from Dupilumab_HeavyChain1
  source 1..1353: mol_type = other RNA
gaggtgcagctggtcgagagcggcgggggcctcgagcagcccgggggctccctgcgcctgagctgcgccgggtccggcttcaccttccgggactacgccatgacctgggtgcgccaggcgcccggcaaggggctcgagtgggtgagctccatcagcggctccgggggcaacacgtactacgccgacagcgtcaaggggcggttcaccatctcccgcgacaacagcaagaacaccctgtacctgcagatgaactccctccgggccgaggacaccgccgtgtactactgcgccaaggaccgcctgagcatcacgatccggccccgctactacggcctggacgtgtggggccaggggaccaccgtcaccgtgtccagcgcgtccacgaagggccccagcgtgttccccctcgccccgtgctcccggagcacctccgagagcaccgccgccctggggtgcctggtcaaggactacttccccgagcccgtgaccgtgagctggaactccggcgcgctcacgagcggcgtccacaccttccccgccgtgctgcagtccagcgggctgtactccctcagctccgtggtcaccgtgccgagctccagcctgggcaccaagacgtacacgtgcaacgtggaccacaagccctccaacaccaaggtcgacaagcgcgtggagagcaagtacgggccgccctgcccgccctgccccgcccccgagttcctgggcgggccgtccgtgttcctcttcccgcccaagcccaaggacaccctgatgatcagccggacccccgaggtgacctgcgtcgtggtcgacgtgtcccaggaggaccccgaggtccagttcaactggtacgtggacggcgtggaggtccacaacgccaagaccaagccccgcgaggagcagttcaacagcacctaccgggtggtgtccgtcctgacggtgctccaccaggactggctgaacggcaaggagtacaagtgcaaggtgagcaacaaggggctgccctccagcatcgagaagaccatcagcaaggccaagggccagccgcgcgagccccaggtctacaccctcccgccctcccaggaggagatgaccaagaaccaggtgagcctgacgtgcctggtgaaggggttctacccctccgacatcgcggtcgagtgggagagcaacggccagcccgagaacaactacaagaccaccccgcccgtgctcgactccgacgggagcttcttcctgtactcccggctgaccgtggacaagagccgctggcaggagggcaacgtcttctcctgcagcgtgatgcacgaggccctccacaaccactacacgcagaagtccctgagcctgtccctcggc

SEQ ID NO: 7869 - RNA, 657 nt, synthetic construct
  misc_feature 1..657: note = derived and/or modified sequence opt1 from Dupilumab_LightChain1
  source 1..657: mol_type = other RNA
gacatcgtgatgacgcagagccccctgtccctcccggtcacccccggcgagcccgccagcatctcctgccgcagctcccagagcctgctgtactccatcgggtacaactacctcgactggtacctgcagaagtccggccagagcccccagctgctcatctacctggggagcaaccgggcctccggcgtgccggaccgcttcagcgggtccggcagcggcacggacttcaccctgaagatctcccgggtggaggcggaggacgtcgggttctactactgcatgcaggccctccagaccccctacaccttcggccaggggacgaagctggagatcaagcgcaccgtggccgcccccagcgtgttcatcttcccgccctccgacgagcagctcaagagcggcaccgcctccgtcgtgtgcctgctgaacaacttctacccccgggaggcgaaggtgcagtggaaggtcgacaacgccctgcagagcgggaacagccaggagtccgtgaccgagcaggacagcaaggactccacgtacagcctctccagcaccctgaccctgtccaaggccgactacgagaagcacaaggtgtacgcctgcgaggtcacccaccagggcctcagctcccccgtgaccaagagcttcaaccgcggcgagtgc

SEQ ID NO: 7870 - RNA, 1353 nt, synthetic construct
  misc_feature 1..1353: note = derived and/or modified sequence opt1 from Durvalumab_HeavyChain1
  source 1..1353: mol_type = other RNA
gaggtgcagctggtcgagagcggcgggggcctcgtgcagcccgggggctccctgcgcctgagctgcgccgcctccgggttcaccttcagccggtactggatgtcctgggtgcgccaggcgccgggcaagggcctcgagtgggtcgccaacatcaagcaggacgggagcgagaagtactacgtggactccgtgaagggccggttcaccatcagccgcgacaacgccaagaactccctgtacctgcagatgaacagcctccgggccgaggacacggccgtctactactgcgcgcgcgagggcgggtggttcggggagctggccttcgactactggggccagggcaccctggtgaccgtgtccagcgcctccaccaaggggcccagcgtcttccccctcgccccctccagcaagtccacgagcggcgggaccgcggccctgggctgcctggtgaaggactacttcccggagcccgtgaccgtctcctggaacagcggcgccctcaccagcggggtgcacacgttccccgccgtgctgcagtccagcggcctgtactccctcagctccgtcgtgaccgtgcccagctccagcctggggacccagacctacatctgcaacgtcaaccacaagccgtccaacacgaaggtggacaagcgggtggagcccaagagctgcgacaagacccacacgtgcccgccctgccccgcccccgagttcgagggcgggccctccgtcttcctgttcccgcccaagcccaaggacaccctcatgatcagccgcacccccgaggtgacctgcgtggtcgtggacgtctcccacgaggaccccgaggtgaagttcaactggtacgtggacggcgtcgaggtgcacaacgcgaagaccaagccgcgggaggagcagtacaacagcacctaccgcgtggtctccgtgctgacggtgctgcaccaggactggctcaacggcaaggagtacaagtgcaaggtcagcaacaaggccctgcccgcctccatcgagaagaccatcagcaaggccaaggggcagccccgggagccccaggtgtacaccctgccgccctcccgcgaggagatgaccaagaaccaggtgagcctcacgtgcctggtcaagggcttctaccccagcgacatcgccgtggagtgggagtccaacgggcagcccgagaacaactacaagaccaccccgcccgtgctggacagcgacggctccttcttcctctacagcaagctgaccgtcgacaagtcccggtggcagcaggggaacgtgttcagctgctccgtgatgcacgaggcgctgcacaaccactacacgcagaagtccctcagcctgagccccggcaag

SEQ ID NO: 7871 - RNA, 645 nt, synthetic construct
  misc_feature 1..645: note = derived and/or modified sequence opt1 from Durvalumab_LightChain1
  source 1..645: mol_type = other RNA
gagatcgtgctgacccagagccccggcaccctctccctgagcccgggggagcgcgccacgctgtcctgccgggccagccagcgcgtctccagctcctacctcgcgtggtaccagcagaagcccggccaggcgccccggctgctgatctacgacgccagctcccgcgccaccgggatccccgaccggttcagcggctccgggagcggcaccgacttcaccctcacgatctcccgcctggagccggaggacttcgccgtgtactactgccagcagtacggcagcctgccctggaccttcgggcagggcaccaaggtggagatcaagcggaccgtcgccgccccctccgtgttcatcttcccgcccagcgacgagcagctcaagtccgggacggccagcgtggtctgcctgctgaacaacttctacccccgcgaggccaaggtgcagtggaaggtggacaacgcgctccagtccggcaacagccaggagagcgtcaccgagcaggactccaaggacagcacctactccctgagctccaccctgacgctcagcaaggccgactacgagaagcacaaggtgtacgcctgcgaggtgacccaccaggggctgtccagccccgtcaccaagtccttcaaccggggcgagtgc

SEQ ID NO: 7872 - RNA, 1338 nt, synthetic construct
  misc_feature 1..1338: note = derived and/or modified sequence opt1 from Dusigitumab_HeavyChain1
  source 1..1338: mol_type = other RNA
caggtgcagctggtccagagcggcgccgaggtgaagaagcccggggcctccgtgaaggtcagctgcaaggcgtccggctacaccttcaccagctacgacatcaactgggtgcgccaggccacggggcagggcctcgagtggatggggtggatgaacccgaactccggcaacaccggctacgcccagaagttccaggggcgggtgaccatgacccgcaacacgagcatctccaccgcctacatggagctgagctccctgcggagcgaggacaccgccgtctactactgcgcgcgcgacccctactactactactacggcatggacgtgtgggggcagggcaccacggtgaccgtctccagcgcctccaccaaggggcccagcgtgttccccctcgccccgtgctcccggagcacctccgagagcacggccgcgctgggctgcctggtgaaggactacttccccgagcccgtcaccgtgtcctggaacagcggcgccctcaccagcggggtgcacaccttccccgccgtcctgcagtccagcggcctgtactccctcagctccgtggtgacggtcccgagctccaacttcgggacccagacctacacgtgcaacgtggaccacaagcccagcaacaccaaggtggacaagaccgtcgagcgcaagtgctgcgtggagtgcccgccctgccccgccccgcccgtggccggcccctccgtcttcctgttcccgcccaagcccaaggacaccctgatgatcagccggacccccgaggtgacgtgcgtcgtggtggacgtctcccacgaggaccccgaggtgcagttcaactggtacgtggacggcgtcgaggtgcacaacgcgaagaccaagccccgcgaggagcagttcaacagcaccttccgggtggtctccgtgctcaccgtggtccaccaggactggctgaacgggaaggagtacaagtgcaaggtgagcaacaagggcctgcccgcccccatcgagaagacgatctccaagaccaaggggcagccgcgcgagccccaggtgtacaccctcccgcccagccgggaggagatgaccaagaaccaggtctccctgacgtgcctggtgaagggcttctaccccagcgacatcgccgtggagtgggagtccaacgggcagcccgagaacaactacaagaccacgcccccgatgctcgacagcgacggcagcttcttcctgtactccaagctgaccgtcgacaagagccgctggcagcagggcaacgtgttctcctgcagcgtgatgcacgaggccctccacaaccactacacccagaagtccctgagcctgtcccccgggaag

SEQ ID NO: 7873 - RNA, 651 nt, synthetic construct
  misc_feature 1..651: note = derived and/or modified sequence opt1 from Dusigitumab_LightChain1
  source 1..651: mol_type = other RNA
cagagcgtgctgacccagcccccgtccgtcagcgccgcccccggccagaaggtgaccatctcctgcagcgggtccagctccaacatcgagaacaaccacgtgagctggtaccagcagctccccggcacggcgcccaagctgctgatctacgacaacaacaagcgcccgtccgggatccccgaccggttcagcggctccaagagcgggacctccgccaccctcggcatcaccggcctgcagacgggggacgaggccgactactactgcgagacctgggacaccagcctgtccgccggccgcgtcttcgggggcgggaccaagctcacggtgctgggccagcccaaggccgcgcccagcgtgaccctgttcccgccctccagcgaggagctccaggccaacaaggccaccctggtctgcctgatctccgacttctaccccggcgccgtgaccgtggcgtggaaggccgacagcagccccgtcaaggccggggtggagacgaccaccccgtccaagcagagcaacaacaagtacgccgcctccagctacctctccctgacccccgagcagtggaagtcccaccggagctacagctgccaggtgacgcacgagggctccaccgtcgagaagaccgtggcgcccaccgagtgcagc

SEQ ID NO: 7874 - RNA, 1347 nt, synthetic construct
  misc_feature 1..1347: note = derived and/or modified sequence opt1 from Ecromeximab_HeavyChain1
  source 1..1347: mol_type = other RNA
gaggtgaccctggtcgagagcggcggggacttcgtgaagcccggcgggtccctcaaggtgagctgcgccgcctccggcttcgcgttcagccactacgccatgtcctgggtccgccagaccccggccaagcggctggagtgggtggcctacatcagctccgggggcagcggcacgtactactccgacagcgtgaaggggcgcttcaccatctcccgggacaacgccaagaacaccctgtacctccagatgcgcagcctgcggtccgaggacagcgcgatgtacttctgcacccgcgtcaagctgggcacgtactacttcgactcctgggggcagggcaccaccctcaccgtgagctccgccagcacgaaggggccctccgtgttccccctggcccccagcagcaagtccaccagcggcggcaccgccgcgctggggtgcctcgtcaaggactacttcccggagcccgtgaccgtgtcctggaacagcggcgccctgacgtccggggtccacaccttccccgccgtgctgcagagctccggcctctacagcctgtccagcgtggtcaccgtgccctccagctccctgggcacccagacgtacatctgcaacgtgaaccacaagccgagcaacaccaaggtcgacaagaaggtggagcccaagtcctgcgacaagacccacacgtgcccgccctgccccgcccccgagctcctcgggggccccagcgtgttcctgttcccgcccaagcccaaggacaccctgatgatctcccggacccccgaggtgacctgcgtcgtggtcgacgtgagccacgaggaccccgaggtcaagttcaactggtacgtggacggggtggaggtccacaacgccaagaccaagccgcgcgaggagcagtacaactccacgtaccgggtggtgagcgtcctgaccgtgctgcaccaggactggctcaacggcaaggagtacaagtgcaaggtgagcaacaaggcgctgcccgcccccatcgagaagaccatctccaaggccaaggggcagccccgcgagccgcaggtctacaccctgccgcccagccgggacgagctcacgaagaaccaggtgtccctgacctgcctggtgaagggcttctaccccagcgacatcgccgtcgagtgggagtccaacggccagcccgagaacaactacaagaccaccccgcccgtgctcgacagcgacgggtccttcttcctgtacagcaagctgacggtggacaagtcccgctggcagcagggcaacgtcttcagctgctccgtgatgcacgaggccctccacaaccactacacccagaagtccctgagcctgagccccgggaag

SEQ ID NO: 7875 - RNA, 642 nt, synthetic construct
  misc_feature 1..642: note = derived and/or modified sequence opt1 from Ecromeximab_LightChain1
  source 1..642: mol_type = other RNA
gacatccagatgacccagaccgccagctccctgcccgccagcctcggcgaccgcgtgacgatctcctgcagcgcgtcccaggacatcagcaactacctgaactggtaccagcagaagccggacgggaccgtcaagctgctcatcttctactccagcaacctgcactccggcgtgcccagccggttctccgggggcgggagcggcaccgactactccctgaccatcagcaacctcgagcccgaggacatcgccacgtacttctgccaccagtactccaagctgccctggaccttcggcgggggcaccaagctggagatcaagcgcaccgtggccgccccgagcgtcttcatcttcccgccctccgacgagcagctcaagagcgggacggcctccgtggtgtgcctgctgaacaacttctacccccgggaggcgaaggtccagtggaaggtggacaacgccctccagagcggcaacagccaggagtccgtgaccgagcaggacagcaaggactccacctacagcctgtccagcaccctgacgctctccaaggccgactacgagaagcacaaggtctacgcctgcgaggtgacccaccaggggctgagctcccccgtgaccaagagcttcaaccgcggcgagtgc

SEQ ID NO: 7876 - RNA, 1341 nt, synthetic construct
  misc_feature 1..1341: note = derived and/or modified sequence opt1 from Eculizumab_HeavyChain1
  source 1..1341: mol_type = other RNA
gtgcagctggtccagagcggcgccgaggtgaagaagcccggggcctccgtgaaggtcagctgcaaggcgtccggctacatcttcagcaactactggatccagtgggtgcgccaggccccggggcagggcctcgagtggatgggggagatcctgcccggctccggcagcaccgagtacaccgagaacttcaaggaccgggtgacgatgacccgcgacacctccaccagcacggtctacatggagctgtccagcctccggtccgaggacaccgccgtgtactactgcgcccgctacttcttcgggagctcccccaactggtacttcgacgtgtggggccaggggaccctggtcaccgtgagctccgccagcacgaagggcccctccgtgttcccgctggcgccctgcagccggtccaccagcgagagcaccgccgccctcgggtgcctggtcaaggactacttccccgagcccgtgaccgtgtcctggaacagcggcgccctgacgtccggcgtccacaccttcccggcggtgctccagagctccgggctgtacagcctgtccagcgtggtcaccgtgccctccagcaacttcggcacccagacgtacacgtgcaacgtggaccacaagccctccaacaccaaggtcgacaagaccgtggagcgcaagtgctgcgtggagtgcccgccctgccccgccccgcccgtcgccgggcccagcgtgttcctcttcccgcccaagcccaaggacaccctgatgatctcccggacccccgaggtgacctgcgtcgtggtcgacgtgagccaggaggaccccgaggtgcagttcaactggtacgtcgacggcgtggaggtgcacaacgccaagaccaagccccgcgaggagcagttcaactccacgtaccgggtcgtgagcgtgctgaccgtcctccaccaggactggctgaacggcaaggagtacaagtgcaaggtgtccaacaaggggctgcccagctccatcgagaagaccatcagcaaggccaagggccagccgcgcgagccccaggtgtacaccctcccgcccagccaggaggagatgacgaagaaccaggtctccctgacctgcctggtgaaggggttctaccccagcgacatcgcggtggagtgggagtccaacggccagcccgagaacaactacaagaccacgcccccggtcctcgacagcgacgggtccttcttcctgtacagccggctgaccgtggacaagtcccgctggcaggagggcaacgtgttcagctgctccgtcatgcacgaggccctccacaaccactacacccagaagtccctgagcctgagcctcggcaag

SEQ ID NO: 7877 - RNA, 642 nt, synthetic construct
  misc_feature 1..642: note = derived and/or modified sequence opt1 from Eculizumab_LightChain1
  source 1..642: mol_type = other RNA
gacatccagatgacgcagagcccctccagcctgtccgccagcgtgggcgaccgcgtcaccatcacgtgcggggcctccgagaacatctacggcgcgctcaactggtaccagcagaagccggggaaggcccccaagctgctgatctacggcgccaccaacctcgccgacggggtgcccagccggttctccggcagcggctccgggaccgacttcaccctgacgatcagctccctgcagcccgaggacttcgccacctactactgccagaacgtgctcaacaccccgctgaccttcggccaggggacgaaggtcgagatcaagcgcaccgtggcggcccccagcgtgttcatcttcccgccctccgacgagcagctcaagagcggcaccgcctccgtcgtgtgcctgctgaacaacttctacccccgggaggccaaggtgcagtggaaggtcgacaacgcgctgcagagcgggaactcccaggagagcgtgaccgagcaggactccaaggacagcacgtacagcctctccagcaccctgaccctgtccaaggccgactacgagaagcacaaggtgtacgcctgcgaggtcacccaccagggcctcagctcccccgtgaccaagagcttcaaccgcggcgagtgc

SEQ ID NO: 7878 - RNA, 375 nt, synthetic construct
  misc_feature 1..375: note = derived and/or modified sequence opt1 from Efalizumab_HeavyChain
  source 1..375: mol_type = other RNA
gaggtgcagctggtcgagagcggcgggggcctcgtgcagcccgggggctccctgcgcctgagctgcgccgcctccgggtacagcttcaccggccactggatgaactgggtgcggcaggcgccgggcaaggggctcgagtgggtcggcatcatgatccacccctccgacagcgagacccgctacaaccagaagttcaaggacatccggttcacgatctccgtggacaagagcaagaacaccctgtacctgcagatgaactccctccgcgccgaggacaccgccgtgtactactgcgcccggatcgggatctacttctacggcaccacgtacttcgactacatctgggggcagggcaccctggtcaccgtgagctcc

SEQ ID NO: 7879 - RNA, 324 nt, synthetic construct
  misc_feature 1..324: note = derived and/or modified sequence opt1 from Efalizumab_LightChain
  source 1..324: mol_type = other RNA
gacatccagatgacccagagcccctccagcctgtccgccagcgtgggcgaccgcgtcaccatcacgtgccgggcctccaagaccatcagcaagtacctcgcgtggtaccagcagaagccggggaaggcccccaagctgctgatctactccggcagcaccctccagtccggggtgcccagccgcttctccggcagcgggtccggcaccgacttcacgctgaccatcagctccctgcagcccgaggacttcgccacctactactgccagcagcacaacgagtacccgctcaccttcggccaggggacgaaggtggagatcaagcgg

SEQ ID NO: 7880 - RNA, 768 nt, synthetic construct
  misc_feature 1..768: note = derived and/or modified sequence opt1 from Efungumab_SingleChain_variable_fragment
  source 1..768: mol_type = other RNA
atggccgaggtgcagctggtcgagagcggcgccgaggtgaagaagcccggggagtccctccgcatcagctgcaagggctccgggtgcatcatcagctcctactggatcagctgggtgcggcagatgccgggcaaggggctggagtggatgggcaagatcgaccccggcgactcctacatcaactacagcccctccttccaggggcacgtcaccatcagcgcggacaagtccatcaacaccgcctacctgcagtggaacagcctcaaggcctccgacacggccatgtactactgcgcccgcggcgggcgggacttcggcgacagcttcgactactgggggcagggcaccctggtgaccgtgtccagcggcgggggcgggtccggcggcgggggcagcgggggcgggggctccgacgtcgtgatgacccagagccccagcttcctgtccgcgttcgtgggcgaccgcatcacgatcacgtgccgggccagctccgggatcagccgctacctcgcctggtaccagcaggccccgggcaaggcgcccaagctgctgatctacgccgcctccaccctccagaccggggtccccagccggttctccggcagcgggtccggcaccgagttcaccctgaccatcaacagcctgcagcccgaggacttcgccacctactactgccagcacctcaactcctacccgctgacgttcggcgggggcaccaaggtggacatcaagcgcgccgcggccctggagcaccaccaccaccaccac

SEQ ID NO: 7881 - RNA, 1362 nt, synthetic construct
  misc_feature 1..1362: note = derived and/or modified sequence opt1 from Eldelumab_HeavyChain1
  source 1..1362: mol_type = other RNA
cagatgcagctggtggagagcggcgggggcgtcgtgcagcccgggcgctccctccggctgagctgcaccgcctccggcttcaccttcagcaacaacgggatgcactgggtgcgccaggccccgggcaagggcctggagtgggtcgcggtgatctggttcgacgggatgaacaagttctacgtggactccgtcaagggccggttcacgatcagccgcgacaactccaagaacaccctctacctggagatgaacagcctgcgggccgaggacaccgccatctactactgcgcccgcgagggggacggctccgggatctactactactacggcatggacgtgtggggccaggggaccacggtgaccgtcagctccgccagcaccaagggcccctccgtgttccccctcgcgcccagctccaagagcacctccgggggcacggccgccctgggctgcctggtgaaggactacttcccggagcccgtcaccgtgagctggaactccggggccctcaccagcggcgtgcacaccttccccgcggtcctgcagagctccgggctgtacagcctctccagcgtggtgacggtcccctccagctccctgggcacccagacctacatctgcaacgtgaaccacaagccgagcaacaccaaggtggacaagcgggtcgagcccaagtcctgcgacaagacgcacacgtgcccgccctgcccggcccccgagctgctcgggggccccagcgtgttcctgttcccgcccaagcccaaggacaccctgatgatctcccgcacccccgaggtgacctgcgtcgtggtcgacgtgagccacgaggaccccgaggtgaagttcaactggtacgtcgacggcgtggaggtgcacaacgccaagaccaagccgcgggaggagcagtacaactccacctaccgcgtcgtgagcgtgctcaccgtcctgcaccaggactggctgaacgggaaggagtacaagtgcaaggtgtccaacaaggccctccccgcccccatcgagaagacgatcagcaaggcgaagggccagccccgggagccccaggtgtacaccctgccgccctcccgcgaggagatgaccaagaaccaggtcagcctgacctgcctcgtgaaggggttctacccctccgacatcgccgtggagtgggagagcaacggccagcccgagaacaactacaagacgaccccgcccgtcctggacagcgacgggtccttcttcctgtacagcaagctcaccgtggacaagtcccggtggcagcagggcaacgtgttcagctgctccgtcatgcacgaggccctgcacaaccactacacccagaagtccctgagcctcagccccggcaag

SEQ ID NO: 7882 - RNA, 648 nt, synthetic construct
  misc_feature 1..648: note = derived and/or modified sequence opt1 from Eldelumab_LightChain1
  source 1..648: mol_type = other RNA
gagatcgtgctgacccagagccccggcaccctctccctgagcccgggggagcgcgccacgctgtcctgccgggccagccagtccgtcagctccagctacctcgcgtggtaccagcagaagcccggccaggcgccccgcctgctgatctacggggcctccagccgggccaccggcatccccgaccgcttctccgggagcggctccggcaccgacttcaccctcacgatcagccggctggagccggaggacttcgccgtgtactactgccagcagtacgggtccagccccatcttcaccttcggccccgggaccaaggtggacatcaagcgcaccgtcgccgccccctccgtgttcatcttcccgcccagcgacgagcagctgaagtccggcacggccagcgtggtctgcctcctgaacaacttctacccccgggaggccaaggtgcagtggaaggtggacaacgcgctgcagagcgggaactcccaggagagcgtcaccgagcaggactccaaggacagcacctactccctcagctccaccctgacgctgagcaaggccgactacgagaagcacaaggtgtacgcctgcgaggtgacccaccagggcctctccagccccgtcaccaagtccttcaaccgcggcgagtgc

SEQ ID NO: 7883 - RNA, 1341 nt, synthetic construct
  misc_feature 1..1341: note = derived and/or modified sequence opt1 from Elgemtumab_HeavyChain1
  source 1..1341: mol_type = other RNA
gaggtgcagctgctcgagagcggcgggggcctggtccagcccgggggctccctgcgcctcagctgcgccgcctccgggttcaccttcagctcctacgcgatgagctgggtgcggcaggccccgggcaagggcctggagtgggtgtccgccatcaacagccaggggaagtccacctactacgccgacagcgtcaagggccgcttcacgatctcccgggacaacagcaagaacaccctgtacctccagatgaactccctgcgcgccgaggacaccgcggtgtactactgcgcccggtggggcgacgaggggttcgacatctgggggcagggcaccctggtgacggtcagctccgccagcaccaagggcccctccgtgttccccctcgcccccagctccaagagcaccagcgggggcaccgcggccctggggtgcctggtgaaggactacttcccggagcccgtcacggtgtcctggaacagcggcgccctcacctccggcgtgcacaccttccccgccgtcctgcagagctccgggctgtacagcctctccagcgtggtgaccgtcccctccagctccctgggcacgcagacctacatctgcaacgtgaaccacaagccgagcaacaccaaggtggacaagcgcgtcgagcccaagtcctgcgacaagacccacacgtgcccgccctgcccggcccccgagctgctcgggggccccagcgtgttcctgttcccgcccaagcccaaggacaccctgatgatctcccggacccccgaggtgacctgcgtcgtggtggacgtcagccacgaggaccccgaggtgaagttcaactggtacgtcgacggggtggaggtgcacaacgcgaagacgaagccgcgcgaggagcagtacaactccacctaccgggtcgtgagcgtgctcaccgtcctgcaccaggactggctgaacggcaaggagtacaagtgcaaggtgtccaacaaggccctccccgcccccatcgagaagaccatcagcaaggccaagggccagccccgcgagccccaggtgtacacgctgccgcccagccgggaggagatgaccaagaaccaggtctccctgacctgcctcgtgaaggggttctaccccagcgacatcgccgtggagtgggagtccaacggccagcccgagaacaactacaagaccacgccgcccgtcctggacagcgacgggtccttcttcctgtacagcaagctcaccgtggacaagtcccgctggcagcagggcaacgtgttcagctgctccgtcatgcacgaggcgctgcacaaccactacacccagaagtccctgagcctcagccccgggaag

SEQ ID NO: 7884 - RNA, 642 nt, synthetic construct
  misc_feature 1..642: note = derived and/or modified sequence opt1 from Elgemtumab_LightChain1
  source 1..642: mol_type = other RNA
gacatccagatgacccagagcccctccagcctgtccgccagcgtgggcgaccgcgtcaccatcacgtgccgggcctcccaggggatcagcaactggctcgcgtggtaccagcagaagccgggcaaggcccccaagctgctgatctacggggcctccagcctccagtccggcgtgcccagccgcttctccgggagcggctccggcaccgacttcaccctgaccatcagctccctgcagcccgaggacttcgccacgtactactgccagcagtacagctccttcccgaccaccttcgggcagggcaccaaggtggagatcaagcggacggtcgccgcgcccagcgtgttcatcttcccgccctccgacgagcagctcaagagcgggaccgccagcgtggtctgcctgctgaacaacttctacccccgcgaggccaaggtgcagtggaaggtggacaacgccctccagtccggcaacagccaggagtccgtcaccgagcaggacagcaaggactccacctacagcctgtccagcacgctgaccctctccaaggcggactacgagaagcacaaggtgtacgcctgcgaggtgacccaccaggggctgagctcccccgtcaccaagagcttcaaccggggcgagtgc

SEQ ID NO: 7885 - RNA, 1347 nt, synthetic construct
  misc_feature 1..1347: note = derived and/or modified sequence opt1 from Elotuzumab_HeavyChain1
  source 1..1347: mol_type = other RNA
gaggtgcagctggtcgagagcggcgggggcctcgtgcagcccgggggctccctgcgcctgagctgcgccgcctccgggttcgacttcagccggtactggatgtcctgggtgcgccaggcgcccggcaagggcctcgagtggatcggggagatcaaccccgacagctccaccatcaactacgcccccagcctgaaggacaagttcatcatctcccgggacaacgccaagaacagcctgtacctccagatgaactccctgcgcgccgaggacaccgccgtctactactgcgcgcggcccgacggcaactactggtacttcgacgtgtgggggcagggcacgctggtgaccgtcagctccgccagcaccaaggggccgtccgtgttccccctcgcccccagctccaagagcacctccggcggcacggccgcgctggggtgcctggtgaaggactacttccccgagccggtcaccgtgagctggaacagcggcgccctcacctccggggtgcacaccttccccgccgtcctgcagagctccggcctgtacagcctctccagcgtggtgacggtcccctccagctccctgggcacccagacctacatctgcaacgtgaaccacaagcccagcaacaccaaggtggacaagaaggtcgagccgaagtcctgcgacaagacgcacacgtgcccgccctgccccgcccccgagctgctcgggggccccagcgtgttcctgttcccgcccaagcccaaggacaccctgatgatctcccgcacccccgaggtgacctgcgtcgtggtggacgtcagccacgaggaccccgaggtgaagttcaactggtacgtcgacggggtggaggtgcacaacgccaagaccaagccccgggaggagcagtacaactccacctaccgcgtcgtgagcgtgctcaccgtcctgcaccaggactggctgaacggcaaggagtacaagtgcaaggtgtccaacaaggcgctcccggcccccatcgagaagacgatcagcaaggccaaggggcagccccgggagccccaggtgtacaccctgccgccctcccgcgacgagctgaccaagaaccaggtcagcctgacctgcctcgtgaagggcttctaccccagcgacatcgccgtggagtgggagtccaacggccagccggagaacaactacaagacgaccccgcccgtcctggacagcgacgggtccttcttcctctacagcaagctgaccgtggacaagtcccggtggcagcagggcaacgtgttcagctgctccgtcatgcacgaggccctgcacaaccactacacccagaagtccctcagcctgagccccgggaag

SEQ ID NO: 7886 - RNA, 642 nt, synthetic construct
  misc_feature 1..642: note = derived and/or modified sequence opt1 from Elotuzumab_LightChain1
  source 1..642: mol_type = other RNA
gacatccagatgacgcagagcccctccagcctgtccgccagcgtgggcgaccgggtcaccatcacgtgcaaggcctcccaggacgtggggatcgcggtggcctggtaccagcagaagccgggcaaggtccccaagctcctgatctactgggccagcacccggcacaccggggtgcccgaccgcttctccggcagcgggtccggcaccgacttcacgctgaccatcagctccctccagcccgaggacgtggccacctactactgccagcagtacagctcctacccgtacaccttcggccaggggacgaaggtcgagatcaagcggaccgtggccgcgcccagcgtgttcatcttcccgccctccgacgagcagctcaagagcggcaccgcctccgtcgtgtgcctgctgaacaacttctacccccgcgaggccaaggtgcagtggaaggtcgacaacgccctgcagagcgggaactcccaggagagcgtgaccgagcaggacagcaaggactccacgtacagcctgtccagcaccctcaccctgtccaaggcggactacgagaagcacaaggtgtacgcctgcgaggtcacccaccagggcctgagctcccccgtgaccaagagcttcaaccgcggggagtgc

SEQ ID NO: 7887 - RNA, 1338 nt, synthetic construct
  misc_feature 1..1338: note = derived and/or modified sequence opt1 from Emactuzumab_HeavyChain1
  source 1..1338: mol_type = other RNA
caggtgcagctggtccagagcggcgccgaggtgaagaagcccggggcctccgtgaaggtcagctgcaaggcgtccggctacaccttcaccagctacgacatctcctgggtgcgccaggccccggggcagggcctcgagtggatgggggtgatctggacggacggcggcaccaactacgcccagaagctgcaggggcgggtcaccatgaccacggacaccagcacctccaccgcctacatggagctgcgcagcctccggtccgacgacacggccgtgtactactgcgcgcgcgaccagcggctgtacttcgacgtgtggggccaggggaccaccgtcaccgtgagctccgccagcacgaagggcccctccgtgttccccctggcccccagctccaagagcacctccgggggcaccgccgcgctcggctgcctggtcaaggactacttcccggagcccgtgaccgtgagctggaactccggggccctgacgagcggcgtccacaccttccccgccgtgctccagagctccgggctgtacagcctgtccagcgtggtcaccgtgccctccagctccctcggcacccagacgtacatctgcaacgtgaaccacaagccgagcaacaccaaggtcgacaagaaggtggagcccaagtcctgcgacaagacccacacgtgcccgccctgccccgcccccgagctgctgggcgggcccagcgtgttcctcttcccgcccaagcccaaggacaccctgatgatctcccgcacccccgaggtgacctgcgtcgtcgtggacgtgagccacgaggaccccgaggtcaagttcaactggtacgtggacggcgtggaggtccacaacgccaagaccaagccgcgggaggagcagtacaactccacgtaccgcgtggtgagcgtcctgaccgtgctccaccaggactggctgaacgggaaggagtacaagtgcaaggtgtccaacaaggcgctgcccgcccccatcgagaagaccatcagcaaggccaagggccagccccgggagccgcaggtctacaccctcccgccctcccgcgacgagctgacgaagaaccaggtgagcctgacctgcctcgtgaaggggttctacccctccgacatcgccgtcgagtgggagagcaacggccagcccgagaacaactacaagaccaccccgcccgtgctggacagcgacggctccttcttcctgtacagcaagctcacggtggacaagtcccggtggcagcaggggaacgtcttcagctgctccgtgatgcacgaggccctgcacaaccactacacccagaagtccctgagcctcagccccggcaag

SEQ ID NO: 7888 - RNA, 639 nt, synthetic construct
  misc_feature 1..639: note = derived and/or modified sequence opt1 from Emactuzumab_LightChain1
  source 1..639: mol_type = other RNA
gacatccagatgacgcagagcccctccagcctgtccgccagcgtgggcgaccgcgtcaccatcacgtgccgggcctccgaggacgtgaacacctacgtgagctggtaccagcagaagccggggaaggcgcccaagctcctgatctacgccgcctccaaccgctacaccggcgtccccagccggttctccgggagcggctccgggaccgacttcacgctgaccatcagctccctccagcccgaggacttcgccacctactactgccagcagagcttctcctacccgaccttcggccagggcacgaagctggagatcaagcgcaccgtggccgcgcccagcgtgttcatcttcccgccctccgacgagcagctcaagagcgggaccgcctccgtcgtgtgcctgctgaacaacttctacccccgggaggccaaggtgcagtggaaggtcgacaacgccctgcagagcggcaacagccaggagtccgtgaccgagcaggacagcaaggactccacgtacagcctctccagcaccctgaccctgtccaaggcggactacgagaagcacaaggtgtacgcctgcgaggtcacccaccaggggctcagctcccccgtgaccaagagcttcaaccgcggcgagtgc

SEQ ID NO: 7889 - RNA, 1323 nt, synthetic construct
  misc_feature 1..1323: note = derived and/or modified sequence opt1 from Emibetuzumab_HeavyChain1
  source 1..1323: mol_type = other RNA
caggtgcagctggtccagagcggcgccgaggtgaagaagcccggggcctccgtgaaggtcagctgcaaggcgtccggctacaccttcaccgactactacatgcactgggtgcgccaggcccccgggcagggcctcgagtggatggggcgggtgaaccccaaccgccggggcacgacctacaaccagaagttcgagggccgcgtcaccatgaccacggacaccagcacctccaccgcctacatggagctgcggagcctgcgctccgacgacacggccgtgtactactgcgcccgggcgaactggctcgactactgggggcagggcaccaccgtgaccgtcagctccgccagcacgaaggggccctccgtgttccccctggccccgtgcagccgctccaccagcgagtccaccgccgcgctgggctgcctcgtgaaggactacttccccgagcccgtcaccgtgagctggaactccggggccctgacgagcggcgtgcacaccttccccgccgtcctgcagtccagcggcctctacagcctgtccagcgtggtgaccgtcccgtccagctccctggggaccaagacgtacacgtgcaacgtggaccacaagcccagcaacaccaaggtggacaagcgggtcgagtccaagtacggcccgccctgcccgccctgccccgcccccgaggccgccgggggcccgagcgtgttcctcttcccgcccaagcccaaggacaccctgatgatctcccgcacccccgaggtgacctgcgtcgtggtcgacgtgagccaggaggaccccgaggtgcagttcaactggtacgtcgacggcgtggaggtgcacaacgcgaagaccaagccccgggaggagcagttcaactccacctaccgcgtcgtgagcgtgctgacggtcctccaccaggactggctgaacgggaaggagtacaagtgcaaggtgtccaacaagggcctgcccagctccatcgagaagaccatcagcaaggccaaggggcagccgcgggagccccaggtgtacaccctcccgccctcccaggaggagatgaccaagaaccaggtcagcctgacgtgcctggtgaagggcttctacccctccgacatcgccgtggagtgggagagcaacgggcagcccgagaacaactacaagaccaccccgcccgtcctcgacagcgacggctccttcttcctgtacagccgcctgaccgtggacaagtcccggtggcaggagggcaacgtgttcagctgctccgtcatgcacgaggccctccacaaccactacacgcagaagtccctgagcctgagcctcggg

SEQ ID NO: 7890 - RNA, 645 nt, synthetic construct
  misc_feature 1..645: note = derived and/or modified sequence opt1 from Emibetuzumab_LightChain1
  source 1..645: mol_type = other RNA
gacatccagatgacccagagcccctccagcctgtccgccagcgtgggcgaccgcgtcaccatcacgtgctccgtgagctccagcgtgtccagcatctacctccactggtaccagcagaagccggggaaggcccccaagctgctgatctactccaccagcaacctcgcgtccggcgtccccagccggttctccgggagcggctccgggaccgacttcaccctgacgatcagctccctgcagcccgaggacttcgccacctactactgccaggtgtacagcggctacccgctcaccttcggcgggggcaccaaggtggagatcaagcgcacggtcgccgcccccagcgtgttcatcttcccgccctccgacgagcagctcaagagcgggaccgcctccgtggtctgcctgctgaacaacttctacccccgggaggcgaaggtgcagtggaaggtggacaacgccctgcagagcggcaactcccaggagagcgtcaccgagcaggactccaaggacagcacctactccctgagctccacgctcaccctgagcaaggccgactacgagaagcacaaggtgtacgcctgcgaggtgacccaccaggggctgtccagccccgtcaccaagtccttcaaccgcggcgagtgc

SEQ ID NO: 7891 - RNA, 1344 nt, synthetic construct
  misc_feature 1..1344: note = derived and/or modified sequence opt1 from Emicizumab_HeavyChain1
  source 1..1344: mol_type = other RNA
caggtgcagctggtcgagagcggcgggggcctcgtgcagcccgggggctccctgcgcctgagctgcgccgcctccgggttcaccttcagctactacgacatccagtgggtgcggcaggcgccgggcaagggcctcgagtgggtctccagcatctcccccagcgggcagtccacctactaccgccgggaggtgaagggccgcttcacgatcagccgggacaactccaagaacaccctgtacctgcagatgaacagcctccgcgccgaggacaccgccgtgtactactgcgcccggcgcaccgggcgggagtacggcgggggctggtacttcgactactggggccaggggacgctggtcaccgtgtccagcgcctccaccaagggccccagcgtgttccccctggcgccgtgctcccgcagcacctccgagagcacggccgccctcgggtgcctggtcaaggactacttccccgagcccgtgaccgtgagctggaactccggcgccctgaccagcggcgtccacaccttccccgcggtgctccagtccagcgggctgtactccctgagctccgtggtcacggtgccgagctccagcctcggcacccagacctacacgtgcaacgtggaccacaagccctccaacaccaaggtcgacaagcgggtggagagcaagtacgggccgccctgcccgccctgccccgcccccgagttcctgggcgggccctccgtgttcctgttcccgcccaagcccaaggacaccctcatgatcagccgcacccccgaggtgacctgcgtcgtggtcgacgtgtcccaggaggaccccgaggtccagttcaactggtacgtggacggcgtggaggtccacaacgccaagacgaagccccgggaggagcagtacaacagcacctaccgcgtggtgtccgtcctgaccgtgctgcaccaggactggctcaacggcaaggagtacaagtgcaaggtgagcaacaaggggctgccctccagcatcgagaagaccatcagcaaggccaagggccagccgcgggagccccaggtctacacgctgccgccctcccagaaggagatgaccaagaaccaggtgagcctgacctgcctcgtgaaggggttctacccctccgacatcgccgtcgagtgggagagcaacggccagcccgagaacaactacaagaccacgcccccggtgctggactccgacgggagcttcttcctctactccaagctgaccgtggacaagagccgctggcaggagggcaacgtcttctcctgcagcgtgatgcacgaggcgctgcacaaccggtacacccagaagtccctcagcctgtccccc

SEQ ID NO: 7892 - RNA, 1332 nt, synthetic construct
  misc_feature 1..1332: note = derived and/or modified sequence opt1 from Emicizumab_HeavyChain2
  source 1..1332: mol_type = other RNA
caggtgcagctggtccagagcggctccgagctcaagaagcccggggccagcgtgaaggtgtcctgcaaggccagcggctacaccttcaccgacaacaacatggactgggtccgccaggcgccggggcagggcctggagtggatgggggacatcaacacgcggtccggcggcagcatctacaacgaggagttccaggaccgcgtgatcatgaccgtggacaagtccaccgacaccgcctacatggagctgagctccctccggagcgaggacacggccacctaccactgcgcccgccggaagtcctacgggtactacctggacgagtggggcgaggggaccctggtcaccgtgagctccgccagcacgaagggcccctccgtgttccccctcgcgccctgcagccgctccaccagcgagtccaccgccgccctggggtgcctggtcaaggactacttcccggagcccgtgaccgtgagctggaacagcggcgccctcacgtccggcgtccacaccttccccgcggtgctgcagagctccgggctgtacagcctctccagcgtggtcaccgtgccctccagctccctgggcacccagacgtacacgtgcaacgtggaccacaagccgagcaacaccaaggtcgacaagcgggtggagtccaagtacgggccgccctgcccgccctgccccgcccccgagttcctgggcggccccagcgtgttcctcttcccgcccaagcccaaggacaccctgatgatctcccgcacccccgaggtgacctgcgtcgtggtcgacgtgagccaggaggaccccgaggtccagttcaactggtacgtggacggggtggaggtccacaacgccaagaccaagccccgggaggagcagtacaactccacctaccgcgtggtgagcgtcctgacggtgctccaccaggactggctgaacggcaaggagtacaagtgcaaggtgtccaacaaggggctgcccagctccatcgagaagaccatcagcaaggccaagggccagccccgggagccgcaggtctacaccctcccgcccagccaggaggagatgaccaagaaccaggtgtccctgacgtgcctggtgaaggggttctaccccagcgacatcgccgtcgagtgggagtccaacggccagcccgagaacaactacaagaccaccccgcccgtgctcgacagcgacggctccttcttcctgtacagcaagctgaccgtggacaagtcccgctggcaggaggggaacgtcttcagctgctccgtgatgcacgaggcgctccacaaccactacacgcaggagagcctgtccctgagcccc

SEQ ID NO: 7893 - RNA, 642 nt, synthetic construct
  misc_feature 1..642: note = derived and/or modified sequence opt1 from Emicizumab_LightChain1
  source 1..642: mol_type = other RNA
gacatccagatgacccagagcccctccagcctgtccgccagcgtgggcgaccgcgtcaccatcacgtgcaaggcctcccggaacatcgagcgccagctcgcgtggtaccagcagaagccggggcaggcccccgagctgctgatctaccaggccagccggaaggagtccggcgtgcccgaccgcttcagcgggtcccggtacggcaccgacttcaccctcaccatcagctccctgcagcccgaggacatcgccacgtactactgccagcagtacagcgacccgcccctgaccttcgggggcggcaccaaggtggagatcaagcgcaccgtcgccgcgccctccgtgttcatcttcccgcccagcgacgagcagctcaagtccgggacggccagcgtggtctgcctgctgaacaacttctacccccgggaggccaaggtgcagtggaaggtggacaacgccctccagtccggcaacagccaggagtccgtcaccgagcaggacagcaaggacagcacctactccctgagctccaccctgacgctcagcaaggcggactacgagaagcacaaggtgtacgcctgcgaggtgacccaccaggggctgtccagccccgtcaccaagtccttcaaccgcggcgagtgc

SEQ ID NO: 7894 - RNA, 1347 nt, synthetic construct
  misc_feature 1..1347: note = derived and/or modified sequence opt1 from Enavatuzumab_HeavyChain1
  source 1..1347: mol_type = other RNA
gaggtgcagctggtcgagagcggcgggggcctcgtgcagcccgggggctccctgcgcctgagctgcgccgcctccgggttcaccttcagctcctactggatgagctgggtgcggcaggcgccgggcaagggcctcgagtgggtcgccgagatccgcctgaagtccgacaactacgccacccactacgccgagagcgtgaaggggcggttcacgatctcccgcgacgacagcaagaactccctgtacctccagatgaacagcctgcgggccgaggacaccgcggtgtactactgcaccggctactacgccgacgccatggactactgggggcagggcaccctggtcacggtgtccagcgcctccaccaaggggcccagcgtgttccccctcgcgccctccagcaagtccaccagcggcggcaccgccgccctggggtgcctggtcaaggactacttcccggagcccgtgacggtgagctggaactccggcgccctcaccagcggggtccacaccttccccgccgtgctgcagtccagcggcctgtactccctcagctccgtggtcaccgtgcccagctccagcctgggcacgcagacctacatctgcaacgtgaaccacaagccgtccaacaccaaggtcgacaagaaggtggagcccaagagctgcgacaagacccacacgtgcccgccctgccccgcgcccgagctgctcgggggcccctccgtgttcctgttcccgcccaagcccaaggacaccctgatgatcagccgcacccccgaggtgacctgcgtcgtggtcgacgtgtcccacgaggaccccgaggtcaagttcaactggtacgtggacggggtggaggtccacaacgccaagacgaagccgcgggaggagcagtacaacagcacctaccgcgtggtgtccgtcctcaccgtgctgcaccaggactggctgaacggcaaggagtacaagtgcaaggtgagcaacaaggccctccccgcccccatcgagaagaccatctccaaggccaaggggcagccccgggagccgcaggtctacacgctgccgcccagccgcgaggagatgaccaagaaccaggtgagcctgacctgcctcgtgaagggcttctacccctccgacatcgcggtcgagtgggagagcaacggccagcccgagaacaactacaagaccacgccgcccgtgctggactccgacgggagcttcttcctgtactccaagctcaccgtggacaagagccggtggcagcagggcaacgtcttctcctgcagcgtgatgcacgaggccctgcacaaccactacacccagaagtccctgagcctctcccccgggaag

SEQ ID NO: 7895 - RNA, 654 nt, synthetic construct
  misc_feature 1..654: note = derived and/or modified sequence opt1 from Enavatuzumab_LightChain1
  source 1..654: mol_type = other RNA
gacatccagatgacccagagcccctccagcctgtccgccagcgtgggcgaccgggtcaccatcacgtgccgggcctcccagagcgtgtccaccagctcctacagctacatgcactggtaccagcagaagccggggaaggcgcccaagctcctgatcaagtacgcctccaacctggagagcggcgtgccctcccgcttcagcgggtccggcagcgggaccgacttcaccctcacgatctccagcctgcagcccgaggacttcgccacctactactgccagcactcctgggagatcccgtacaccttcggcggcgggaccaaggtcgagatcaagcggacggtggccgcccccagcgtgttcatcttcccgcccagcgacgagcagctgaagtccggcaccgcgagcgtcgtgtgcctcctgaacaacttctacccccgcgaggccaaggtgcagtggaaggtcgacaacgccctgcagtccgggaacagccaggagtccgtgaccgagcaggacagcaaggactccacctacagcctctccagcacgctgaccctgtccaaggccgactacgagaagcacaaggtgtacgcgtgcgaggtcacccaccagggcctcagctcccccgtgaccaagagcttcaaccgcggggagtgc

SEQ ID NO: 7896 - RNA, 1341 nt, synthetic construct
  misc_feature 1..1341: note = derived and/or modified sequence opt1 from Enfortumab_HeavyChain
  source 1..1341: mol_type = other RNA
gaggtgcagctggtcgagagcggcgggggcctcgtgcagcccgggggctccctgcgcctgagctgcgccgcctccgggttcaccttcagctcctacaacatgaactgggtgcggcaggcgccgggcaagggcctcgagtgggtcagctacatctccagctccagctccaccatctactacgccgacagcgtgaaggggcgcttcacgatctcccgggacaacgccaagaacagcctgtccctgcagatgaacagcctccgcgacgaggacaccgccgtgtactactgcgcccgggcgtactactacggcatggacgtctgggggcagggcaccaccgtgacggtgtccagcgcctccaccaaggggcccagcgtcttccccctggcccccagctccaagagcacctccggcggcaccgccgcgctggggtgcctcgtgaaggactacttcccggagcccgtgacggtcagctggaactccggcgccctgaccagcggggtgcacaccttccccgccgtgctgcagtccagcggcctctactccctgagctccgtcgtgaccgtgcccagctccagcctgggcacgcagacctacatctgcaacgtcaaccacaagccgtccaacaccaaggtggacaagcgcgtggagcccaagagctgcgacaagacccacacgtgcccgccctgcccggcccccgagctcctcgggggcccctccgtcttcctgttcccgcccaagcccaaggacaccctcatgatcagccggacccccgaggtgacctgcgtggtcgtggacgtctcccacgaggaccccgaggtgaagttcaactggtacgtggacggggtcgaggtgcacaacgccaagacgaagccgcgcgaggagcagtacaacagcacctaccgggtggtcagcgtgctgaccgtgctgcaccaggactggctcaacggcaaggagtacaagtgcaaggtctccaacaaggcgctgcccgcccccatcgagaagaccatcagcaaggccaaggggcagccccgcgagccccaggtgtacacgctgccgccctcccgggaggagatgaccaagaaccaggtgagcctgacctgcctggtcaagggcttctacccctccgacatcgccgtggagtgggagagcaacggccagcccgagaacaactacaagaccacgccgcccgtgctggactccgacgggagcttcttcctctactccaagctgaccgtcgacaagagccgctggcagcagggcaacgtgttctcctgcagcgtgatgcacgaggccctgcacaaccactacacccagaagtccctcagcctgtcccccgggaag

SEQ ID NO: 7897 - RNA, 642 nt, synthetic construct
  misc_feature 1..642: note = derived and/or modified sequence opt1 from Enfortumab_LightChain
  source 1..642: mol_type = other RNA
gacatccagatgacccagagcccctccagcgtgtccgccagcgtcggcgaccgcgtgaccatcacgtgccgggcctcccaggggatcagcggctggctggcgtggtaccagcagaagccggggaaggcccccaagttcctcatctacgccgcctccaccctgcagagcggcgtgccctcccgcttcagcgggtccggcagcggcaccgacttcaccctgacgatctccagcctccagcccgaggacttcgccacctactactgccagcaggcgaactccttcccgcccaccttcgggggcgggaccaaggtcgagatcaagcggacggtggccgcccccagcgtgttcatcttcccgccctccgacgagcagctcaagagcggcaccgcctccgtcgtgtgcctgctgaacaacttctacccccgcgaggcgaaggtgcagtggaaggtcgacaacgccctgcagagcgggaacagccaggagtccgtgaccgagcaggacagcaaggactccacctacagcctgtccagcacgctcaccctgtccaaggccgactacgagaagcacaaggtgtacgcctgcgaggtcacccaccagggcctgagctcccccgtgaccaagagcttcaaccggggcgagtgc

SEQ ID NO: 7898 - RNA, 1341 nt, synthetic construct; identical to SEQ ID NO: 7896
  misc_feature 1..1341: note = derived and/or modified sequence opt1 from Enfortumab_vedotin_HeavyChain1
  source 1..1341: mol_type = other RNA

SEQ ID NO: 7899 - RNA, 642 nt, synthetic construct; identical to SEQ ID NO: 7897
  misc_feature 1..642: note = derived and/or modified sequence opt1 from Enfortumab_vedotin_LightChain1
  source 1..642: mol_type = other RNA

SEQ ID NO: 7900 - RNA, 1356 nt, synthetic construct
  misc_feature 1..1356: note = derived and/or modified sequence opt1 from Enoblituzumab_HeavyChain
  source 1..1356: mol_type = other RNA
gaggtgcagctggtcgagagcggcgggggcctcgtgcagcccgggggctccctgcgcctgagctgcgccgcctccgggttcaccttcagctccttcggcatgcactgggtgcggcaggcgccgggcaaggggctcgagtgggtcgcctacatcagctccgacagctccgccatctactacgccgacaccgtgaagggccgcttcacgatcagccgggacaacgccaagaactccctgtacctgcagatgaacagcctccgcgacgaggacaccgcggtgtactactgcgggcggggccgcgagaacatctactacgggtcccggctggactactggggccagggcaccaccgtcacggtgagctccgccagcaccaaggggccctccgtgttccccctggcccccagctccaagagcaccagcggcgggaccgccgcgctcggctgcctggtcaaggactacttcccggagcccgtgacggtgtcctggaacagcggcgccctgacctccggggtccacaccttccccgccgtgctccagagctccggcctgtacagcctgtccagcgtggtcaccgtgccctccagctccctcgggacgcagacctacatctgcaacgtgaaccacaagccgagcaacaccaaggtcgacaagcgcgtggagcccaagtcctgcgacaagacccacacgtgcccgccctgccccgcccccgagctggtgggcgggcccagcgtcttcctgctgcccccgaagcccaaggacaccctcatgatctcccggacccccgaggtgacctgcgtggtcgtggacgtcagccacgaggaccccgaggtgaagttcaactggtacgtggacggcgtcgaggtgcacaacgccaagacgaagccgcccgaggagcagtacaactccaccctgcgcgtggtcagcgtgctcaccgtgctgcaccaggactggctgaacggcaaggagtacaagtgcaaggtctccaacaaggcgctccccgcccccatcgagaagaccatcagcaaggccaaggggcagccgcgggagccccaggtgtacacgctgccgcccagccgcgaggagatgaccaagaaccaggtgtccctgacctgcctcgtcaagggcttctaccccagcgacatcgccgtggagtgggagtccaacgggcagcccgagaacaactacaagaccacgcccctggtgctggacagcgacggctccttcttcctctacagcaagctgaccgtcgacaagtcccggtggcagcaggggaacgtgttcagctgctccgtgatgcacgaggccctgcacaaccactacacccagaagtccctcagcctgagcccgggcaag

SEQ ID NO: 7901 - RNA, 642 nt, synthetic construct
  misc_feature 1..642: note = derived and/or modified sequence opt1 from Enoblituzumab_LightChain
  source 1..642: mol_type = other RNA
gacatccagctgacccagagcccctccttcctcagcgcctccgtgggcgaccgcgtcaccatcacgtgcaaggccagccagaacgtggacaccaacgtggcgtggtaccagcagaagccggggaaggcccccaaggccctgatctactccgccagctaccggtactccggcgtccccagccgcttctccgggagcggctccgggaccgacttcaccctgacgatcagctccctccagcccgaggacttcgccacctactactgccagcagtacaacaactacccgttcaccttcggccagggcaccaagctggagatcaagcggacggtggcggcccccagcgtgttcatcttcccgccctccgacgagcagctcaagagcgggaccgcctccgtcgtgtgcctgctgaacaacttctacccccgcgaggccaaggtgcagtggaaggtcgacaacgcgctgcagagcggcaactcccaggagagcgtgaccgagcaggacagcaaggactccacctacagcctctccagcacgctgaccctgtccaaggccgactacgagaagcacaaggtgtacgcctgcgaggtcacccaccaggggctcagctcccccgtgaccaagagcttcaaccggggcgagtgc

SEQ ID NO: 7902 - RNA, 1356 nt, synthetic construct
  misc_feature 1..1356: note = derived and/or modified sequence opt1 from Enokizumab_HeavyChain1
  source 1..1356: mol_type = other RNA
caggtgcagctggtccagagcggcgccgaggtgaagaagcccgggtccagcgtgaaggtctcctgcaaggccagcggcgggaccttctcctactactggatcgagtgggtgcgccaggcgccgggccaggggctcgagtggatgggcgagatcctgcccggcagcgggaccacgaaccccaacgagaagttcaagggccgggtgaccatcaccgccgacgagtccaccagcacggcctacatggagctgtccagcctccgctccgaggacaccgccgtctactactgcgcccgggcggactactacgggagcgactacgtgaagttcgactactggggccaggggaccctggtgaccgtctccagcgcctccacgaagggccccagcgtgttcccgctggccccctccagcaagtccaccagcggcgggaccgccgcgctcggctgcctggtgaaggactacttccccgagcccgtcaccgtgagctggaactccggggccctgacgagcggcgtgcacaccttcccggccgtcctccagtccagcggcctgtactccctgagctccgtggtgaccgtccccagctccagcctcgggacccagacgtacatctgcaacgtgaaccacaagccctccaacaccaaggtggacaagcgcgtcgagcccaagagctgcgacaagacccacacgtgcccgccctgccccgcccccgagctgctgggcgggccgtccgtgttcctcttcccgcccaagcccaaggacaccctgatgatcagccggacccccgaggtgacctgcgtcgtggtcgacgtgtcccacgaggaccccgaggtgaagttcaactggtacgtcgacggcgtggaggtgcacaacgccaagaccaagccccgcgaggagcagtacaacagcacgtaccgggtcgtgtccgtgctgaccgtcctccaccaggactggctgaacgggaaggagtacaagtgcaaggtgagcaacaaggcgctgcccgccccgatcgagaagaccatctccaaggccaagggccagccccgcgagccccaggtgtacaccctcccgcccagccgggaggagatgacgaagaaccaggtcagcctgacctgcctggtgaagggcttctacccctccgacatcgccgtggagtgggagagcaacgggcagcccgagaacaactacaagaccaccccgcccgtcctcgactccgacggcagcttcttcctgtactccaagctgacggtggacaagagccgctggcagcaggggaacgtgttctcctgcagcgtcatgcacgaggccctccacaaccactacacccagaagtccctgagcctgtcccccggcaag

SEQ ID NO: 7903 - RNA, 642 nt, synthetic construct
  misc_feature 1..642: note = derived and/or modified sequence opt1 from Enokizumab_LightChain1
  source 1..642: mol_type = other RNA
gacatccagatgacccagagcccctccagcctgtccgccagcgtgggcgaccgcgtcaccatcacgtgcaaggcctcccagcacgtgatcacccacgtgacctggtaccagcagaagccggggaaggcgcccaagctcctgatctacggcaccagctactcctacagcggggtcccctcccggttcagcggctccgggagcggcacggacttcaccctgaccatctccagcctccagcccgaggacttcgccacctactactgccagcagttctacgagtacccgctgacgttcggcgggggcaccaaggtggagatcaagcgcaccgtggccgccccctccgtcttcatcttcccgcccagcgacgagcagctgaagtccgggaccgccagcgtggtgtgcctcctgaacaacttctacccccgggaggcgaaggtccagtggaaggtggacaacgccctgcagtccggcaacagccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccgcggcgagtgc

SEQ ID NO: 7904 - RNA, 612 nt, synthetic construct
  misc_feature 1..612: note = derived and/or modified sequence opt1 from Enokizumab_LightChain
  source 1..612: mol_type = other RNA
gacatccagatgacccagagcccctccagcctgtccgccagcgtgggcgaccgcgtcaccatcacgtgcaaggcctcccagcacgtgatcacccacgtgacctggtaccagcagaagccggggaaggcgcccaagctcctgatctacggcaccagctactcctacagcggggtcccctcccggttcagcggctccgggagcggcacggacttcaccctgaccatctccagcctccagcccgaggacttcgccacctactactgccagcagttctacgagtacccgctgacgttcggcgggggcaccaaggtggagatcaagcgcaccgtggccgccccctccgtcttcatcttcccgcccagcgacgagcagctgaagtccgggaccgccagcgtggtgtgcctcctgaacaacttctacccccgggaggcgaaggtccagtggaaggtggagtccgtgacggagcaggacagcaaggacagcacctactccctgagctccaccctcaccctgagcaaggccgactacgagaagcacaaggtctacgcctgcgaggtgacgcaccagggcctgtccagccccgtgaccaagtccttcaaccgcggggagtgc

SEQ ID NO: 7905 - RNA, 1356 nt, synthetic construct
  misc_feature 1..1356: note = derived and/or modified sequence opt1 from Enoticumab_HeavyChain1
  source 1..1356: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtgagcttcctctggtacgacgggaccaacaagaactacgtggagtccgtcaagggccggttcacgatcagccgcgacaactccaagaacatgctgtacctggagatgaacagcctccgggccgaggacaccgccgtgtactactgcgcccgcgaccacgacttccggtccgggtacgagggctggttcgacccctgggggcagggcaccctggtgaccgtcagctccgccagcacgaagggcccctccgtgttccccctggcgccgagctccaagagcacctccgggggcaccgccgccctcgggtgcctggtgaaggactacttccccgagcccgtcaccgtgagctggaacagcggcgccctgacgtccggcgtgcacaccttccccgcggtcctccagagctccgggctgtacagcctgtccagcgtggtgaccgtcccgtccagctccctcggcacccagacgtacatctgcaacgtgaaccacaagcccagcaacaccaaggtggacaagaaggtcgagcccaagtcctgcgacaagacccacacgtgcccgccctgccccgcccccgagctgctcgggggccccagcgtgttcctgttcccgcccaagcccaaggacaccctgatgatctcccgcacccccgaggtgacctgcgtcgtggtcgacgtgagccacgaggacccggaggtgaagttcaactggtacgtcgacggggtggaggtgcacaacgccaagaccaagccccgggaggagcagtacaactccacgtaccgcgtcgtgagcgtgctgaccgtcctccaccaggactggctgaacggcaaggagtacaagtgcaaggtgtccaacaaggccctgcccgcccccatcgagaagaccatcagcaaggcgaagggccagccgcgggagccccaggtgtacaccctcccgccctcccgcgacgagctgacgaagaaccaggtcagcctgacctgcctcgtgaaggggttctaccccagcgacatcgccgtggagtgggagtccaacggccagcccgagaacaactacaagaccacgcccccggtcctggacagcgacgggtccttcttcctgtacagcaagctcaccgtggacaagtcccggtggcagcagggcaacgtgttcagctgctccgtcatgcacgaggccctgcacaaccactacacccagaagtccctgagcctcagccccggg

SEQ ID NO: 7906 - RNA, 642 nt, synthetic construct
  misc_feature 1..642: note = derived and/or modified sequence opt1 from Enoticumab_LightChain1
  source 1..642: mol_type = other RNA
gagatcgtgctgacccagagccccgccaccctctccctgagccccggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcaccggagcaactggccgcccaccttcggcggcgggaccaaggtggagatcaagcgcaccgtcgccgccccctccgtgttcatcttcccgcccagcgacgagcagctgaagtccggcacggcgagcgtggtctgcctcctgaacaacttctacccccgggaggccaaggtgcagtggaaggtggacaacgccctgcagtccgggaacagccaggagagcgtcaccgagcaggactccaaggacagcacctactccctcagctccaccctgacgctgagcaaggccgactacgagaagcacaaggtgtacgcctgcgaggtgacccaccagggcctctccagccccgtcaccaagtccttcaaccgcggggagtgc

SEQ ID NO: 7907 - RNA, 1329 nt, synthetic construct
  misc_feature 1..1329: note = derived and/or modified sequence opt1 from Ensituximab_HeavyChain1
  source 1..1329: mol_type = other RNA
caggtgcagctgaaggagagcggccccgacctcgtcgccccgtcccagagcctgtccatcacgtgcaccgtgagcgggttctccctgagcaagttcggcgtgaactgggtccgccagccgcccgggaagggcctcgagtggctgggggtgatctggggcgacggctccaccagctacaactccgggctgatcagccggctctccatcagcaaggagaactccaagagccaggtgttcctgaagctgaactccctccaggccgacgacaccgcgacctactactgcgtcaagcccggcggggactactggggccacgggaccagcgtgacggtgtccagcgcctccaccaagggcccgagcgtcttccccctggcccccagctccaagagcacctccggcgggaccgccgccctgggctgcctcgtgaaggactacttccccgagccggtgacggtcagctggaactccggggcgctgaccagcggcgtgcacaccttccccgccgtgctgcagtccagcggcccctactccctcagctccgtcgtgaccgtgcccagctccagcctggggacgcagacctacatctgcaacgtcaaccacaagccgtccaacaccaaggtggacaagaaggtggagcccaagagctgcgacaagacccacacgtgcccgccctgccccgcccccgagctgctcggcgggccctccgtcttcctgttcccgcccaagcccaaggacaccctgatgatcagccgcacccccgaggtgacctgcgtggtcgtggacgtctcccacgaggaccccgaggtgaagttcaactggtacgtggacggcgtcgaggtgcacaacgccaagacgaagccgcgggaggagcagtacaacagcacctaccgcgtggtcagcgtgctcaccgtgctgcaccaggactggctgaacgggaaggagtacaagtgcaaggtctccaacaaggcgctccccgcccccatcgagaagaccatcagcaaggccaagggccagccccgggagccccaggtgtacacgctgccgccctcccgcgacgagctgaccaagaaccaggtgagcctgacctgcctcgtcaagggcttctacccctccgacatcgccgtggagtgggagagcaacgggcagcccgagaacaactacaagaccatgccgcccgtgctggactccgacggcagcttcttcctctactccaagctgacggtcgacaagagccggtggcagcaggggaacgtgttctcctgcagcgtgatgcacgaggccctgcacaaccactacacccagaagtccctcagcctgtcccccggcaag

SEQ ID NO: 7908 - RNA, 639 nt, synthetic construct
  misc_feature 1..639: note = derived and/or modified sequence opt1 from Ensituximab_LightChain1
  source 1..639: mol_type = other RNA
caggtggtcctgacccagagccccgtgatcatgtccgccagcccgggcgagaaggtgaccatgacgtgctccgccagctccagcatctcctacatgtactggtaccagcagaagcccgggaccagccccaagcgctggatctacgacacctccaagctcgcgagcggcgtccccgcccggttctccgggagcggctccgggaccagctactccctgacgatcagcaacatggaggccggcgacgccgccacctactactgccaccagcgcgactcctacccgtggaccttcggcgggggcaccaacctggagatcaagcggacggtggcggcccccagcgtgttcatcttcccgccctccgacgagcagctcaagagcgggaccgccagcgtcgtgtgcctgctgaacaacttctacccccgcgaggccaaggtgcagtggaaggtcgacaacgcgctccagtccggcaacagccaggagtccgtgaccgagcaggacagcaaggactccacctacagcctgtccagcacgctgaccctctccaaggccgactacgagaagcacaaggtgtacgcctgcgaggtcacccaccaggggctgagctcccccgtgaccaagagcttcaaccggggcgagtgc

SEQ ID NO: 7909 - RNA, 768 nt, synthetic construct; identical to SEQ ID NO: 7880
  misc_feature 1..768: note = derived and/or modified sequence opt1 from Ensituximab_SingleChain_variable_fragment
  source 1..768: mol_type = other RNA

SEQ ID NO: 7910 - RNA, 987 nt, synthetic construct
  misc_feature 1..987: note = derived and/or modified sequence opt1 from Entolimod_chain1
  source 1..987: mol_type = other RNA
atgcgcggcagccaccaccaccaccaccacgggatggcctccatgaccggcgggcagcagatgggccgggacctgtacgacgacgacgacaaggaccccatggcccaggtgatcaacaccaacagcctctccctgctgacgcagaacaacctcaacaagagccagtccagcctgtccagcgcgatcgagcgcctgtccagcgggctccggatcaactccgccaaggacgacgccgccggccaggccatcgcgaaccgcttcaccagcaacatcaagggcctgacccaggcctcccggaacgccaacgacgggatcagcatcgcccagaccacggagggcgcgctgaacgagatcaacaacaacctccagcgcgtccgggagctgtccgtgcaggccaccaacgggaccaacagcgactccgacctcaagagcatccaggacgagatccagcagcgcctggaggagatcgaccgggtgtccaaccagacccagttcaacggcgtcaaggtgctgagccaggacaaccagatgaagatccaggtgggggccaacgacggcgagacgatcaccatcgacctgcagaagatcgacgtcaagagcctcggcctggacgggttcaacgtgaactccccgggcatcagcgggggcggcgggggcatcctggactccatggggaccctcatcaacgaggacgccgccgcggccaagaagtccaccgccaaccccctggccagcatcgacagcgccctgtccaaggtggacgcggtccgcagctccctcggcgccatccagaaccggttcgacagcgccatcacgaacctggggaacaccgtgaccaacctgaactccgcccgcagccggatcgaggacgccgactacgcgaccgaggtgtccaacatgagcaaggcccagatcctccagcaggccggcacgtccgtcctggcccaggccaaccaggtgccccagaacgtgctgagcctcctgcgc

SEQ ID NO: 7911 - RNA, 1338 nt, synthetic construct
  misc_feature 1..1338: note = derived and/or modified sequence opt1 from Epratuzumab_HeavyChain
  source 1..1338: mol_type = other RNA
caggtgcagctggtccagagcggcgccgaggtgaagaagcccgggtccagcgtgaaggtctcctgcaaggccagcggctacaccttcacctcctactggctccactgggtgcgccaggcgccggggcagggcctggagtggatcgggtacatcaacccccggaacgactacaccgagtacaaccagaacttcaaggacaaggccaccatcaccgccgacgagagcaccaacacggcctacatggagctgtccagcctccgctccgaggacaccgccttctacttctgcgcgcggcgcgacatcaccaccttctactggggccagggcacgctggtgaccgtcagctccgccagcaccaaggggccctccgtgttccccctggccccgagctccaagagcacctccggcgggacggccgcgctcggctgcctggtgaaggactacttccccgagcccgtcaccgtgagctggaactccggggccctgaccagcggcgtgcacaccttccccgccgtcctccagagctccggcctgtacagcctgtccagcgtggtgacggtcccgtccagctccctcgggacccagacctacatctgcaacgtgaaccacaagcccagcaacaccaaggtggacaagaaggtcgagcccaagtcctgcgacaagacgcacacgtgcccgccctgccccgcccccgagctgctgggcgggcccagcgtgttcctcttcccgcccaagcccaaggacaccctgatgatctcccggacccccgaggtgacctgcgtcgtggtggacgtcagccacgaggacccggaggtgaagttcaactggtacgtcgacggcgtggaggtgcacaacgccaagaccaagccccgcgaggagcagtacaactccacctaccgggtcgtgagcgtgctgaccgtcctccaccaggactggctgaacggcaaggagtacaagtgcaaggtgtccaacaaggcgctgcccgcccccatcgagaagacgatcagcaaggccaaggggcagccgcgcgagccccaggtgtacaccctcccgccctcccgggacgagctgaccaagaaccaggtcagcctgacctgcctcgtgaagggcttctacccctccgacatcgccgtggagtgggagagcaacgggcagcccgagaacaactacaagacgacgcccccggtcctggacagcgacggctccttcttcctgtacagcaagctcaccgtggacaagtcccgctggcagcaggggaacgtgttcagctgctccgtcatgcacgaggccctgcacaaccactacacccagaagtccctgagcctcagccccggcaag

SEQ ID NO: 7912 - RNA, 657 nt, synthetic construct
  misc_feature 1..657: note = derived and/or modified sequence opt1 from Epratuzumab_LightChain
  source 1..657: mol_type = other RNA
gacatccagctgacccagagcccctccagcctctccgccagcgtgggcgaccgcgtcaccatgtcctgcaagagctcccagagcgtgctgtactccgccaaccacaagaactacctggcgtggtaccagcagaagccggggaaggcccccaagctcctgatctactgggccagcacgcgggagtccggcgtgcccagccgcttctccgggagcggctccgggaccgacttcaccttcaccatcagctccctgcagcccgaggacatcgccacgtactactgccaccagtacctcagctcctggaccttcggccagggcaccaaggtcgagatcaagcggaccgtggccgcgccgagcgtgttcatcttcccgcccagcgacgagcagctgaagtccgggacggccagcgtcgtgtgcctgctcaacaacttctacccccgcgaggccaaggtgcagtggaaggtcgacaacgccctgcagtccggcaacagccaggagtccgtgaccgagcaggacagcaaggactccacctacagcctgtccagcaccctcacgctgtccaaggcggactacgagaagcacaaggtgtacgcctgcgaggtcacccaccaggggctgagctcccccgtgaccaagagcttcaaccggggcgagtgc

SEQ ID NO: 7913 - RNA, 762 nt, synthetic construct
  misc_feature 1..762: note = derived and/or modified sequence opt1 from Eptacog_beta_HeavyChain1
  source 1..762: mol_type = other RNA
atcgtgggcgggaaggtctgccccaagggcgagtgcccgtggcaggtcctgctcctggtgaacggggcccagctgtgcggcgggaccctcatcaacaccatctgggtggtgagcgccgcgcactgcttcgacaagatcaagaactggcgcaacctgatcgccgtgctgggcgagcacgacctctccgagcacgacggcgacgagcagagccggcgcgtcgcccaggtgatcatcccctccacgtacgtgcccgggaccaccaaccacgacatcgccctgctgcggctccaccagcccgtcgtgctgaccgaccacgtggtcccgctgtgcctccccgagcgcacgttcagcgagcggaccctggccttcgtgcgcttctccctggtgagcggctgggggcagctcctggaccggggcgcgaccgccctggagctcatggtcctgaacgtgccccgcctgatgacccaggactgcctccagcagtcccggaaggtgggggacagccccaacatcacggagtacatgttctgcgccggctactccgacggcagcaaggactcctgcaagggggacagcggcgggccgcacgccacccactaccgcggcacctggtacctgaccggcatcgtctcctgggggcagggctgcgcgacggtggggcacttcggcgtgtacacccgggtcagccagtacatcgagtggctgcagaagctcatgcgctccgagccccggcccggggtgctgctgcgcgcccccttcccg

SEQ ID NO: 7914 - RNA, 456 nt, synthetic construct
  misc_feature 1..456: note = derived and/or modified sequence opt1 from Eptacog_beta_LightChain1
  source 1..456: mol_type = other RNA
gccaacgccttcctggaggagctccgccccggcagcctggagcgggagtgcaaggaggagcagtgctccttcgaggaggcgcgcgagatcttcaaggacgccgagcggaccaagctgttctggatcagctactccgacggggaccagtgcgccagctccccgtgccagaacggcgggagctgcaaggaccagctccagtcctacatctgcttctgcctgcccgccttcgagggccgcaactgcgagacccacaaggacgaccagctgatctgcgtgaacgagaacgggggctgcgagcagtactgcagcgaccacacgggcaccaagcggtcctgccgctgccacgaggggtacagcctcctggccgacggcgtctcctgcacccccaccgtggagtacccctgcgggaagatcccgatcctggagaagcggaacgcgagcaagccccagggccgc

SEQ ID NO: 7915 - RNA, 708 nt, synthetic construct
  misc_feature 1..708: note = derived and/or modified sequence opt1 from Erlizuab_HeavyChain1
  source 1..708: mol_type = other RNA
gaggtgcagctggtcgagagcggcgggggcctcgtgcagcccgggggctccctgcgcctgagctgcgccacctccgggtacaccttcacggagtacacccactggcggcaggccccgggcaagggcctcgagtgggtggcggggatcaaccccaagaacggcgggaccagccacaaccagcgcttcgaccggttcaccatctccgtcgacaagagcacgtccaccgcctaccagaacagcctgcgcgccgaggacaccgccgtgtactactgcgcccggtggcgcggcctgaactacgggttcgacgtgcggtacttcgacgtctggggccagggcaccctcgtgacggtgtccagcgcgtccaccaaggggcccagcgtcttccccctggccccgtccagcaagtccaccagcggcgggaccgccgccctgggctgcctcgtgaaggactacttccccgagcccgtgacggtctcctggaacagcggcgcgctgacctccggggtgcacaccttccccgccgtgctgcagagcagcggcctctactccctgagctccgtcgtgaccgtgccgagctccagcctggggacgcagacctacatctgcaacgtcaaccacaagccctccaacaccaaggtggacaagaaggtggagcccaagagctgcgacaagacccacacgtgcccgccctgccccgcccccgagctc

SEQ ID NO: 7916 - RNA, 639 nt, synthetic construct
  misc_feature 1..639: note = derived and/or modified sequence opt1 from Erlizuab_LightChain1
  source 1..639: mol_type = other RNA
gacatccagacccagagcccctccagcctgtccgccagcgtgggcgaccgggtcaccatcacgtgccgggcctcccaggacatcaacaactacctcaactggtaccagcagaagccggggaaggcgcccaagctgctgatctactacaccagcaccctccactccggcgtgcccagccgcttctccgggagcggctccgggaccgactacacgctgaccatcagctccctgcagcccgaggacttcgccacctactactgccagcagggcaacaccctcccgcccacgttcggccaggggaccaaggtggagatcaagcggaccgtcgccgcccccagcgtgttcatcttcccgccctccgacgagcagctcaagagcggcaccgcctccgtggtctgcctgctgaacaacttctacccccgcgaggcgaaggtgcagtggaaggtggacaacgccctgcagagcgggaactcccaggagagcgtcacggagcaggacagcaaggactccacctacagcctgtccagcaccctcaccctgtccaaggccgactacgagaagcacaaggtgtacgcctgcgaggtgacgcaccagggcctgagctcccccgtcaccaagagcttcaaccgcggggagtgc

SEQ ID NO: 7917 - RNA, 1341 nt, synthetic construct
  misc_feature 1..1341: note = derived and/or modified sequence opt1 from Etaracizumab_HeavyChain1
  source 1..1341: mol_type = other RNA
caggtgcagctggtcgagagcggcgggggcgtggtgcagcccgggcgctccctccggctgagctgcgccgcctccggcttcaccttcagctcctacgacatgagctgggtccgccaggcgccggggaagggcctggagtgggtggccaaggtgtccagcggcgggggctccacctactacctcgacacggtccaggggcggttcaccatcagccgcgacaactccaagaacaccctgtacctgcagatgaacagcctccgggccgaggacaccgccgtgtactactgcgcccgccacctccacggctccttcgcgagctgggggcagggcacgaccgtgaccgtctccagcgcctccaccaagggccccagcgtgttccccctggccccctccagcaagagcacgtccgggggcaccgccgcgctggggtgcctggtgaaggactacttcccggagcccgtcaccgtgagctggaactccggcgccctgaccagcggcgtgcacacgttccccgccgtcctccagtccagcgggctgtactccctgagctccgtggtgaccgtccccagctccagcctcggcacccagacctacatctgcaacgtgaaccacaagccgtccaacacgaaggtggacaagcgggtcgagcccaagagctgcgacaagacccacacgtgcccgccctgcccggcccccgagctgctcgggggcccctccgtgttcctgttcccgcccaagcccaaggacaccctgatgatcagccgcacccccgaggtgacctgcgtcgtggtcgacgtgtcccacgaggaccccgaggtgaagttcaactggtacgtcgacggggtggaggtgcacaacgccaagaccaagccgcgggaggagcagtacaacagcacctaccgcgtcgtgtccgtgctgacggtcctccaccaggactggctgaacggcaaggagtacaagtgcaaggtgagcaacaaggcgctgcccgcccccatcgagaagaccatcagcaaggccaagggccagccccgggagccccaggtgtacaccctcccgccctcccgcgaggagatgaccaagaaccaggtcagcctgacgtgcctggtgaaggggttctacccctccgacatcgccgtggagtgggagagcaacggccagcccgagaacaactacaagaccaccccgcccgtcctcgactccgacgggagcttcttcctgtactccaagctgaccgtggacaagagccggtggcagcagggcaacgtgttctcctgcagcgtcatgcacgaggccctccacaaccactacacgcagaagtccctgagcctgtcccccgggaag

SEQ ID NO: 7918 - RNA, 642 nt, synthetic construct
  misc_feature 1..642: note = derived and/or modified sequence opt1 from Etaracizumab_LightChain1
  source 1..642: mol_type = other RNA
gagatcgtgctgacccagagccccgccaccctctccctgagcccgggcgagcgcgccacgctgtcctgccaggcgagccagtccatcagcaacttcctccactggtaccagcagcggcccgggcaggcgccccgcctgctgatccggtaccgctcccagagcatctccggcatccccgcccggttcagcgggtccggcagcgggaccgacttcaccctcaccatctccagcctggagccggaggacttcgccgtctactactgccagcagtccggcagctggcccctgacgttcggcgggggcaccaaggtggagatcaagcgcaccgtggccgccccctccgtcttcatcttcccgcccagcgacgagcagctcaagtccgggaccgccagcgtggtgtgcctgctgaacaacttctacccccgggaggccaaggtccagtggaaggtggacaacgccctccagagcggcaactcccaggagagcgtgacggagcaggactccaaggacagcacctactccctgagctccaccctgaccctcagcaaggcggactacgagaagcacaaggtctacgcctgcgaggtgacgcaccaggggctgtccagccccgtgaccaagtccttcaaccgcggcgagtgc

SEQ ID NO: 7919 - RNA, 1326 nt, synthetic construct
  misc_feature 1..1326: note = derived and/or modified sequence opt1 from Etrolizuab_HeavyChain1
  source 1..1326: mol_type = other RNA
gaggtgcagctggtcgagagcggcgggggcctcgtgcagcccgggggctccctgcgcctgagctgcgccgcctccgggttcttcatcaccaacaactactggggctgggtgcggcaggcgccgggcaaggggctcgagtgggtcggctacatcagctactccgggagcacctcctacaaccccagcctgaagtcccgcttcacgatcagccgggacacctccaagaacaccttctacctgcagaacagcctccgcgccgaggacaccgccgtgtactactgcgcccggacgggctccagcgggtacttcgacttctggggccagggcaccctggtgaccgtctccagcgcctccaccaaggggcccagcgtgttccccctggcgccgtccagcaagagcacgtccggcgggaccgccgccctcggctgcctggtgaaggactacttccccgagcccgtcaccgtgagctggaactccggcgccctgaccagcggggtgcacacgttccccgcggtcctccagtccagcggcctgtactccctgagctccgtggtgaccgtcccgagctccagcctcgggacccagacctacatctgcaacgtgaaccacaagccctccaacacgaaggtggacaagaaggtcgagcccaagagctgcgacaagacccacacgtgcccgccctgccccgcccccgagctgctgggcgggccctccgtgttcctcttcccgcccaagcccaaggacaccctgatcagccgcacccccgaggtgacctgcgtcgtggtggacgtctcccacgaggacccggaggtgaagttcaactggtacgtcgacggcgtggaggtgcacaacgccaagaccaagccccgggaggagcagtacaacagcacctaccgcgtcgtgtccgtgctgacggtcctccaccaggactggctgaacggcaaggagtacaagtgcaaggtgagcaacaaggccctgcccgcccccatcgagaagaccatcagcaaggcgaaggggcagccgcgggagccccaggtgtacaccctcccgccctcccgcgaggagaccaagaaccaggtcagcctgacgtgcctggtgaagggcttctacccctccgacatcgccgtggagtgggagagcaacgggcagcccgagaacaactacaagaccacgcccccggtcctcgactccgacggcagcttcttcctgtactccaagctgaccgtggacaagagccggtggcagcaggggaacgtgttctcctgcagcgtccacgaggccctccacaaccactacacccagaagtccctgagcctgtcccccggc

SEQ ID NO: 7920 - RNA, 1326 nt, synthetic construct
  misc_feature 1..1326: note = derived and/or modified sequence opt1 from Etrolizuab_HeavyChain2
  source 1..1326: mol_type = other RNA
gaggtgcagctggtcgagagcggcgggggcctcgtgcagcccgggggctccctgcgcctgagctgcgccgcctccgggttcttcatcaccaacaactactggggctgggtgcggcaggcgccgggcaaggggctcgagtgggtcggctacatcagctactccgggagcacctcctacaaccccagcaagctgtcccgcttcacgatcagccgggacacctccaagaacaccttctacctgcagaacagcctccgcgccgaggacaccgccgtgtactactgcgcccggacgggctccagcgggtacttcgacttctggggccagggcaccctggtgaccgtctccagcgcctccaccaaggggcccagcgtgttccccctggcgccgtccagcaagagcacgtccggcgggaccgccgccctcggctgcctggtgaaggactacttccccgagcccgtcaccgtgagctggaactccggcgccctgaccagcggggtgcacacgttccccgcggtcctccagtccagcggcctgtactccctgagctccgtggtgaccgtcccgagctccagcctcgggacccagacctacatctgcaacgtgaaccacaagccctccaacacgaaggtggacaagaaggtcgagcccaagagctgcgacaagacccacacgtgcccgccctgccccgcccccgagctgctgggcgggccctccgtgttcctcttcccgcccaagcccaaggacaccctgatcagccgcacccccgaggtgacctgcgtcgtggtggacgtctcccacgaggacccggaggtgaagttcaactggtacgtcgacggcgtggaggtgcacaacgccaagaccaagccccgggaggagcagtacaacagcacctaccgcgtcgtgtccgtgctgacggtcctccaccaggactggctgaacggcaaggagtacaagtgcaaggtgagcaacaaggccctgcccgcccccatcgagaagaccatcagcaaggcgaaggggcagccgcgggagccccaggtgtacaccctcccgccctcccgcgaggagaccaagaaccaggtcagcctgacgtgcctggtgaagggcttctacccctccgacatcgccgtggagtgggagagcaacgggcagcccgagaacaactacaagaccacgcccccggtcctcgactccgacggcagcttcttcctgtactccaagctgaccgtggacaagagccggtggcagcaggggaacgtgttctcctgcagcgtccacgaggccctccacaaccactacacccagaagtccctgagcctgtcccccggc

SEQ ID NO: 7921 - RNA, 639 nt, synthetic construct
  misc_feature 1..639: note = derived and/or modified sequence opt1 from Etrolizuab_LightChain1
  source 1..639: mol_type = other RNA
gacatccagacccagagcccctccagcctgtccgccagcgtgggcgaccgggtcaccatcacgtgccgggcctccgagagcgtggacgacctcctgcactggtaccagcagaagccggggaaggcgcccaagctgctcatcaagtacgcctcccagagcatctccggcgtgcccagccgcttctccgggagcggctccgggaccgacttcaccctgaccatcagctccctgcagcccgaggacttcgccacgtactactgccagcagggcaacagcctcccgaacaccttcggccaggggaccaaggtcgagatcaagcggaccgtggccgccccctccgtgttcatcttcccgcccagcgacgagcagctgaagtccggcacggcgagcgtcgtgtgcctgctcaacaacttctacccccgcgaggccaaggtgcagtggaaggtcgacaacgccctgcagagcgggaactcccaggagagcgtgaccgagcaggactccaaggacagcacctactccctgagctccaccctcacgctgagcaaggccgactacgagaagcacaaggtgtacgcgtgcgaggtcacccaccagggcctgtccagccccgtgaccaagtccttcaaccgcggggagtgc

SEQ ID NO: 7922 - RNA, 1338 nt, synthetic construct
  misc_feature 1..1338: note = derived and/or modified sequence opt1 from Etrolizumab_HeavyChain1
  source 1..1338: mol_type = other RNA
gaggtgcagctggtcgagagcggcgggggcctcgtgcagcccgggggctccctgcgcctgagctgcgccgcctccgggttcttcatcaccaacaactactggggctgggtgcggcaggcgccgggcaaggggctcgagtgggtcggctacatcagctactccgggagcacctcctacaaccccagcctgaagtcccgcttcacgatcagccgggacacctccaagaacaccttctacctgcagatgaacagcctccgcgccgaggacaccgccgtgtactactgcgcccggacgggctccagcgggtacttcgacttctggggccagggcaccctggtgaccgtctccagcgcctccaccaaggggcccagcgtgttccccctggcgccgtccagcaagagcacgtccggcgggaccgccgccctcggctgcctggtgaaggactacttccccgagcccgtcaccgtgagctggaactccggcgccctgaccagcggggtgcacacgttccccgcggtcctccagtccagcggcctgtactccctgagctccgtggtgaccgtcccgagctccagcctcgggacccagacctacatctgcaacgtgaaccacaagccctccaacacgaaggtggacaagaaggtcgagcccaagagctgcgacaagacccacacgtgcccgccctgccccgcccccgagctgctgggcgggccctccgtgttcctcttcccgcccaagcccaaggacaccctgatgatcagccgcacccccgaggtgacctgcgtcgtggtggacgtctcccacgaggacccggaggtgaagttcaactggtacgtcgacggcgtggaggtgcacaacgccaagaccaagccccgggaggagcagtacaacagcacctaccgcgtcgtgtccgtgctgacggtcctccaccaggactggctgaacggcaaggagtacaagtgcaaggtgagcaacaaggccctgcccgcccccatcgagaagaccatcagcaaggcgaaggggcagccgcgggagccccaggtgtacaccctcccgccctcccgcgaggagatgaccaagaaccaggtcagcctgacgtgcctggtgaagggcttctacccctccgacatcgccgtggagtgggagagcaacgggcagcccgagaacaactacaagaccacgcccccggtcctcgactccgacggcagcttcttcctgtactccaagctgaccgtggacaagagccggtggcagcaggggaacgtgttctcctgcagcgtcatgcacgaggccctccacaaccactacacccagaagtccctgagcctgtcccccggc

SEQ ID NO: 7923 - RNA, 642 nt, synthetic construct
  misc_feature 1..642: note = derived and/or modified sequence opt1 from Etrolizumab_LightChain1
  source 1..642: mol_type = other RNA
gacatccagatgacccagagcccctccagcctgtccgccagcgtgggcgaccgggtcaccatcacgtgccgggcctccgagagcgtggacgacctcctgcactggtaccagcagaagccggggaaggcgcccaagctgctcatcaagtacgcctcccagagcatctccggcgtgcccagccgcttctccgggagcggctccgggaccgacttcaccctgaccatcagctccctgcagcccgaggacttcgccacgtactactgccagcagggcaacagcctcccgaacaccttcggccaggggaccaaggtcgagatcaagcggaccgtggccgccccctccgtgttcatcttcccgcccagcgacgagcagctgaagtccggcacggcgagcgtcgtgtgcctgctcaacaacttctacccccgcgaggccaaggtgcagtggaaggtcgacaacgccctgcagagcgggaactcccaggagagcgtgaccgagcaggactccaaggacagcacctactccctgagctccaccctcacgctgagcaaggccgactacgagaagcacaaggtgtacgcgtgcgaggtcacccaccagggcctgtccagccccgtgaccaagtccttcaaccgcggggagtgc

SEQ ID NO: 7924 - RNA, 1359 nt, synthetic construct
  misc_feature 1..1359: note = derived and/or modified sequence opt1 from Evinacumab_HeavyChain1
  source 1..1359: mol_type = other RNA
gaggtgcagctggtcgagagcggcgggggcgtgatccagcccgggggctccctccgcctgagctgcgccgcctccgggttcaccttcgacgactacgcgatgaactgggtgcggcagggccccggcaaggggctggagtgggtcagcgccatctccggcgacgggggcagcacctactacgccgactccgtgaaggggcgcttcacgatcagccgggacaactccaagaacagcctctacctgcagatgaactccctgcgcgccgaggacaccgccttcttctactgcgcgaaggacctccggaacaccatcttcggcgtggtcatccccgacgccttcgacatctggggccaggggaccatggtgacggtgagctccgccagcaccaagggcccctccgtcttccccctggccccgtgcagccgctccaccagcgagtccaccgcggccctggggtgcctcgtgaaggactacttccccgagcccgtgacggtcagctggaacagcggcgccctgacctccggcgtgcacaccttccccgccgtgctgcagagctccgggctctacagcctgtccagcgtcgtgaccgtgccgtccagctccctgggcacgaagacctacacgtgcaacgtcgaccacaagcccagcaacaccaaggtggacaagcgggtggagtccaagtacgggccgccctgcccgccctgccccgcccccgagttcctcggcgggccgagcgtcttcctgttcccgcccaagcccaaggacaccctgatgatctcccgcacccccgaggtgacctgcgtggtcgtggacgtcagccaggaggaccccgaggtgcagttcaactggtacgtggacggcgtcgaggtgcacaacgcgaagaccaagccccgggaggagcagttcaactccacgtaccgcgtggtcagcgtgctcaccgtgctgcaccaggactggctgaacggcaaggagtacaagtgcaaggtctccaacaaggggctccccagctccatcgagaagaccatcagcaaggccaagggccagccgcgggagccccaggtgtacaccctgccgcccagccaggaggagatgacgaagaaccaggtgtccctgacctgcctcgtcaaggggttctaccccagcgacatcgccgtggagtgggagtccaacggccagcccgagaacaactacaagaccaccccgcccgtgctggacagcgacgggtccttcttcctgtacagccgcctcacggtcgacaagtcccggtggcaggagggcaacgtgttcagctgctccgtgatgcacgaggccctgcacaaccactacacccagaagtccctgagcctcagcctgggcaag

SEQ ID NO: 7925 - RNA, 642 nt, synthetic construct
  misc_feature 1..642: note = derived and/or modified sequence opt1 from Evinacumab_LightChain1
  source 1..642: mol_type = other RNA
gacatccagatgacccagagcccctccaccctgagcgcctccgtgggcgaccgcgtcacgatcacgtgccgggccagccagtccatccgcagctggctcgcgtggtaccagcagaagccggggaaggcccccaagctgctgatctacaaggcctccagcctcgagtccggcgtgcccagccggttctccgggagcggctccgggaccgagttcaccctgaccatcagctccctgcagcccgacgacttcgccacctactactgccagcagtacaacagctactcctacaccttcggccagggcaccaagctcgagatcaagcgcacggtggccgcgccgagcgtcttcatcttcccgccctccgacgagcagctcaagagcgggaccgccagcgtggtgtgcctgctgaacaacttctacccccgggaggccaaggtccagtggaaggtggacaacgccctgcagtccggcaacagccaggagtccgtgaccgagcaggacagcaaggactccacctacagcctgtccagcacgctcaccctgtccaaggcggactacgagaagcacaaggtctacgcctgcgaggtgacccaccaggggctgagctcccccgtgaccaagagcttcaaccgcggcgagtgc

SEQ ID NO: 7926 - RNA, 1323 nt, synthetic construct
  misc_feature 1..1323: note = derived and/or modified sequence opt1 from Evolocumab_HeavyChain1
  source 1..1323: mol_type = other RNA
gaggtgcagctggtccagagcggcgccgaggtgaagaagcccggggcctccgtgaaggtcagctgcaaggcgtccggctacaccctcaccagctacgggatctcctgggtgcgccaggccccgggccaggggctggagtggatgggctgggtgagcttctacaacggcaacacgaactacgcccagaagctgcaggggcggggcaccatgaccaccgacccctccacgagcaccgcctacatggagctccgctccctgcggagcgacgacaccgccgtctactactgcgcgcgcgggtacggcatggacgtgtgggggcagggcaccacggtgaccgtctccagcgcctccaccaagggccccagcgtgttccccctggccccgtgctcccggagcacctccgagagcacggccgcgctcgggtgcctggtgaaggactacttccccgagcccgtcaccgtgtcctggaacagcggcgccctgaccagcggggtgcacaccttccccgccgtcctccagtccagcggcctgtactccctgagctccgtggtgacggtcccgagctccaacttcggcacccagacctacacgtgcaacgtggaccacaagcccagcaacaccaaggtggacaagaccgtcgagcgcaagtgctgcgtggagtgcccgccctgccccgccccgcccgtggccgggccctccgtcttcctcttcccgcccaagcccaaggacaccctgatgatcagccggacccccgaggtgacgtgcgtcgtggtggacgtctcccacgaggaccccgaggtgcagttcaactggtacgtggacggcgtcgaggtgcacaacgcgaagaccaagccccgcgaggagcagttcaacagcaccttccgggtggtctccgtgctgaccgtggtccaccaggactggctcaacgggaaggagtacaagtgcaaggtgagcaacaagggcctgcccgcccccatcgagaagacgatctccaagaccaaggggcagccgcgcgagccccaggtgtacaccctgccgcccagccgggaggagatgaccaagaaccaggtctccctcacgtgcctggtgaagggcttctaccccagcgacatcgccgtggagtgggagtccaacggccagcccgagaacaactacaagaccacgcccccgatgctggacagcgacgggagcttcttcctctactccaagctgaccgtcgacaagagccgctggcagcagggcaacgtgttctcctgcagcgtgatgcacgaggccctgcacaaccactacacccagaagtccctcagcctgtcccccgggaag

SEQ ID NO: 7927 - RNA, 645 nt, synthetic construct
  misc_feature 1..645: note = derived and/or modified sequence opt1 from Evolocumab_LightChain1
  source 1..645: mol_type = other RNA
gagagcgccctgacccagcccgcctccgtgagcggctccccggggcagagcatcaccatctcctgcacgggcaccagctccgacgtcgggggctacaacagcgtgtcctggtaccagcagcaccccgggaaggcgcccaagctcatgatctacgaggtgagcaaccgcccctccggcgtcagcaaccggttctccggcagcaagtccgggaacaccgccagcctgaccatctccggcctgcaggccgaggacgaggccgactactactgcaacagctacacgtccaccagcatggtgttcgggggcgggaccaagctcaccgtgctgggccagccgaaggccgcgcccagcgtcacgctgttcccgccctccagcgaggagctccaggccaacaaggccaccctggtgtgcctgatctccgacttctaccccggcgccgtgaccgtcgcgtggaaggccgacagctcccccgtgaaggccggggtggagaccacgacccccagcaagcagtccaacaacaagtacgccgccagctcctacctcagcctgacccccgagcagtggaagtcccaccgcagctactcctgccaggtcacccacgagggcagcacggtggagaagaccgtggcgccgaccgagtgctcc

SEQ ID NO: 7928 - RNA, 1353 nt, synthetic construct
  misc_feature 1..1353: note = derived and/or modified sequence opt1 from Exbivirumab_HeavyChain1
  source 1..1353: mol_type = other RNA
caggtgcagctggtcgagagcggcgggggcgtggtgcagcccgggggctccctccgcctgagctgcgccccgtccgggttcgtcttccggagctacggcatgcactgggtgcgccagacccccggcaaggggctggagtgggtgtccctcatctggcacgacggcagcaaccggttctacgccgactccgtcaaggggcgcttcaccatcagccgggacaactccaagaacacgctgtacctgcagatgaacagcctccgcgcggaggacaccgccatgtacttctgcgcccgggagcgcctgatcgccgcccccgcggccttcgacctgtggggccaggggaccctcgtgaccgtgtccagcgcctccacgaagggccccagcgtcttcccgctggccccctccagcaagtccaccagcggcgggaccgcggccctgggctgcctcgtgaaggactacttccccgagcccgtgaccgtctcctggaacagcggggccctgacgagcggcgtgcacaccttcccggccgtgctgcagtccagcggcctctactccctgagctccgtcgtgaccgtgcccagctccagcctggggacccagacgtacatctgcaacgtcaaccacaagccctccaacaccaaggtggacaagcgggtggagcccaagagctgcgacaagacccacacgtgcccgccctgccccgcccccgagctcctgggcgggccgtccgtcttcctgttcccgcccaagcccaaggacaccctcatgatcagccgcacccccgaggtgacctgcgtggtcgtggacgtctcccacgaggaccccgaggtgaagttcaactggtacgtggacggcgtcgaggtgcacaacgcgaagaccaagccccgggaggagcagtacaacagcacgtaccgcgtggtctccgtgctgaccgtgctgcaccaggactggctcaacgggaaggagtacaagtgcaaggtcagcaacaaggccctgcccgccccgatcgagaagaccatctccaaggccaagggccagccccgggagccccaggtgtacaccctgcccccgagccgcgaggagatgacgaagaaccaggtgtccctgacctgcctcgtcaagggcttctaccccagcgacatcgccgtggagtgggagagcaacgggcagcccgagaacaactacaagaccaccccgcccgtgctggactccgacggcagcttcttcctctactccaagctgacggtcgacaagagccggtggcagcaggggaacgtgttctcctgcagcgtgatgcacgaggcgctgcacaaccactacacccagaagtccctcagcctgtcccccggcaag

SEQ ID NO: 7929 - RNA, 642 nt, synthetic construct
  misc_feature 1..642: note = derived and/or modified sequence opt1 from Exbivirumab_LightChain1
  source 1..642: mol_type = other RNA
agctacgtgctgacccagcccccgtccgtcagcgtggcccccggcaagaccgcccgcatctcctgcgggggcaacaacatcgggacgaagaacgtgcactggtaccagcagaagcccggccaggcgcccgtcctcgtggtgtacgccgacagcgaccggccgtccgggatccccgagcgcttcagcggctccaacagcggcaacaccgccaccctgaccatctcccgggtcgaggccggggacgaggccgactactactgccaggtgtgggacagcgtgtcctaccacgtcgtgttcggcgggggcacgaccctgaccgtgctcgggcagcccaaggcggcccccagcgtcaccctgttcccgccctccagcgaggagctgcaggccaacaaggccacgctcgtgtgcctgatctccgacttctaccccggcgcggtgaccgtcgcctggaaggccgacagctcccccgtgaaggccggcgtggagaccaccacgccgagcaagcagtccaacaacaagtacgccgcgagcagctacctgtccctcacccccgagcagtggaagtcccaccgcagctacagctgccaggtcacccacgaggggtccaccgtggagaagacggtggcccccaccgagtgcagc

SEQ ID NO: 7930 - RNA, 1347 nt, synthetic construct
  misc_feature 1..1347: note = derived and/or modified sequence opt1 from Farletuzumab_HeavyChain1
  source 1..1347: mol_type = other RNA
gaggtgcagctggtcgagagcggcgggggcgtggtgcagcccgggcgctccctccggctgagctgctccgccagcggcttcaccttctccgggtacggcctgagctgggtccgccaggcccccggcaaggggctcgagtgggtggcgatgatctccagcggcgggtcctacacctactacgccgacagcgtgaagggccggttcgccatctcccgcgacaacgccaagaacacgctgttcctgcagatggacagcctccggcccgaggacaccggggtctacttctgcgcccgccacggcgacgaccccgcgtggttcgcctactggggccaggggacccccgtgaccgtgtccagcgcctccacgaagggcccgagcgtcttccccctggccccctccagcaagtccaccagcgggggcaccgcggccctgggctgcctcgtgaaggactacttccccgagccggtgaccgtcagctggaactccggggccctgacgagcggcgtgcacaccttccccgccgtgctgcagtccagcgggctctactccctgagctccgtcgtgaccgtgcccagctccagcctgggcacccagacgtacatctgcaacgtcaaccacaagccctccaacaccaaggtggacaagaaggtggagcccaagagctgcgacaagacccacacgtgcccgccctgccccgccccggagctcctcgggggcccctccgtcttcctgttcccgcccaagcccaaggacaccctgatgatcagccggacccccgaggtgacctgcgtggtcgtggacgtctcccacgaggaccccgaggtgaagttcaactggtacgtggacggcgtcgaggtgcacaacgcgaagaccaagccccgcgaggagcagtacaacagcacgtaccgggtggtctccgtgctgaccgtgctgcaccaggactggctcaacgggaaggagtacaagtgcaaggtcagcaacaaggccctgccggcccccatcgagaagaccatctccaaggccaagggccagccccgcgagccccaggtgtacaccctgccgcccagccgggacgagctcacgaagaaccaggtgagcctgacctgcctggtcaaggggttctacccctccgacatcgccgtggagtgggagagcaacggccagccggagaacaactacaagaccaccccgcccgtgctcgactccgacgggagcttcttcctgtactccaagctgacggtcgacaagagccgctggcagcagggcaacgtgttctcctgcagcgtgatgcacgaggcgctccacaaccactacacccagaagtccctgagcctgtcccccggcaag

SEQ ID NO: 7931 - RNA, 651 nt, synthetic construct
  misc_feature 1..651: note = derived and/or modified sequence opt1 from Farletuzumab_LightChain1
  source 1..651: mol_type = other RNA
gacatccagctgacccagagcccctccagcctctccgccagcgtgggcgaccgcgtcaccatcacgtgctccgtgagctccagcatctccagcaacaacctgcactggtaccagcagaagccggggaaggcccccaagccctggatctacggcacctccaacctggcgagcggggtgccctcccggttcagcggctccgggagcggcaccgactacaccttcacgatctccagcctccagccggaggacatcgccacctactactgccagcagtggtccagctacccctacatgtacaccttcggccaggggaccaaggtcgagatcaagcgcacggtggccgcccccagcgtgttcatcttcccgccctccgacgagcagctcaagagcggcaccgcctccgtcgtgtgcctgctgaacaacttctacccccgggaggcgaaggtgcagtggaaggtcgacaacgccctgcagagcgggaactcccaggagagcgtgaccgagcaggactccaaggacagcacctactccctgagctccacgctcaccctgagcaaggccgactacgagaagcacaaggtgtacgcctgcgaggtcacccaccagggcctgtccagccccgtgaccaagtccttcaaccgcggggagtgc

SEQ ID NO: 7932 - RNA, 1338 nt, synthetic construct
  misc_feature 1..1338: note = derived and/or modified sequence opt1 from Fasinumab_HeavyChain1
  source 1..1338: mol_type = other RNA
caggtgcagctggtccagagcggcgccgaggtgaagaagcccggggcctccgtgaaggtcagctgcaaggtgtccggcttcaccctcaccgagctgagcatccactgggtgcgccaggcgcccgggaagggcctggagtggatgggcgggttcgaccccgaggacggcgagacgatctacgcccagaagttccaggggcgggtcaccatgaccgaggacacctccacggacaccgcctacatggagctcaccagcctgcgctccgaggacaccgccgtgtactactgcagcacgatcttcggcgtggtcaccaacttcgacaactgggggcagggcaccctggtgaccgtgtccagcgcctccacgaaggggcccagcgtcttccccctcgcgccgtgctcccggagcacctccgagagcaccgccgccctgggctgcctggtgaaggactacttccccgagcccgtgaccgtctcctggaacagcggcgccctcacgtccggggtgcacaccttccccgcggtgctgcagagcagcggcctgtactccctcagctccgtcgtgaccgtgccgagctccagcctggggaccaagacgtacacgtgcaacgtcgaccacaagccctccaacaccaaggtggacaagcgcgtggagagcaagtacggcccgccctgcccgccctgccccgcccccgagttcctgggcgggccgtccgtcttcctcttcccgcccaagcccaaggacaccctgatgatcagccggacccccgaggtgacctgcgtcgtggtggacgtctcccaggaggaccccgaggtgcagttcaactggtacgtggacggcgtcgaggtgcacaacgccaagaccaagccccgcgaggagcagttcaacagcacctaccgggtggtctccgtgctgacggtgctccaccaggactggctgaacgggaaggagtacaagtgcaaggtcagcaacaagggcctgccctccagcatcgagaagaccatctccaaggccaaggggcagccgcgcgagccccaggtgtacaccctcccgcccagccaggaggagatgaccaagaaccaggtgtccctgacgtgcctggtcaagggcttctaccccagcgacatcgccgtggagtgggagagcaacggccagcccgagaacaactacaagaccaccccgcccgtgctcgactccgacgggagcttcttcctgtactcccggctgaccgtcgacaagagccgctggcaggagggcaacgtgttctcctgcagcgtgatgcacgaggcgctccacaaccactacacgcagaagtccctgagcctgtccctcgggaag

SEQ ID NO: 7933 - RNA, 642 nt, synthetic construct
  misc_feature 1..642: note = derived and/or modified sequence opt1 from Fasinumab_LightChain1
  source 1..642: mol_type = other RNA
gacatccagatgacccagagcccctccagcctgtccgccagcgccggcgaccgcgtgaccatcacgtgccgggcgtcccaggccatccgcaacgacctcgggtggtaccagcagaagccgggcaaggcccccaagcggctgatctacgccgccttcaacctgcagagcggggtcccctcccgcttcagcggctccgggagcggcaccgagttcaccctcaccatctccagcctgcagcccgaggacctggcgtcctactactgccagcagtacaaccggtacccgtggacgttcggccaggggaccaaggtggagatcaagcgcaccgtggccgcccccagcgtcttcatcttcccgccctccgacgagcagctcaagagcggcaccgcctccgtggtgtgcctgctgaacaacttctacccccgggaggcgaaggtccagtggaaggtggacaacgccctccagagcgggaactcccaggagagcgtgacggagcaggacagcaaggactccacctacagcctgtccagcaccctgaccctctccaaggccgactacgagaagcacaaggtctacgcctgcgaggtgacgcaccagggcctgagctcccccgtgaccaagagcttcaaccgcggggagtgc

SEQ ID NO: 7934 - RNA, 1350 nt, synthetic construct
  misc_feature 1..1350: note = derived and/or modified sequence opt1 from Fezakinumab_HeavyChain1
  source 1..1350: mol_type = other RNA
caggtgcagctggtccagagcggcgccgaggtgaagaagcccggggcctccgtgaaggtcagctgcaaggcgtccggctacaccttcaccaactactacatgcactgggtgcgccaggccccggggcagggcctcgagtgggtggggtggatcaacccctacacgggcagcgccttctacgcccagaagttccggggccgcgtcaccatgacccgggacacctccatcagcacggcctacatggagctgtcccgcctgcggagcgacgacaccgcggtgtactactgcgcccgcgagcccgagaagttcgactccgacgacagcgacgtgtgggggcggggcaccctcgtcaccgtgtccagcgcctccacgaaggggcccagcgtgttcccgctggccccctccagcaagtccaccagcggcgggaccgcggccctgggctgcctcgtcaaggactacttccccgagcccgtgaccgtgtcctggaacagcggcgccctgacgagcggggtccacaccttcccggccgtgctgcagtccagcggcctctactccctgagctccgtggtcaccgtgcccagctccagcctggggacccagacgtacatctgcaacgtgaaccacaagccctccaacaccaaggtcgacaagaaggtggagcccaagagctgcgacaagacccacacgtgcccgccctgccccgcccccgagctcctgggcggcccgtccgtgttcctgttcccgcccaagcccaaggacaccctcatgatcagccgcacccccgaggtgacctgcgtcgtcgtggacgtgtcccacgaggaccccgaggtcaagttcaactggtacgtggacggggtggaggtccacaacgcgaagaccaagccccgggaggagcagtacaacagcacgtaccgcgtggtgtccgtcctgaccgtgctgcaccaggactggctcaacggcaaggagtacaagtgcaaggtgagcaacaaggccctgcccgccccgatcgagaagaccatctccaaggccaaggggcagccccgggagccccaggtctacaccctgcccccgagccgcgaggagatgacgaagaaccaggtgtccctgacctgcctcgtgaagggcttctaccccagcgacatcgccgtcgagtgggagagcaacgggcagcccgagaacaactacaagaccaccccgcccgtgctggactccgacggcagcttcttcctctactccaagctgacggtggacaagagccggtggcagcagggcaacgtcttctcctgcagcgtgatgcacgaggcgctgcacaaccactacacccagaagtccctcagcctgtcccccggg

SEQ ID NO: 7935 - RNA, 651 nt, synthetic construct
  misc_feature 1..651: note = derived and/or modified sequence opt1 from Fezakinumab_LightChain1
  source 1..651: mol_type = other RNA
caggccgtgctgacccagcccccgagcgtctccggcgcccccgggcagcgcgtgaccatcagctgcacgggctccagctccaacatcggggcgggctacggggtgcactggtaccagcagctccccggcaccgcccccaagctgctgatctacggcgacagcaaccggccgtccggggtccccgaccgcttcagcggctccaagagcgggacctccgccagcctcgccatcaccggcctgcaggccgaggacgaggcggactactactgccagtcctacgacaacagcctgtccgggtacgtgttcggcggcgggacgcagctcaccgtgctgggccagcccaaggccgcccccagcgtcaccctgttcccgccctccagcgaggagctccaggccaacaaggcgaccctggtgtgcctgatctccgacttctaccccggggccgtgacggtcgcctggaaggccgacagcagccccgtgaaggccggcgtggagaccaccaccccgtccaagcagagcaacaacaagtacgcggcctccagctacctctccctgacgcccgagcagtggaagtcccaccggagctacagctgccaggtcacccacgagggctccaccgtggagaagaccgtggcccccacggagtgcagc

SEQ ID NO: 7936 - RNA, 1347 nt, synthetic construct
  misc_feature 1..1347: note = derived and/or modified sequence opt1 from FG-3019_HeavyChain1
  source 1..1347: mol_type = other RNA
gagggccagctggtgcagagcgggggcgggctcgtccaccccggcgggtccctgcgcctgagctgcgccggctccggcttcaccttcagctcctacgggatgcactgggtgcggcaggccccgggcaaggggctcgagtgggtgagcggcatcgggaccggcggcgggacgtactccaccgacagcgtcaagggccgcttcaccatctcccgggacaacgcgaagaacagcctgtacctgcagatgaactccctccgcgccgaggacatggccgtgtactactgcgcccgcggggactactacggcagcggctccttcttcgactgctgggggcagggcaccctggtgacggtcagctccgccagcaccaaggggccctccgtgttccccctggcgcccagctccaagagcaccagcggcgggaccgccgccctcggctgcctggtgaaggactacttcccggagcccgtcacggtgtcctggaacagcggcgccctgacctccggggtgcacaccttccccgcggtcctccagagctccggcctgtacagcctgtccagcgtggtgaccgtcccctccagctccctcgggacgcagacctacatctgcaacgtgaaccacaagccgagcaacaccaaggtggacaagcgggtcgagcccaagtcctgcgacaagacccacacgtgcccgccctgcccggcccccgagctgctgggcgggcccagcgtgttcctcttcccgcccaagcccaaggacaccctgatgatctcccggacccccgaggtgacctgcgtcgtggtggacgtcagccacgaggaccccgaggtgaagttcaactggtacgtcgacggcgtggaggtgcacaacgccaagacgaagccgcgcgaggagcagtacaactccacctaccgggtcgtgagcgtgctgaccgtcctccaccaggactggctgaacggcaaggagtacaagtgcaaggtgtccaacaaggccctgcccgcccccatcgagaagaccatcagcaaggcgaaggggcagccccgcgagccccaggtgtacacgctcccgcccagccgggaggagatgaccaagaaccaggtctccctgacctgcctggtgaagggcttctaccccagcgacatcgccgtggagtgggagtccaacgggcagcccgagaacaactacaagaccacgccgcccgtcctcgacagcgacggctccttcttcctgtacagcaagctgaccgtggacaagtcccgctggcagcaggggaacgtgttcagctgctccgtcatgcacgaggccctccacaaccactacacccagaagtccctgagcctgagccccggc

SEQ ID NO: 7937 - RNA, 642 nt, synthetic construct
  misc_feature 1..642: note = derived and/or modified sequence opt1 from FG-3019_LightChain1
  source 1..642: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccgcctccagcctgcagtccggcgtgcccagccgcttctccgggagcggctccgggaccgacttcaccctcaccatcagctccctgcagcccgaggacttcgccacgtactactgccagcagtacaacagctacccgcccaccttcggccagggcaccaagctggagatcaagcggaccgtggcggccccctccgtcttcatcttcccgcccagcgacgagcagctcaagagcgggacggcctccgtggtgtgcctgctgaacaacttctacccccgcgaggccaaggtccagtggaaggtggacaacgcgctccagagcggcaactcccaggagagcgtgaccgagcaggactccaaggacagcacctactccctgagctccaccctgacgctcagcaaggccgactacgagaagcacaaggtctacgcctgcgaggtgacccaccaggggctgtccagccccgtgaccaagtccttcaaccggggcgagtgc

SEQ ID NO: 7938 - RNA, 1344 nt, synthetic construct
  misc_feature 1..1344: note = derived and/or modified sequence opt1 from Fibatuzumab_HeavyChain1
  source 1..1344: mol_type = other RNA
caggtgcagctggtccagagcggcgccgaggtgaagaagcccggggcctccgtgaaggtcagctgcaaggcgtccggctacaccttcaccgggtactggatgaactgggtgcgccaggccccgggccaggggctcgagtggatgggcgacatctaccccggcagcgggaacacgaactacgacgagaagttccagggccgggtgaccatgacccgcgacacctccatcagcacggcctacatggagctgtcccggctgcgcagcgacgacaccgccgtctactactgcgcccgcgggggctactacgaggacttcgactcctgggggcagggcaccaccgtgacggtgagctccgcgagcaccaagggcccctccgtcttccccctcgccccgagctccaagagcacctccgggggcaccgccgccctggggtgcctggtgaaggactacttccccgagcccgtgacggtcagctggaactccggcgcgctcaccagcggcgtgcacaccttccccgccgtgctgcagagctccgggctgtacagcctctccagcgtcgtgaccgtgccgtccagctccctgggcacgcagacctacatctgcaacgtcaaccacaagcccagcaacaccaaggtggacaagcgggtggagcccaagtcctgcgacaagacccacacgtgcccgccctgccccgcccccgagctgctcgggggccccagcgtcttcctgttcccgcccaagcccaaggacaccctgatgatctcccggacccccgaggtgacctgcgtggtcgtggacgtcagccacgaggacccggaggtgaagttcaactggtacgtggacggggtcgaggtgcacaacgccaagacgaagccccgcgaggagcagtacaactccacctaccgggtggtcagcgtgctcaccgtgctgcaccaggactggctgaacggcaaggagtacaagtgcaaggtctccaacaaggccctccccgcgcccatcgagaagaccatcagcaaggccaagggccagccgcgcgagccccaggtgtacacgctgccgccctcccgggaggagatgaccaagaaccaggtgagcctgacctgcctcgtcaaggggttctacccctccgacatcgccgtggagtgggagagcaacggccagcccgagaacaactacaagaccacgcccccggtgctggacagcgacgggtccttcttcctgtacagcaagctcaccgtcgacaagtcccgctggcagcagggcaacgtgttcagctgctccgtgatgcacgaggccctgcacaaccactacacccagaagtccctgagcctcagccccgggaag

SEQ ID NO: 7939 - RNA, 642 nt, synthetic construct
  misc_feature 1..642: note = derived and/or modified sequence opt1 from Fibatuzumab_LightChain1
  source 1..642: mol_type = other RNA
gacatccagatgacccagagcccctccttcctgagcgcctccgtgggcgaccgcgtcaccatcacgtgccgggccagccaggggatcatctcctacctcgcgtggtaccagcagaagccggagaaggcccccaagcgcctgatctacgccgccagctccctgcagagcggcgtgccctcccggttcagcgggtccggcagcgggaccgagttcaccctcaccatctccagcctgcagcccgaggacttcgccacgtactactgcggccagtacgcgaactacccgtacaccttcggccaggggaccaagctggagatcaagcgcaccgtggccgccccctccgtcttcatcttcccgcccagcgacgagcagctcaagtccggcacggccagcgtggtgtgcctgctgaacaacttctacccccgggaggcgaaggtccagtggaaggtggacaacgccctccagtccgggaacagccaggagagcgtgaccgagcaggactccaaggacagcacctactccctgagctccaccctgacgctcagcaaggccgactacgagaagcacaaggtctacgcctgcgaggtgacccaccagggcctgtccagccccgtgaccaagtccttcaaccgcggggagtgc

SEQ ID NO: 7940 - RNA, 1344 nt, synthetic construct
  misc_feature 1..1344: note = derived and/or modified sequence opt1 from Ficlatuzumab_HeavyChain1
  source 1..1344: mol_type = other RNA
caggtgcagctggtccagcccggcgccgaggtgaagaagccggggaccagcgtgaagctctcctgcaaggccagcggctacaccttcacgacctactggatgcactgggtccgccaggcgcccgggcagggcctggagtggatcggggagatcaaccccaccaacggccacaccaactacaaccagaagttccagggccgggccacgctgaccgtggacaagtccaccagcaccgcctacatggagctctccagcctgcgctccgaggacacggccgtgtactactgcgcccggaactacgtcgggagcatcttcgactactggggccaggggaccctgctcaccgtgtccagcgcgtccaccaagggccccagcgtgttcccgctggccccctccagcaagtccacgagcgggggcaccgccgccctgggctgcctcgtcaaggactacttccccgagcccgtgaccgtgtcctggaacagcggggcgctgacctccggcgtccacacgttcccggccgtgctgcagagcagcgggctctactccctgagctccgtggtcaccgtgcccagctccagcctgggcacccagacctacatctgcaacgtgaaccacaagccctccaacacgaaggtcgacaagcgcgtggagcccaagagctgcgacaagacccacacgtgcccgccctgccccgcccccgagctcctgggcgggccgtccgtgttcctgttcccgcccaagcccaaggacaccctcatgatcagccggacccccgaggtgacctgcgtcgtggtcgacgtgtcccacgaggaccccgaggtcaagttcaactggtacgtggacggcgtggaggtccacaacgccaagaccaagccccgcgaggagcagtacaacagcacctaccgggtggtgtccgtcctgacggtgctgcaccaggactggctcaacgggaaggagtacaagtgcaaggtgagcaacaaggccctgcccgcgccgatcgagaagaccatctccaaggccaagggccagccccgcgagccccaggtctacaccctgcccccgagccgggaggagatgaccaagaaccaggtgtccctcacgtgcctggtgaaggggttctaccccagcgacatcgccgtcgagtgggagtccaacggccagcccgagaacaactacaagaccaccccgcccgtgctggacagcgacggcagcttcttcctctactccaagctgaccgtggacaagagccgctggcagcaggggaacgtcttctcctgcagcgtgatgcacgaggccctgcacaaccactacacgcagaagtccctcagcctgtcccccggcaag

SEQ ID NO: 7941 - RNA, 1341 nt, synthetic construct
  misc_feature 1..1341: note = derived and/or modified sequence opt1 from Ficlatuzumab_HeavyChain
  source 1..1341: mol_type = other RNA
gtgcagctggtccagcccggcgccgaggtgaagaagccggggaccagcgtgaagctctcctgcaaggccagcggctacaccttcacgacctactggatgcactgggtccgccaggcgcccgggcagggcctggagtggatcggggagatcaaccccaccaacggccacaccaactacaaccagaagttccagggccgggccacgctgaccgtggacaagtccaccagcaccgcctacatggagctctccagcctgcgctccgaggacacggccgtgtactactgcgcccggaactacgtcgggagcatcttcgactactggggccaggggaccctgctcaccgtgtccagcgcgtccaccaagggccccagcgtgttcccgctggccccctccagcaagtccacgagcgggggcaccgccgccctgggctgcctcgtcaaggactacttccccgagcccgtgaccgtgtcctggaacagcggggcgctgacctccggcgtccacacgttcccggccgtgctgcagagcagcgggctctactccctgagctccgtggtcaccgtgcccagctccagcctgggcacccagacctacatctgcaacgtgaaccacaagccctccaacacgaaggtcgacaagcgcgtggagcccaagagctgcgacaagacccacacgtgcccgccctgccccgcccccgagctcctgggcgggccgtccgtgttcctgttcccgcccaagcccaaggacaccctcatgatcagccggacccccgaggtgacctgcgtcgtggtcgacgtgtcccacgaggaccccgaggtcaagttcaactggtacgtggacggcgtggaggtccacaacgccaagaccaagccccgcgaggagcagtacaacagcacctaccgggtggtgtccgtcctgacggtgctgcaccaggactggctcaacgggaaggagtacaagtgcaaggtgagcaacaaggccctgcccgcgccgatcgagaagaccatctccaaggccaagggccagccccgcgagccccaggtctacaccctgcccccgagccgggaggagatgaccaagaaccaggtgtccctcacgtgcctggtgaaggggttctaccccagcgacatcgccgtcgagtgggagtccaacggccagcccgagaacaactacaagaccaccccgcccgtgctggacagcgacggcagcttcttcctctactccaagctgaccgtggacaagagccgctggcagcaggggaacgtcttctcctgcagcgtgatgcacgaggccctgcacaaccactacacgcagaagtccctcagcctgtcccccggcaag

SEQ ID NO: 7942 - RNA, 642 nt, synthetic construct
  misc_feature 1..642: note = derived and/or modified sequence opt1 from Ficlatuzumab_LightChain1
  source 1..642: mol_type = other RNA
gacatcgtgatgacccagagccccgactccctggccatgagcctcggcgagcgggtcaccctgaactgcaaggcctccgagaacgtggtgagctacgtctcctggtaccagcagaagccggggcagagccccaagctgctcatctacggcgcgtccaaccgggagagcggggtgcccgaccgcttctccggcagcgggtccgccacggacttcaccctgaccatcagctccgtgcaggccgaggacgtcgccgactaccactgcggccagagctacaactacccctacaccttcggccaggggacgaagctggagatcaagcggaccgtggccgcgccgtccgtgttcatcttcccgcccagcgacgagcagctcaagtccggcaccgccagcgtcgtgtgcctgctgaacaacttctacccccgcgaggccaaggtgcagtggaaggtcgacaacgccctccagtccgggaacagccaggagagcgtgaccgagcaggactccaaggacagcacgtactccctgagctccaccctgaccctcagcaaggcggactacgagaagcacaaggtgtacgcctgcgaggtcacccaccagggcctgtccagccccgtgacgaagtccttcaaccgcggggagtgc

SEQ ID NO: 7943 - RNA, 1350 nt, synthetic construct
  misc_feature 1..1350: note = derived and/or modified sequence opt1 from Figitumumab_HeavyChain1
  source 1..1350: mol_type = other RNA
gaggtgcagctgctcgagagcggcgggggcctggtccagcccgggggctccctgcgcctcagctgcaccgcctccgggttcaccttcagctcctacgccatgaactgggtgcggcaggcgccgggcaagggcctggagtgggtgagcgccatctccgggagcggcgggacgaccttctacgccgactccgtcaagggccgcttcaccatcagccgggacaactcccgcaccacgctgtacctccagatgaacagcctgcgggccgaggacaccgccgtgtactactgcgcgaaggacctggggtggtccgacagctactactactactacggcatggacgtgtggggccaggggaccaccgtcacggtgtccagcgcctccaccaagggccccagcgtgttccccctcgccccctgctcccgcagcaccagcgagtccaccgccgcgctggggtgcctggtcaaggactacttcccggagcccgtgacggtgagctggaactccggcgccctcaccagcggcgtccacaccttccccgccgtgctgcagtccagcgggctgtactccctcagctccgtggtcaccgtgcccagctccaacttcggcacgcagacctacacgtgcaacgtggaccacaagccgagcaacaccaaggtcgacaagaccgtggagcggaagtgctgcgtggagtgcccgccctgccccgccccgcccgtcgccgggccctccgtgttcctgttcccgcccaagcccaaggacaccctgatgatcagccgcacccccgaggtgacctgcgtcgtggtcgacgtgtcccacgaggaccccgaggtgcagttcaactggtacgtcgacggcgtggaggtgcacaacgcgaagacgaagccccgggaggagcagttcaacagcaccttccgcgtcgtgtccgtgctcaccgtcgtgcaccaggactggctgaacgggaaggagtacaagtgcaaggtgagcaacaagggcctgcccgcccccatcgagaagaccatctccaagacgaagggccagccccgggagccgcaggtctacaccctcccgcccagccgcgaggagatgaccaagaaccaggtgagcctgacctgcctggtgaaggggttctacccctccgacatcgccgtcgagtgggagagcaacggccagcccgagaacaactacaagacgaccccgcccatgctcgactccgacgggagcttcttcctgtactccaagctgaccgtggacaagagccggtggcagcagggcaacgtgttctcctgcagcgtcatgcacgaggccctccacaaccactacacccagaagtccctgagcctgtcccccggg

SEQ ID NO: 7944 - RNA, 642 nt, synthetic construct
  misc_feature 1..642: note = derived and/or modified sequence opt1 from Figitumumab_LightChain1
  source 1..642: mol_type = other RNA
gacatccagatgacccagttccccagctccctgagcgcctccgtgggcgaccgcgtcaccatcacgtgccgggccagccaggggatccgcaacgacctcggctggtaccagcagaagccggggaaggcgcccaagcggctgatctacgccgcctcccgcctgcaccggggcgtgcccagccgcttctccgggagcggctccggcaccgagttcaccctcaccatcagctccctgcagcccgaggacttcgccacgtactactgcctgcagcacaacagctacccgtgctccttcgggcagggcaccaagctcgagatcaagcggaccgtggccgcgcccagcgtcttcatcttcccgccctccgacgagcagctcaagagcgggaccgcctccgtggtgtgcctgctgaacaacttctacccccgcgaggccaaggtccagtggaaggtggacaacgccctgcagagcggcaactcccaggagagcgtgacggagcaggacagcaaggactccacctacagcctgtccagcaccctcaccctgtccaaggcggactacgagaagcacaaggtctacgcctgcgaggtgacgcaccaggggctgagctcccccgtgaccaagagcttcaaccggggcgagtgc

SEQ ID NO: 7945 - RNA, 1359 nt, synthetic construct
  misc_feature 1..1359: note = derived and/or modified sequence opt1 from Firivumab_HeavyChain1
  source 1..1359: mol_type = other RNA
caggtgcagctggtccagagcggcgccgaggtgaagatgcccgggtccagcgtgaaggtctcctgcaagaccagcggcgtgttcttctccagccacgccatctcctgggtgcgccaggcgcccgggcagggcctcgagtggatgggcgggatcagccccatgttcggcaccacgcactacgcccagaagttccaggggcgggtcaccatcaccgccgaccagtccaccacgaccgcctacatggagctgaccagcctgacctccgaggacacggccgtgtactactgcgcgcgcgacggcgccgggagctactaccccctcaactggttcgacccctggggccaggggaccctggtgaccgtctccagcgcctccaccaagggcccgagcgtgttccccctggccccctccagcaagtccacgagcggcgggaccgcggccctcggctgcctggtgaaggactacttccccgagccggtcaccgtgagctggaactccggggccctgaccagcggcgtgcacacgttccccgccgtcctccagtccagcggcctgtactccctgagctccgtggtgaccgtccccagctccagcctcgggacccagacctacatctgcaacgtgaaccacaagccctccaacacgaaggtggacaagcgggtcgagcccaagagctgcgacaagacccacacgtgcccgccctgccccgccccggagctgctgggcgggccctccgtgttcctcttcccgcccaagcccaaggacaccctgatgatcagccgcacccccgaggtgacctgcgtcgtggtcgacgtgtcccacgaggaccccgaggtgaagttcaactggtacgtcgacggcgtggaggtgcacaacgcgaagaccaagccccgggaggagcagtacaacagcacctaccgcgtcgtgtccgtgctgacggtcctccaccaggactggctgaacgggaaggagtacaagtgcaaggtgagcaacaaggccctgccggcccccatcgagaagaccatctccaaggccaagggccagccccgggagccccaggtgtacaccctcccgcccagccgcgacgagctgaccaagaaccaggtcagcctgacgtgcctcgtgaagggcttctacccctccgacatcgccgtggagtgggagagcaacgggcagccggagaacaactacaagaccaccccgcccgtcctggactccgacggcagcttcttcctgtactccaagctcaccgtggacaagagccggtggcagcaggggaacgtgttctcctgcagcgtcatgcacgagggcctgcacaaccactacacgcagaagtccctgagcctctcccccgggaag

SEQ ID NO: 7946 - RNA, 642 nt, synthetic construct
  misc_feature 1..642: note = derived and/or modified sequence opt1 from Firivumab_LightChain1
  source 1..642: mol_type = other RNA
gagatcgtgctgacccagagccccgccaccctctccctgagcccgggcgagcgggccacgctgtcctgccgggcgagcgagaacatctggaacaacctcgcctggtaccagcagaagcccgggcaggcgccccgcctgctgatctccggcgccagcaccggggccaccggcgtcccctcccggttccgcgggagcggctcccggaccgagttcacgctcaccatcagctccctgcagagcgaggacttcgccatctacttctgccagcagtacaactcctggccgcgcaccttcggccccgggaccaaggtggagatcaagcggacggtggccgcccccagcgtcttcatcttcccgccctccgacgagcagctcaagagcggcaccgcctccgtggtgtgcctgctgaacaacttctacccccgcgaggcgaaggtccagtggaaggtggacaacgccctgcagagcgggaactcccaggagagcgtgaccgagcaggacagcaaggactccacctacagcctctccagcacgctgaccctgtccaaggccgactacgagaagcacaaggtctacgcctgcgaggtgacccaccagggcctcagctcccccgtgaccaagagcttcaaccgcggggagtgc

SEQ ID NO: 7947 - RNA, 1347 nt, synthetic construct
  misc_feature 1..1347: note = derived and/or modified sequence opt1 from Flanvotumab_HeavyChain1
  source 1..1347: mol_type = other RNA
caggtgcagctggtccagagcggctccgagctcaagaagcccggggccagcgtgaagatctcctgcaaggccagcggctacaccttcacctcctacgcgatgaactgggtgcgccaggccccggggcagggcctggagagcatggggtggatcaacacgaacaccggcaaccccacctacgcccagggcttcaccgggcggttcgtcttctccatggacacgagcgtgtccaccgcctacctgcagatcagctccctcaaggccgaggacaccgcgatctactactgcgcgccccgctacagctccagctggtacctggactactggggccaggggaccctggtgacggtctccagcgcctccaccaagggccccagcgtgttcccgctcgccccctccagcaagagcacctccgggggcaccgccgccctgggctgcctggtgaaggactacttccccgagcccgtcacggtgagctggaactccggggccctcaccagcggcgtgcacaccttcccggccgtcctgcagtccagcgggctgtactccctcagctccgtggtgaccgtccccagctccagcctgggcacgcagacctacatctgcaacgtgaaccacaagccctccaacaccaaggtggacaagcgggtcgagcccaagagctgcgacaagacccacacgtgcccgccctgccccgcccccgagctgctcggcgggccgtccgtgttcctgttcccgcccaagcccaaggacaccctgatgatcagccgcacccccgaggtgacctgcgtcgtggtggacgtctcccacgaggaccccgaggtgaagttcaactggtacgtcgacggcgtggaggtgcacaacgcgaagacgaagccccgggaggagcagtacaacagcacctaccgcgtcgtgtccgtgctcaccgtcctgcaccaggactggctgaacgggaaggagtacaagtgcaaggtgagcaacaaggccctccccgccccgatcgagaagaccatcagcaaggccaagggccagccccgggagccccaggtgtacacgctgcccccgtcccgcgaggagatgaccaagaaccaggtcagcctgacctgcctcgtgaaggggttctacccctccgacatcgccgtggagtgggagagcaacggccagcccgagaacaactacaagaccacgccgcccgtcctggactccgacggcagcttcttcctgtactccaagctcaccgtggacaagagccggtggcagcaggggaacgtgttctcctgcagcgtcatgcacgaggcgctgcacaaccactacacccagaagtccctgagcctctcccccggcaag

SEQ ID NO: 7948 - RNA, 645 nt, synthetic construct
  misc_feature 1..645: note = derived and/or modified sequence opt1 from Flanvotumab_LightChain1
  source 1..645: mol_type = other RNA
gagatcgtgctgacccagagccccgccaccctctccctgagcccgggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggctgatgtacaccttcggccagggcaccaagctcgagatcaagcgcaccgtggccgccccctccgtcttcatcttcccgcccagcgacgagcagctgaagtccgggacggcgagcgtggtgtgcctgctcaacaacttctacccccgggaggccaaggtccagtggaaggtggacaacgccctgcagtccggcaacagccaggagagcgtgaccgagcaggactccaaggacagcacctactccctgagctccaccctcacgctgagcaaggccgactacgagaagcacaaggtctacgcctgcgaggtgacccaccaggggctgtccagccccgtgaccaagtccttcaaccgcggcgagtgc

SEQ ID NO: 7949 - RNA, 1362 nt, synthetic construct
  misc_feature 1..1362: note = derived and/or modified sequence opt1 from Fletikumab_HeavyChain1
  source 1..1362: mol_type = other RNA
caggtgcagctggtccagagcggcgccgaggtgaagcgccccggggcctccgtgaaggtcagctgcaaggcgtccggctacaccttcaccaacgacatcatccactgggtgcggcaggccccggggcagcgcctcgagtggatgggctggatcaacgccgggtacggcaacacgcagtacagccagaacttccaggaccgggtgtccatcacccgcgacaccagcgcctccaccgcctacatggagctgatcagcctgcggtccgaggacacggcggtctactactgcgcccgcgagcccctctggttcggcgagagcagcccccacgactactacgggatggacgtgtggggccaggggaccaccgtgaccgtcagctccgccagcacgaagggcccctccgtgttcccgctggccccctgcagccggtccaccagcgagtccaccgcggccctggggtgcctcgtgaaggactacttccccgagcccgtcaccgtgagctggaacagcggcgccctgacgtccggcgtgcacaccttcccggccgtcctgcagagctccgggctctacagcctgtccagcgtggtgaccgtcccctccagctccctgggcaccaagacgtacacgtgcaacgtggaccacaagcccagcaacaccaaggtggacaagcgcgtcgagtccaagtacgggcccccgtgcccgccctgccccgcccccgagttcctcggcggccccagcgtgttcctgttcccgcccaagcccaaggacaccctgatgatctcccggacccccgaggtgacctgcgtcgtggtcgacgtgagccaggaggaccccgaggtgcagttcaactggtacgtcgacggggtggaggtgcacaacgcgaagaccaagccccgcgaggagcagttcaactccacctaccgggtcgtgagcgtgctcacggtcctgcaccaggactggctgaacggcaaggagtacaagtgcaaggtgtccaacaaggggctcccgagctccatcgagaagaccatcagcaaggccaagggccagccccgcgagccccaggtgtacaccctgcccccgagccaggaggagatgaccaagaaccaggtctccctgacgtgcctcgtgaaggggttctaccccagcgacatcgccgtggagtgggagtccaacggccagcccgagaacaactacaagaccaccccgcccgtcctggacagcgacggctccttcttcctgtacagccggctcaccgtggacaagtcccgctggcaggaggggaacgtgttcagctgctccgtcatgcacgaggccctgcacaaccactacacgcagaagtccctgtccctcagcctgggcaag

SEQ ID NO: 7950 - RNA, 642 nt, synthetic construct
  misc_feature 1..642: note = derived and/or modified sequence opt1 from Fletikumab_LightChain1
  source 1..642: mol_type = other RNA
gccatccagctgacccagagcccctccagcctctccgccagcgtgggcgaccgcgtcaccatcacgtgccgggcgtcccaggggatcagctccgccctggcctggtaccagcagaagccgggcaaggcccccaagctgctcatctacgacgccagctccctggagagcggggtgccctcccgcttcagcggctccgggagcggcaccgacttcaccctgaccatctccagcctccagcccgaggacttcgcgacgtactactgccagcagttcaactcctacccgctgaccttcggcgggggcaccaaggtggagatcaagcggaccgtcgccgcccccagcgtgttcatcttcccgccctccgacgagcagctcaagagcgggacggccagcgtggtctgcctgctgaacaacttctacccccgcgaggcgaaggtgcagtggaaggtggacaacgccctgcagtccggcaacagccaggagtccgtcaccgagcaggacagcaaggactccacctacagcctctccagcaccctgacgctgtccaaggccgactacgagaagcacaaggtgtacgcctgcgaggtgacccaccaggggctcagctcccccgtcaccaagagcttcaaccggggcgagtgc

SEQ ID NO: 7951 - RNA, 1341 nt, synthetic construct
  misc_feature 1..1341: note = derived and/or modified sequence opt1 from Fontolizumab_HeavyChain1
  source 1..1341: mol_type = other RNA
caggtgcagctggtccagagcggcgccgagctcaagaagcccgggtccagcgtgaaggtgtcctgcaaggccagcggctacatcttcacctccagctggatcaactgggtcaagcaggcgccggggcagggcctggagtggatcgggcgcatcgacccctccgacggcgaggtgcactacaaccaggacttcaaggacaaggccaccctgacggtggacaagagcaccaacaccgcctacatggagctctccagcctgcggtccgaggacaccgccgtctactactgcgcccgcggcttcctgccctggttcgcggactgggggcagggcacgctcgtgaccgtgagctccgccagcaccaaggggccctccgtcttcccgctggcccccagctccaagagcacctccggcgggacggccgcgctgggctgcctcgtgaaggactacttccccgagcccgtgaccgtcagctggaacagcggcgccctgacctccggggtgcacaccttcccggccgtgctgcagagctccggcctctacagcctgtccagcgtcgtgacggtgccctccagctccctggggacccagacctacatctgcaacgtcaaccacaagcccagcaacaccaaggtggacaagaaggtggagcccaagtcctgcgacaagacgcacacgtgcccgccctgccccgcccccgagctcctgggcggcccgagcgtcttcctgttcccgcccaagcccaaggacaccctcatgatctcccggacccccgaggtgacctgcgtggtcgtggacgtcagccacgaggaccccgaggtgaagttcaactggtacgtggacggggtcgaggtgcacaacgccaagaccaagccccgcgaggagcagtacaactccacctaccgggtggtcagcgtgctgaccgtgctgcaccaggactggctcaacggcaaggagtacaagtgcaaggtctccaacaaggcgctgcccgccccgatcgagaagacgatcagcaaggccaaggggcagccccgcgagccccaggtgtacaccctgcccccgtcccgggacgagctcaccaagaaccaggtgagcctgacctgcctggtcaagggcttctaccccagcgacatcgccgtggagtgggagtccaacgggcagcccgagaacaactacaagacgaccccgcccgtgctcgacagcgacggctccttcttcctgtacagcaagctgaccgtcgacaagtcccgctggcagcagggcaacgtgttcagctgctccgtgatgcacgaggccctccacaaccactacacccagaagtccctgagcctgagccccgggaag

SEQ ID NO: 7952 - RNA, 642 nt, synthetic construct
  misc_feature 1..642: note = derived and/or modified sequence opt1 from Fontolizumab_LightChain1
  source 1..642: mol_type = other RNA
gacatccagatgacccagagcccctccaccctgagcgcctccgtgggcgaccgcgtcacgatcacgtgcaaggccagcgagaacgtggacacctacgtgtcctggtaccagcagaagccggggaaggcgcccaagctcctgatctacggcgccagcaaccggtacaccggggtcccctcccgcttcagcggctccgggagcggcaccgacttcaccctgaccatctccagcctccagcccgacgacttcgccacctactactgcggccagtcctacaactacccgttcacgttcgggcagggcaccaaggtggaggtgaagcggaccgtcgccgcccccagcgtgttcatcttcccgccctccgacgagcagctcaagagcgggaccgcgtccgtggtctgcctgctgaacaacttctacccccgcgaggccaaggtgcagtggaaggtggacaacgccctgcagagcggcaactcccaggagagcgtcacggagcaggacagcaaggactccacctacagcctgtccagcaccctcaccctgtccaaggccgactacgagaagcacaaggtgtacgcgtgcgaggtgacgcaccaggggctgagctcccccgtcaccaagagcttcaaccggggcgagtgc

SEQ ID NO: 7953 - RNA, 1344 nt, synthetic construct
  misc_feature 1..1344: note = derived and/or modified sequence opt1 from Foralumab_HeavyChain1
  source 1..1344: mol_type = other RNA
caggtgcagctggtcgagagcggcgggggcgtggtgcagcccgggcgctccctccggctgagctgcgccgcctccggcttcaagttcagcgggtacggcatgcactgggtccgccaggcgccgggcaaggggctggagtgggtggccgtgatctggtacgacggctccaagaagtactacgtcgacagcgtgaaggggcggttcaccatctcccgcgacaacagcaagaacaccctctacctgcagatgaactccctgcgggccgaggacacggccgtgtactactgcgcccgccagatgggctactggcacttcgacctctgggggcggggcaccctggtcaccgtgagctccgcgagcaccaagggcccctccgtgttccccctggcccccagctccaagagcacgtccgggggcaccgccgccctcgggtgcctggtcaaggactacttcccggagcccgtgaccgtgagctggaactccggcgcgctgaccagcggcgtccacacgttccccgccgtgctccagagctccgggctgtacagcctgtccagcgtggtcaccgtgccctccagctccctcggcacccagacctacatctgcaacgtgaaccacaagccgagcaacacgaaggtcgacaagcgcgtggagcccaagtcctgcgacaagacccacacgtgcccgccctgccccgcccccgaggccgagggcgggcccagcgtgttcctgttcccgcccaagcccaaggacaccctgatgatctcccggacccccgaggtgacctgcgtcgtcgtggacgtgagccacgaggaccccgaggtcaagttcaactggtacgtggacggggtggaggtccacaacgccaagaccaagccgcgcgaggagcagtacaactccacctaccgggtggtgagcgtcctcacggtgctgcaccaggactggctgaacggcaaggagtacaagtgcaaggtgtccaacaaggcgctccccgcccccatcgagaagaccatcagcaaggccaagggccagccccgcgagccgcaggtctacaccctgccgccctcccgggaggagatgaccaagaaccaggtgagcctgacgtgcctcgtgaaggggttctacccctccgacatcgccgtcgagtgggagagcaacggccagcccgagaacaactacaagaccaccccgcccgtgctggacagcgacgggtccttcttcctgtacagcaagctcaccgtggacaagtcccgctggcagcagggcaacgtcttcagctgctccgtgatgcacgaggccctgcacaaccactacacgcagaagtccctgagcctcagccccgggaag

SEQ ID NO: 7954 - RNA, 645 nt, synthetic construct
  misc_feature 1..645: note = derived and/or modified sequence opt1 from Foralumab_LightChain1
  source 1..645: mol_type = other RNA
gagatcgtgctgacccagagccccgccaccctctccctgagccccggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggccgcccctgaccttcggcggcgggaccaaggtggagatcaagcgcaccgtcgccgccccctccgtgttcatcttcccgcccagcgacgagcagctcaagtccggcacggcgagcgtggtctgcctgctgaacaacttctacccccgggaggccaaggtgcagtggaaggtggacaacgccctccagtccgggaacagccaggagagcgtcaccgagcaggactccaaggacagcacctactccctgagctccaccctgacgctcagcaaggccgactacgagaagcacaaggtgtacgcctgcgaggtgacccaccagggcctgtccagccccgtcaccaagtccttcaaccgcggggagtgc

SEQ ID NO: 7955 - RNA, 1344 nt, synthetic construct
  misc_feature 1..1344: note = derived and/or modified sequence opt1 from Foravirumab_HeavyChain1
  source 1..1344: mol_type = other RNA
caggtgcagctggtcgagagcggcgggggcgccgtgcagcccgggcgctccctccggctgagctgcgccgcgtccggcttcaccttcagctcctacgggatgcactgggtgcgccaggccccgggcaagggcctggagtgggtcgccgtgatcctctacgacgggagcgacaagttctacgccgactccgtgaagggccggttcaccatcagccgcgacaactccaagaacacgctgtacctgcagatgaacagcctccgggccgaggacaccgcggtctactactgcgccaaggtggccgtggccgggacccacttcgactactggggccaggggaccctggtcacggtgtccagcgcgtccaccaagggccccagcgtgttccccctggccccctccagcaagtccaccagcggcgggaccgccgccctcggctgcctggtcaaggactacttcccggagcccgtgacggtgtcctggaacagcggggccctgaccagcggcgtccacaccttccccgcggtgctccagtccagcggcctgtactccctgagctccgtggtcaccgtgcccagctccagcctcgggacgcagacctacatctgcaacgtgaaccacaagccgtccaacaccaaggtcgacaagcgcgtggagcccaagagctgcgacaagacccacacgtgcccgccctgccccgcccccgagctgctgggcgggccctccgtgttcctcttcccgcccaagcccaaggacaccctgatgatcagccggacccccgaggtgacctgcgtcgtcgtggacgtgtcccacgaggaccccgaggtcaagttcaactggtacgtggacggcgtggaggtccacaacgccaagacgaagccgcgcgaggagcagtacaacagcacctaccgggtggtgtccgtcctgaccgtgctccaccaggactggctgaacgggaaggagtacaagtgcaaggtgagcaacaaggccctgcccgcccccatcgagaagaccatctccaaggcgaagggccagccccgcgagccgcaggtctacacgctcccgcccagccgggaggagatgaccaagaaccaggtgtccctgacctgcctggtgaagggcttctaccccagcgacatcgccgtcgagtgggagagcaacgggcagcccgagaacaactacaagaccacgccgcccgtgctcgactccgacggcagcttcttcctgtactccaagctgaccgtggacaagagccgctggcagcaggggaacgtcttctcctgcagcgtgatgcacgaggccctccacaaccactacacccagaagtccctgagcctgtcccccggc

SEQ ID NO: 7956 - RNA, 1344 nt, synthetic construct
  misc_feature 1..1344: note = derived and/or modified sequence opt1 from Foravirumab_HeavyChain
  source 1..1344: mol_type = other RNA
gaggtgcagctggtcgagagcggcgggggcgccgtgcagcccgggcgctccctccggctgagctgcgccgcgtccggcttcaccttcagctcctacgggatgcactgggtgcgccaggccccgggcaagggcctggagtgggtcgccgtgatcctctacgacgggagcgacaagttctacgccgactccgtgaagggccggttcaccatcagccgcgacaactccaagaacacgctgtacctgcagatgaacagcctccgggccgaggacaccgcggtctactactgcgccaaggtggccgtggccgggacccacttcgactactggggccaggggaccctggtcacggtgtccagcgcgtccaccaagggccccagcgtgttccccctggccccctccagcaagtccaccagcggcgggaccgccgccctcggctgcctggtcaaggactacttcccggagcccgtgacggtgtcctggaacagcggggccctgaccagcggcgtccacaccttccccgcggtgctccagtccagcggcctgtactccctgagctccgtggtcaccgtgcccagctccagcctcgggacgcagacctacatctgcaacgtgaaccacaagccgtccaacaccaaggtcgacaagcgcgtggagcccaagagctgcgacaagacccacacgtgcccgccctgccccgcccccgagctgctgggcgggccctccgtgttcctcttcccgcccaagcccaaggacaccctgatgatcagccggacccccgaggtgacctgcgtcgtcgtggacgtgtcccacgaggaccccgaggtcaagttcaactggtacgtggacggcgtggaggtccacaacgccaagacgaagccgcgcgaggagcagtacaacagcacctaccgggtggtgtccgtcctgaccgtgctccaccaggactggctgaacgggaaggagtacaagtgcaaggtgagcaacaaggccctgcccgcccccatcgagaagaccatctccaaggcgaagggccagccccgcgagccgcaggtctacacgctcccgcccagccgggaggagatgaccaagaaccaggtgtccctgacctgcctggtgaagggcttctaccccagcgacatcgccgtcgagtgggagagcaacgggcagcccgagaacaactacaagaccacgccgcccgtgctcgactccgacggcagcttcttcctgtactccaagctgaccgtggacaagagccgctggcagcaggggaacgtcttctcctgcagcgtgatgcacgaggccctccacaaccactacacccagaagtccctgagcctgtcccccggc

SEQ ID NO: 7957 - RNA, 642 nt, synthetic construct
  misc_feature 1..642: note = derived and/or modified sequence opt1 from Foravirumab_LightChain1
  source 1..642: mol_type = other RNA
gacatccagatgacccagagcccctccagcctgtccgccagcgtgggcgaccgcgtcaccatcacgtgccgggcctcccaggggatccgcaacgacctcggctggtaccagcagaagccggggaaggcgcccaagctgctgatctacgccgccagctccctccagagcggcgtgccctcccggttcagcgggtccggcagcggcaccgacttcaccctgaccatctccagcctgcagcccgaggacttcgccacgtactactgccagcagctcaactcctacccgcccaccttcgggggcgggaccaaggtggagatcaagcgcaccgtcgccgcgcccagcgtgttcatcttcccgccctccgacgagcagctcaagagcggcacggcctccgtggtctgcctgctgaacaacttctacccccgggaggccaaggtgcagtggaaggtggacaacgccctgcagagcgggaacagccaggagtccgtcaccgagcaggacagcaaggactccacctacagcctgtccagcaccctcacgctgtccaaggcggactacgagaagcacaaggtgtacgcctgcgaggtgacccaccagggcctgagctcccccgtcaccaagagcttcaaccgcggcgagtgc

SEQ ID NO: 7958 - RNA, 1341 nt, synthetic construct
  misc_feature 1..1341: note = derived and/or modified sequence opt1 from Fresolimumab_HeavyChain1
  source 1..1341: mol_type = other RNA
caggtgcagctggtccagagcggcgccgaggtgaagaagcccgggtccagcgtgaaggtctcctgcaaggccagcggctacaccttctccagcaacgtgatctcctgggtgcgccaggcgcccgggcagggcctcgagtggatgggcggggtcatccccatcgtggacatcgccaactacgcccagcggttcaagggccgcgtgaccatcacggccgacgagagcacctccaccacctacatggagctgagctccctgcggagcgaggacacggccgtctactactgcgcgtccaccctcgggctggtgctggacgccatggactactggggccaggggaccctcgtgaccgtcagctccgccagcacgaagggcccctccgtgttccccctggccccgtgcagccgctccaccagcgagagcaccgcggccctggggtgcctcgtgaaggactacttccccgagcccgtcaccgtgtcctggaacagcggcgccctgacgtccggcgtgcacaccttccccgccgtcctgcagagctccgggctctacagcctgtccagcgtggtgaccgtcccgtccagctccctgggcaccaagacgtacacgtgcaacgtggaccacaagcccagcaacaccaaggtggacaagcgggtcgagtccaagtacgggccgccctgcccgagctgccccgcccccgagttcctcggcggcccctccgtgttcctgttcccgcccaagcccaaggacaccctgatgatcagccgcacccccgaggtgacctgcgtcgtggtcgacgtgtcccaggaggacccggaggtgcagttcaactggtacgtcgacggggtggaggtgcacaacgcgaagaccaagccccgggaggagcagttcaacagcacctaccgcgtcgtgtccgtgctcacggtcctgcaccaggactggctgaacggcaaggagtacaagtgcaaggtgagcaacaaggggctccccagctccatcgagaagaccatcagcaaggccaagggccagccccgggagccccaggtgtacaccctgccgccctcccaggaggagatgaccaagaaccaggtcagcctgacgtgcctcgtgaaggggttctacccctccgacatcgccgtggagtgggagagcaacggccagcccgagaacaactacaagaccaccccgcccgtcctggactccgacggcagcttcttcctgtactcccgcctcaccgtggacaagagccggtggcaggaggggaacgtgttctcctgcagcgtcatgcacgaggccctgcacaaccactacacgcagaagtccctgagcctctccctgggcaag

SEQ ID NO: 7959 - RNA, 645 nt, synthetic construct
  misc_feature 1..645: note = derived and/or modified sequence opt1 from Fresolimumab_LightChain1
  source 1..645: mol_type = other RNA
gagaccgtgctgacccagagccccggcacgctctccctgagcccgggggagcgcgccaccctgtcctgccgggccagccagtccctcggcagctcctacctggcgtggtaccagcagaagcccgggcaggcgccccgcctgctcatctacggcgccagctcccgggcccccgggatcccggaccgcttcagcggctccggcagcgggaccgacttcaccctgacgatctcccggctggagcccgaggacttcgccgtctactactgccagcagtacgccgacagccccatcaccttcggccaggggacccgcctcgagatcaagcggaccgtggccgccccctccgtgttcatcttcccgcccagcgacgagcagctgaagtccggcacggccagcgtcgtgtgcctgctcaacaacttctacccccgcgaggcgaaggtgcagtggaaggtcgacaacgccctgcagtccgggaacagccaggagagcgtgaccgagcaggactccaaggacagcacctactccctgagctccaccctcacgctgagcaaggccgactacgagaagcacaaggtgtacgcctgcgaggtcacccaccagggcctgtccagccccgtgaccaagtccttcaaccggggcgagtgc

SEQ ID NO: 7960 - RNA, 1347 nt, synthetic construct
  misc_feature 1..1347: note = derived and/or modified sequence opt1 from Fulranumab_HeavyChain1
  source 1..1347: mol_type = other RNA
gaggtgcagctggtcgagagcggcgggggcctcgtgcagcccgggggctccctgcgcctgagctgcgccgcctccgggttcaccctccggagctactccatgaactgggtgcgccaggcgccgggcaagggcctggagtgggtcagctacatctcccggagctcccacaccatcttctacgccgacagcgtgaaggggcgcttcacgatctcccgggacaacgccaagaacagcctgtacctccagatggactccctgcgcgacgaggacaccgccatgtactactgcgcccgggtgtacagctccggctggcacgtcagcgactacttcgactactgggggcagggcatcctggtgaccgtgtccagcgcgtccaccaaggggcccagcgtcttccccctcgccccctgcagccgctccacgagcgagtccaccgccgccctgggctgcctggtgaaggactacttcccggagcccgtgaccgtcagctggaactccggcgcgctcaccagcggggtgcacacgttccccgccgtgctgcagtccagcggcctgtactccctcagctccgtcgtgaccgtgcccagctccaacttcgggacccagacctacacgtgcaacgtcgaccacaagccgagcaacaccaaggtggacaagaccgtggagcggaagtgctgcgtcgagtgcccgccctgccccgccccgcccgtggccggcccctccgtgttcctgttcccgcccaagcccaaggacaccctgatgatcagccgcacgcccgaggtgacctgcgtcgtcgtggacgtgtcccacgaggaccccgaggtccagttcaactggtacgtggacggcgtggaggtccacaacgccaagaccaagccgcgggaggagcagttcaacagcaccttccgcgtggtgtccgtcctcacggtggtgcaccaggactggctgaacgggaaggagtacaagtgcaaggtcagcaacaagggcctgcccgcgcccatcgagaagaccatcagcaagaccaaggggcagccccgggagccccaggtgtacaccctcccgccctcccgcgaggagatgacgaagaaccaggtgagcctgacctgcctggtcaagggcttctacccctccgacatcgccgtggagtgggagagcaacgggcagcccgagaacaactacaagaccaccccgcccatgctcgactccgacggcagcttcttcctgtactccaagctgacggtggacaagagccggtggcagcagggcaacgtcttctcctgcagcgtgatgcacgaggccctccacaaccactacacccagaagtccctgagcctgtcccccgggaag

SEQ ID NO: 7961 - RNA, 642 nt, synthetic construct; identical to SEQ ID NO: 7950
  misc_feature 1..642: note = derived and/or modified sequence opt1 from Fulranumab_LightChain1
  source 1..642: mol_type = other RNA

SEQ ID NO: 7962 - RNA, 1356 nt, synthetic construct
  misc_feature 1..1356: note = derived and/or modified sequence opt1 from Futuximab_HeavyChain1
  source 1..1356: mol_type = other RNA
gaggtgcagctgcagcagcccggcagcgagctcgtccgcccgggggcctccgtgaagctgagctgcaaggcctccggctacaccttcaccagctactggatgcactgggtgaagcagcggcccgggcagggcctggagtggatcgggaacatctaccccggctcccgcagcacgaactacgacgagaagttcaagtccaaggcgaccctcaccgtcgacaccagctccagcacggcctacatgcagctgtccagcctgacctccgaggacagcgccgtgtactactgcacccggaacggcgactactacgtgtccagcggggacgccatggactactggggccaggggacctccgtcacggtgagctccgccagcaccaagggccccagcgtgttcccgctcgcgccctccagcaagtccaccagcgggggcaccgccgccctgggctgcctggtcaaggactacttccccgagcccgtgacggtgtcctggaacagcggggccctcacctccggcgtccacaccttcccggcggtgctgcagagctccgggctgtacagcctctccagcgtggtcaccgtgccctccagctccctgggcacgcagacctacatctgcaacgtgaaccacaagcccagcaacaccaaggtcgacaagcgcgtggagcccaagtcctgcgacaagacccacacgtgcccgccctgccccgcccccgagctgctcggcgggccgagcgtgttcctgttcccgcccaagcccaaggacaccctgatgatctcccggacccccgaggtgacctgcgtcgtggtcgacgtgagccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgccccgatcgagaagaccatctccaaggcgaagggccagccccgcgagccccaggtctacacgctgcccccgagccgggaggagatgaccaagaaccaggtgtccctgacctgcctcgtgaaggggttctaccccagcgacatcgccgtcgagtgggagtccaacggccagcccgagaacaactacaagaccacgccgcccgtgctggacagcgacggctccttcttcctgtacagcaagctcaccgtggacaagtcccgctggcagcaggggaacgtcttcagctgctccgtgatgcacgaggccctgcacaaccactacacccagaagtccctgagcctcagccccggc

SEQ ID NO: 7963 - RNA, 642 nt, synthetic construct
  misc_feature 1..642: note = derived and/or modified sequence opt1 from Futuximab_LightChain1
  source 1..642: mol_type = other RNA
gacatccagatgacccagaccacgagctccctgagcgcctccctcggcgaccgcgtgaccatcagctgccggacctcccaggacatcgggaactacctgaactggtaccagcagaagcccgacggcaccgtcaagctgctcatctactacacgagccgcctgcactccggggtgcccagccggttctccggcagcgggtccggcaccgacttcagcctgaccatcaacaacgtggagcaggaggacgtcgccacctacttctgccagcactacaacacggtgccgcccaccttcggcgggggcaccaagctcgagatcaagcgcaccgtggcggccccctccgtcttcatcttcccgcccagcgacgagcagctgaagtccgggacggccagcgtggtgtgcctgctcaacaacttctacccccgggaggccaaggtccagtggaaggtggacaacgccctgcagtccggcaacagccaggagtccgtgaccgagcaggacagcaaggacagcacctactccctgagctccaccctcacgctgagcaaggcggactacgagaagcacaaggtctacgcctgcgaggtgacccaccaggggctgtccagccccgtgaccaagtccttcaaccgcggcgagtgc

SEQ ID NO: 7964 - RNA, 1335 nt, synthetic construct
  misc_feature 1..1335: note = derived and/or modified sequence opt1 from Galcanezumab_HeavyChain1
  source 1..1335: mol_type = other RNA
caggtgcagctggtccagagcggcgccgaggtgaagaagcccgggtccagcgtgaaggtctcctgcaaggccagcggctacaccttcgggaactactggatgcagtgggtgcgccaggcgcccggccaggggctcgagtggatgggcgccatctacgagggcaccgggaagacggtgtacatccagaagttcgccgaccgggtcaccatcaccgccgacaagtccaccagcacggcctacatggagctgtccagcctgcgctccgaggacaccgcggtgtactactgcgcccggctcagcgactacgtgtccggcttcgggtactggggccaggggaccaccgtcacggtgagctccgccagcaccaagggcccctccgtgttccccctggccccctgcagccgctccaccagcgagtccaccgcggccctgggctgcctcgtcaaggactacttcccggagcccgtgacggtgagctggaacagcggggccctgacctccggcgtccacaccttccccgccgtgctgcagagctccgggctctacagcctgtccagcgtggtcaccgtgccctccagctccctgggcacgaagacctacacgtgcaacgtggaccacaagccgagcaacaccaaggtcgacaagcgggtggagtccaagtacggcccgccctgcccgccctgccccgcccccgaggcggccgggggccccagcgtgttcctcttcccgcccaagcccaaggacaccctgatgatctcccgcacccccgaggtgacctgcgtcgtcgtggacgtgagccaggaggaccccgaggtccagttcaactggtacgtggacggggtggaggtccacaacgccaagaccaagccccgggaggagcagttcaactccacgtaccgcgtggtgagcgtcctgaccgtgctccaccaggactggctgaacggcaaggagtacaagtgcaaggtgtccaacaaggggctgcccagctccatcgagaagaccatcagcaaggccaagggccagccccgggagccgcaggtctacaccctcccgcccagccaggaggagatgacgaagaaccaggtgtccctgacctgcctggtgaagggcttctaccccagcgacatcgccgtcgagtgggagtccaacgggcagcccgagaacaactacaagaccaccccgcccgtgctcgacagcgacggctccttcttcctgtacagccgcctgacggtggacaagtcccggtggcaggaggggaacgtcttcagctgctccgtgatgcacgaggcgctccacaaccactacacccagaagtccctgagcctgagcctcggc

SEQ ID NO: 7965 - RNA, 642 nt, synthetic construct
  misc_feature 1..642: note = derived and/or modified sequence opt1 from Galcanezumab_LightChain1
  source 1..642: mol_type = other RNA
gacatccagatgacccagagcccctccagcctgtccgccagcgtgggcgaccgcgtcaccatcacgtgccgggcctccaaggacatcagcaagtacctcaactggtaccagcagaagccggggaaggcgcccaagctgctgatctactacacctccggctaccacagcggggtgccctcccgcttcagcggctccgggagcggcaccgacttcaccctcacgatctccagcctgcagcccgaggacttcgccacctactactgccagcagggcgacgccctgccgcccaccttcgggggcgggaccaaggtggagatcaagcggacggtcgccgccccctccgtgttcatcttcccgcccagcgacgagcagctcaagtccggcaccgcgagcgtggtctgcctgctgaacaacttctacccccgcgaggccaaggtgcagtggaaggtggacaacgccctccagtccgggaacagccaggagagcgtcaccgagcaggactccaaggacagcacctactccctgagctccacgctgaccctcagcaaggccgactacgagaagcacaaggtgtacgcgtgcgaggtgacccaccagggcctgtccagccccgtcaccaagtccttcaaccggggcgagtgc

SEQ ID NO: 7966 - RNA, 1371 nt, synthetic construct
  misc_feature 1..1371: note = derived and/or modified sequence opt1 from Galiximab_HeavyChain1
  source 1..1371: mol_type = other RNA
caggtgcagctgcaggagagcggccccgggctcgtcaagccgtccgagaccctgagcctgacctgcgccgtgtccggcgggagcatctccggcgggtacggctggggctggatccgccagccgcccgggaagggcctcgagtggatcgggagcttctactccagctccggcaacacgtactacaaccccagcctgaagtcccaggtgaccatcagcaccgacacctccaagaaccagttcagcctgaagctcaactccatgacggccgcggacaccgccgtctactactgcgtgcgggaccgcctgttcagcgtggtcgggatggtgtacaacaactggttcgacgtgtggggccccggcgtcctggtgaccgtgtccagcgcctccaccaaggggcccagcgtcttccccctcgcccccagctccaagagcacgtccggcgggaccgccgcgctgggctgcctggtgaaggactacttcccggagcccgtgaccgtcagctggaactccggcgccctcaccagcggggtgcacacgttccccgccgtgctgcagtccagcggcctgtactccctcagctccgtcgtgaccgtgcccagctccagcctggggacccagacctacatctgcaacgtcaaccacaagccgtccaacacgaaggtggacaagaaggccgagcccaagagctgcgacaagacccacacgtgcccgccctgccccgcgcccgagctgctcggcgggccctccgtgttcctgttcccgcccaagcccaaggacaccctgatgatcagccggacccccgaggtgacctgcgtcgtcgtggacgtgtcccacgaggaccccgaggtcaagttcaactggtacgtggacggcgtggaggtccacaacgccaagaccaagccgcgcgaggagcagtacaacagcacctaccgggtggtgagcgtcctcacggtgctgcaccaggactggctgaacggcaaggagtacaagtgcaaggtgtccaacaaggccctccccgcccccatcgagaagaccatcagcaaggccaaggggcagccccgcgagccgcaggtctacaccctgccgccctcccgggacgagctgaccaagaaccaggtgagcctcacgtgcctggtgaagggcttctacccctccgacatcgcggtcgagtgggagagcaacgggcagcccgagaacaactacaagaccaccccgcccgtgctggactccgacggcagcttcttcctctactccaagctgaccgtggacaagagccgctggcagcaggggaacgtcttctcctgcagcgtgatgcacgaggccctgcacaaccactacacgcagaagtccctcagcctgtcccccggcaag

SEQ ID NO: 7967 - RNA, 648 nt, synthetic construct
  misc_feature 1..648: note = derived and/or modified sequence opt1 from Galiximab_LightChain1
  source 1..648: mol_type = other RNA
gagagcgccctgacccagcccccgtccgtgagcggcgcccccgggcagaaggtcaccatctcctgcacgggcagcacctccaacatcgggggctacgacctccactggtaccagcagctgcccgggaccgcgcccaagctgctcatctacgacatcaacaagcgcccgagcggcatctccgaccggttcagcggctccaagagcgggaccgccgcctccctggccatcacgggcctgcagaccgaggacgaggccgactactactgccagagctacgactccagcctcaacgcccaggtgttcgggggcgggacccgcctgaccgtgctgggccagcccaaggcggcccccacggtcaccctcttcccgccctccagcgaggagctgcaggccaacaaggcgaccctggtgtgcctcatctccgacttctaccccggcgccgtgaccgtcgcctggaaggccgacagctcccccgtgaaggccggggtggagacgaccacccccagcaagcagagcaacaacaagtacgcggcctccagctacctgtccctgaccccggagcagtggaagtcccaccggagctacagctgccaggtcacgcacgagggctccaccgtggagaagaccgtggcccccaccgagtgcagc

SEQ ID NO: 7968 - RNA, 1347 nt, synthetic construct
  misc_feature 1..1347: note = derived and/or modified sequence opt1 from Ganitumab_HeavyChain1
  source 1..1347: mol_type = other RNA
caggtgcagctgcaggagagcggccccgggctcgtcaagccctccggcaccctgagcctgacctgcgccgtgtccgggggcagcatctccagctccaactggtggagctgggtgcgccagccgcccgggaagggcctcgagtggatcggcgagatctaccactccgggagcacgaactacaacccctccctcaagagccgggtcaccatctccgtggacaagagcaagaaccagttctccctgaagctgagctccgtgaccgccgcggacaccgccgtctactactgcgcccgctggacgggccggaccgacgccttcgacatctgggggcagggcaccatggtgaccgtgagctccgccagcacgaaggggcccagcgtcttccccctggcgccctccagcaagtccaccagcggcggcaccgccgccctggggtgcctcgtgaaggactacttccccgagccggtgaccgtctcctggaacagcggcgccctgacgtccggggtgcacaccttccccgcggtgctgcagagctccggcctctacagcctgtccagcgtcgtgaccgtgccctccagctccctgggcacccagacgtacatctgcaacgtcaaccacaagcccagcaacaccaaggtggacaagaaggtggagccgaagtcctgcgacaagacccacacgtgcccgccctgccccgcccccgagctcctcgggggccccagcgtcttcctgttcccgcccaagcccaaggacaccctgatgatctcccgcacccccgaggtgacctgcgtggtcgtggacgtcagccacgaggaccccgaggtgaagttcaactggtacgtggacggggtcgaggtgcacaacgccaagaccaagccccgggaggagcagtacaacagcacgtaccgcgtggtctccgtgctgaccgtgctgcaccaggactggctcaacggcaaggagtacaagtgcaaggtcagcaacaaggccctgccggcccccatcgagaagaccatctccaaggcgaaggggcagccccgggagccccaggtgtacaccctgccgcccagccgcgacgagctcacgaagaaccaggtgtccctgacctgcctggtcaagggcttctaccccagcgacatcgccgtggagtgggagtccaacggccagccggagaacaactacaagaccaccccgcccgtgctcgacagcgacgggtccttcttcctgtacagcaagctgacggtcgacaagtcccggtggcagcagggcaacgtgttcagctgctccgtgatgcacgaggccctccacaaccactacacccagaagtccctgagcctgagccccgggaag

SEQ ID NO: 7969 - RNA, 657 nt, synthetic construct
  misc_feature 1..657: note = derived and/or modified sequence opt1 from Ganitumab_LightChain1
  source 1..657: mol_type = other RNA
gacgtggtcatgacccagagccccctgtccctcccggtgacccccggcgagcccgccagcatctcctgccgcagctcccagagcctgctgcactccaacgggtacaactacctcgactggtacctgcagaagcccggccagagcccgcagctgctcatctacctggggtccaaccgggccagcggcgtgcccgaccgcttctccgggagcggctccggcacggacttcaccctgaagatcagccgggtcgaggcggaggacgtgggggtgtactactgcatgcagggcacccactggcccctcaccttcgggcagggcacgaaggtcgagatcaagcgcaccgtggccgccccctccgtgttcatcttcccgcccagcgacgagcagctgaagtccgggaccgccagcgtcgtgtgcctgctcaacaacttctacccccgggaggccaaggtgcagtggaaggtcgacaacgcgctgcagtccggcaacagccaggagagcgtgaccgagcaggactccaaggacagcacgtactccctgagctccaccctcaccctgagcaaggccgactacgagaagcacaaggtgtacgcctgcgaggtcacccaccagggcctgtccagccccgtgacgaagtccttcaaccgcggggagtgc

SEQ ID NO: 7970 - RNA, 1368 nt, synthetic construct
  misc_feature 1..1368: note = derived and/or modified sequence opt1 from Gantenerumab_HeavyChain1
  source 1..1368: mol_type = other RNA
caggtggagctggtcgagagcggcgggggcctcgtgcagcccgggggctccctgcgcctgagctgcgccgcctccgggttcaccttcagctcctacgcgatgagctgggtgcggcaggccccgggcaagggcctcgagtgggtctccgccatcaacgccagcgggacccgcacgtactacgccgactccgtgaagggccggttcaccatcagccgcgacaactccaagaacaccctgtacctgcagatgaacagcctccgggcggaggacaccgccgtgtactactgcgcccgcgggaagggcaacacgcacaagccctacgggtacgtccggtacttcgacgtgtggggccagggcaccctggtgaccgtctccagcgcctccaccaaggggcccagcgtgttccccctggcgccgtccagcaagtccacgagcggcgggaccgccgccctcggctgcctggtgaaggactacttccccgagcccgtcaccgtgagctggaactccggcgccctgaccagcggggtgcacacgttccccgccgtcctccagtccagcggcctgtactccctgagctccgtggtgaccgtcccgagctccagcctcgggacccagacctacatctgcaacgtgaaccacaagccctccaacacgaaggtggacaagaaggtcgagcccaagagctgcgacaagacccacacgtgcccgccctgccccgcgcccgagctgctgggcgggccctccgtgttcctcttcccgcccaagcccaaggacaccctgatgatcagccgcacccccgaggtgacctgcgtcgtggtcgacgtgtcccacgaggacccggaggtgaagttcaactggtacgtcgacggcgtggaggtgcacaacgccaagaccaagccccgggaggagcagtacaacagcacctaccgcgtcgtgtccgtgctgacggtcctccaccaggactggctgaacggcaaggagtacaagtgcaaggtgagcaacaaggccctgcccgcccccatcgagaagaccatctccaaggccaaggggcagccgcgggagccccaggtgtacaccctcccgcccagccgcgacgagctgaccaagaaccaggtcagcctgacgtgcctcgtgaagggcttctacccctccgacatcgcggtggagtgggagagcaacgggcagcccgagaacaactacaagaccacgcccccggtcctggactccgacggcagcttcttcctgtactccaagctcaccgtggacaagagccggtggcagcaggggaacgtgttctcctgcagcgtcatgcacgaggccctgcacaaccactacacccagaagtccctgagcctctcccccggcaag

SEQ ID NO: 7971 - RNA, 645 nt, synthetic construct
  misc_feature 1..645: note = derived and/or modified sequence opt1 from Gantenerumab_LightChain1
  source 1..645: mol_type = other RNA
gacatcgtgctgacccagagccccgccaccctctccctgagcccgggcgagcgggccacgctgtcctgccgggcgagccagtccgtcagctccagctacctcgcctggtaccagcagaagcccgggcaggcgccccgcctgctgatctacggcgcctccagccgggccaccggggtgcccgcccgcttctccggcagcgggtccggcaccgacttcaccctcacgatcagctccctggagccggaggacttcgccacctactactgcctgcagatctacaacatgcccatcaccttcggccaggggaccaaggtggagatcaagcggacggtcgccgcccccagcgtgttcatcttcccgccctccgacgagcagctcaagagcggcaccgcgtccgtggtctgcctgctgaacaacttctacccccgcgaggccaaggtgcagtggaaggtggacaacgccctccagagcgggaacagccaggagtccgtcaccgagcaggacagcaaggactccacctacagcctgtccagcacgctgaccctctccaaggccgactacgagaagcacaaggtgtacgcctgcgaggtgacccaccagggcctgagctcccccgtcaccaagagcttcaaccgcggggagtgc

SEQ ID NO: 7972 - RNA, 348 nt, synthetic construct
  misc_feature 1..348: note = derived and/or modified sequence opt1 from Gemtuzumab_HeavyChain1
  source 1..348: mol_type = other RNA
caggtgcagctgcagcagagcggcgccgagctcgccaagcccggggcgtccgtcaagatgagctgcaaggcctccggctacaccttcaccagctaccgcatgcactgggtgaagcagcggccggggcagggcctggagtggatcgggtacatcaacccctccacgggctacaccgagtacaaccagaagttcaaggacaaggccaccctgaccgccgacaagagctccagcacggcctacatgcagctctccagcctgaccttcgaggactccgcggtgtactactgcgcccgcggcgggggcgtcttcgactactgggggcagggcaccaccctgacggtgagctcc

SEQ ID NO: 7973 - RNA, 351 nt, synthetic construct
  misc_feature 1..351: note = derived and/or modified sequence opt1 from Gemtuzumab_HeavyChain2
  source 1..351: mol_type = other RNA
caggtgcagctggtccagagcggcgccgaggtgaagaagcccgggtccagcgtgaaggtctcctgcaaggccagcggcgggaccttctcccgcagcgcgatcatctgggtgcggcaggccccgggccaggggctcgagtggatgggcggcatcgtgcccatgttcgggccgcccaactacgcccagaagttccagggccgcgtcaccatcacggccgacgagtccaccaacaccgcctacatggagctgagctccctgcggagcgaggacaccgcgttctacttctgcgccgggggctacgggatctactcccccgaggagtacaacggcggcctcgtgacggtgagctcc

SEQ ID NO: 7974 - RNA, 321 nt, synthetic construct
  misc_feature 1..321: note = derived and/or modified sequence opt1 from Gemtuzumab_LightChain2
  source 1..321: mol_type = other RNA
gacatccagatgacccagagcccctccaccctgagcgcctccgtgggcgaccgcgtcacgatcacgtgccgggccagccagtccatcaacacctggctcgcgtggtaccagcagaagccggggaaggcccccaagctgctgatgtacaaggccagctccctcgagagcggcgtgccctcccgcttcatcgggagcggctccgggaccgagttcaccctgaccatcagctccctgcagcccgacgacttcgccacctactactgccagcagtacaacagcgactccaagatgttcggccagggcaccaaggtggaggtcaag

SEQ ID NO: 7975 - RNA, 318 nt, synthetic construct
  misc_feature 1..318: note = derived and/or modified sequence opt1 from Gemtuzumab_ozogamicin_LightChain1
  source 1..318: mol_type = other RNA
cagatcgtgctgacccagagccccgccatcatgtccgccagcccgggcgagaaggtcaccatcacgtgctccgcgagctccagcatctcctacatgcactggttccagcagaagcccgggaccagccccaagctctggatctacaccacctccaacctggccagcggcgtgcccgcccgcttctccgggagcggctccgggacgagctactccctgaccatcagccggatggaggccgaggacgccgcgacctactactgccaccagcgctccacctacccgctcacgttcggcagcggcaccaagctggagctgaag

SEQ ID NO: 7976 - RNA, 1335 nt, synthetic construct
  misc_feature 1..1335: note = derived and/or modified sequence opt1 from Gevokizumab_HeavyChain1
  source 1..1335: mol_type = other RNA
caggtgcagctgcaggagagcggccccgggctcgtcaagccctcccagaccctgagcctgacctgctccttcagcggcttctccctcagcacgtccgggatgggcgtggggtggatccgccagcccagcggcaagggcctggagtggctggcccacatctggtgggacggggacgagtcctacaaccccagcctcaagtcccggctgaccatcagcaaggacacctccaagaaccaggtgagcctgaagatcacctccgtcacggccgcggacaccgccgtgtacttctgcgcccgcaaccggtacgacccgccctggttcgtggactggggccaggggaccctcgtcaccgtgagctccgccagcacgaagggcccctccgtgttccccctggccccctgcagccgcagcacctccgagagcaccgcggccctggggtgcctcgtcaaggactacttcccggagcccgtgaccgtgtcctggaacagcggcgccctgacgtccggcgtccacaccttccccgccgtgctgcagagctccgggctctacagcctgtccagcgtggtcaccgtgacctccagcaacttcggcacgcagacctacacgtgcaacgtggaccacaagccctccaacaccaaggtcgacaagaccgtggagcggaagtgctgcgtggagtgcccgccctgccccgcgcccccggtcgccgggcccagcgtgttcctgttcccgcccaagcccaaggacaccctcatgatctcccgcacccccgaggtgacctgcgtcgtggtcgacgtgagccacgaggaccccgaggtgcagttcaactggtacgtcgacggcatggaggtgcacaacgccaagacgaagccccgggaggagcagttcaactccaccttccgcgtggtcagcgtgctgaccgtggtccaccaggactggctgaacggcaaggagtacaagtgcaaggtgtccaacaaggggctcccggcccccatcgagaagaccatcagcaagacgaagggccagccccgggagccccaggtgtacaccctgccgcccagccgcgaggagatgaccaagaaccaggtctccctgacctgcctcgtgaaggggttctaccccagcgacatcgccgtggagtgggagtccaacggccagccggagaacaactacaagacgaccccgcccatgctggacagcgacgggtccttcttcctgtacagcaagctcaccgtcgacaagtcccggtggcagcagggcaacgtgttcagctgctccgtgatgcacgaggcgctgcacaaccactacacccagaagtccctgagcctcagccccggc

SEQ ID NO: 7977 - RNA, 642 nt, synthetic construct
  misc_feature 1..642: note = derived and/or modified sequence opt1 from Gevokizumab_LightChain1
  source 1..642: mol_type = other RNA
gacatccagatgacccagagcacctccagcctgtccgccagcgtgggcgaccgggtcacgatcacgtgccgggcctcccaggacatcagcaactacctctcctggtaccagcagaagcccgggaaggcggtgaagctgctgatctactacaccagcaagctccactccggcgtgccgagccgcttctccgggagcggctccgggaccgactacacgctgaccatcagctccctgcagcaggaggacttcgccacctacttctgcctccagggcaagatgctgccctggaccttcggccaggggacgaagctggagatcaagcggaccgtcgccgcccccagcgtgttcatcttcccgccctccgacgagcagctcaagagcggcaccgcctccgtggtctgcctgctgaacaacttctacccccgcgaggcgaaggtgcagtggaaggtggacaacgccctccagagcgggaacagccaggagtccgtcaccgagcaggacagcaaggactccacgtacagcctgtccagcaccctgaccctctccaaggccgactacgagaagcacaaggtgtacgcctgcgaggtgacccaccagggcctgagctcccccgtcaccaagagcttcaaccgcggggagtgc

SEQ ID NO: 7978 - RNA, 1347 nt, synthetic construct
  misc_feature 1..1347: note = derived and/or modified sequence opt1 from Girentuximab_HeavyChain1
  source 1..1347: mol_type = other RNA
gacgtgaagctggtcgagagcggcgggggcctcgtgaagctcgggggctccctgaagctgagctgcgccgcctccgggttcaccttcagcaactactacatgtcctgggtgcgccagacccccgagaagcggctggagctggtcgcggccatcaacagcgacggcggcatcacgtactacctcgacaccgtgaaggggcgcttcaccatctcccgggacaacgccaagaacaccctgtacctgcagatgagctccctcaagagcgaggacacggccctgttctactgcgcccgccaccggtccggctacttcagcatggactactgggggcagggcacctccgtgaccgtcagctccgcgagcaccaaggggccgtccgtgttccccctggcccccagctccaagagcacgagcggcggcaccgccgccctcgggtgcctggtgaaggactacttccccgagccggtcaccgtgtcctggaacagcggcgcgctgacctccggggtgcacacgttccccgccgtcctccagagctccggcctgtacagcctgtccagcgtggtgaccgtcccctccagctccctcggcacccagacctacatctgcaacgtgaaccacaagcccagcaacacgaaggtggacaagaaggtcgagccgaagtcctgcgacaagacccacacgtgcccgccctgccccgcccccgagctgctcgggggccccagcgtgttcctgttcccgcccaagcccaaggacaccctgatgatctcccgcacccccgaggtgacctgcgtcgtggtggacgtcagccacgaggaccccgaggtgaagttcaactggtacgtcgacggggtggaggtgcacaacgccaagaccaagccccgggaggagcagtacaactccacctaccgcgtcgtgagcgtgctgacggtcctccaccaggactggctgaacggcaaggagtacaagtgcaaggtgtccaacaaggccctgccggcgcccatcgagaagaccatcagcaaggccaaggggcagccccgggagccccaggtgtacaccctcccgcccagccgcgacgagctgaccaagaaccaggtctccctgacgtgcctcgtgaagggcttctaccccagcgacatcgccgtggagtgggagtccaacggccagcccgagaacaactacaagaccaccccgcccgtcctggacagcgacgggtccttcttcctgtacagcaagctcaccgtggacaagtcccggtggcagcagggcaacgtgttcagctgctccgtcatgcacgaggccctgcacaaccactacacgcagaagtccctgagcctcagccccgggaag

SEQ ID NO: 7979 - RNA, 642 nt, synthetic construct
  misc_feature 1..642: note = derived and/or modified sequence opt1 from Girentuximab_LightChain1
  source 1..642: mol_type = other RNA
gacatcgtgatgacccagagccagcgcttcatgtccaccacggtcggcgaccgggtgagcatcacgtgcaaggcctcccagaacgtggtcagcgccgtggcgtggtaccagcagaagcccgggcagtccccgaagctgctcatctacagcgcctccaaccgctacaccggcgtgcccgaccggttcaccgggagcggctccgggaccgacttcaccctgaccatcagcaacatgcagtccgaggacctggccgacttcttctgccagcagtacagcaactacccctggaccttcggcggcgggacgaagctcgagatcaagcgcaccgtcgccgccccctccgtgttcatcttcccgcccagcgacgagcagctgaagtccggcaccgcgagcgtggtctgcctgctcaacaacttctacccccgggaggccaaggtgcagtggaaggtggacaacgccctgcagtccgggaacagccaggagtccgtcaccgagcaggacagcaaggacagcacgtactccctgagctccaccctcaccctgagcaaggccgactacgagaagcacaaggtgtacgcgtgcgaggtgacccaccagggcctgtccagccccgtcacgaagtccttcaaccgcggggagtgc

SEQ ID NO: 7980 - RNA, 1335 nt, synthetic construct
  misc_feature 1..1335: note = derived and/or modified sequence opt1 from Glembatumumab_HeavyChain1
  source 1..1335: mol_type = other RNA
caggtgcagctgcaggagagcggccccgggctcgtcaagccgtcccagaccctgagcctgacctgcacggtgtccggcgggagcatctccagcttcaactactactggtcctggatccgccaccaccccggcaaggggctcgagtggatcggctacatctactacagcggctccacctacagcaacccctccctcaagagccgggtgaccatctccgtcgacaccagcaagaaccagttctccctgacgctcagctccgtgaccgccgccgacaccgcggtgtactactgcgcccgcgggtacaactggaactacttcgactactggggccaggggaccctggtcacggtgagctccgccagcaccaagggccccagcgtgttcccgctggccccctgctcccggagcacctccgagagcaccgccgcgctcgggtgcctggtcaaggactacttccccgagcccgtgacggtgtcctggaacagcggcgccctgacctccggcgtccacaccttcccggccgtgctccagagctccgggctgtacagcctgtccagcgtggtcaccgtgccctccagcaacttcggcacgcagacctacacgtgcaacgtggaccacaagccctccaacaccaaggtcgacaagaccgtggagcgcaagtgctgcgtggagtgcccgccctgccccgccccgcccgtcgcggggcccagcgtgttcctcttcccgcccaagcccaaggacaccctgatgatctcccggacccccgaggtgacctgcgtcgtggtcgacgtgagccacgaggaccccgaggtgcagttcaactggtacgtcgacggcgtggaggtgcacaacgccaagacgaagccccgcgaggagcagttcaactccaccttccgggtcgtgagcgtgctgaccgtcgtgcaccaggactggctcaacggcaaggagtacaagtgcaaggtgagcaacaaggggctgcccgccccgatcgagaagaccatctccaagacgaagggccagccccgcgagccccaggtctacaccctgcccccgagccgggaggagatgaccaagaaccaggtgtccctgacctgcctggtgaaggggttctaccccagcgacatcgccgtcgagtgggagtccaacggccagcccgagaacaactacaagacgaccccgcccatgctggacagcgacgggtccttcttcctctacagcaagctgaccgtggacaagtcccgctggcagcagggcaacgtgttcagctgctccgtcatgcacgaggccctgcacaaccactacacccagaagtccctcagcctgagccccggcaag

SEQ ID NO: 7981 - RNA, 645 nt, synthetic construct
  misc_feature 1..645: note = derived and/or modified sequence opt1 from Glembatumumab_LightChain1
  source 1..645: mol_type = other RNA
gagatcgtgatgacccagagccccgccaccctgtccgtcagcccgggcgagcgggccacgctctcctgccgggcgagccagtccgtggacaacaacctggtgtggtaccagcagaagcccgggcaggcgccccgcctgctcatctacggcgccagcacccgggccaccgggatccccgcccgcttctccggcagcgggtccggcaccgagttcacgctgaccatcagctccctgcagagcgaggacttcgccgtctactactgccagcagtacaacaactggccgccctggaccttcggccaggggaccaaggtggagatcaagcggacggtggccgccccctccgtcttcatcttcccgcccagcgacgagcagctcaagtccggcaccgccagcgtggtgtgcctgctgaacaacttctacccccgcgaggcgaaggtccagtggaaggtggacaacgccctccagtccgggaacagccaggagtccgtgaccgagcaggacagcaaggacagcacctactccctgagctccacgctgaccctcagcaaggccgactacgagaagcacaaggtctacgcctgcgaggtgacccaccagggcctgtccagccccgtgaccaagtccttcaaccgcggggagtgc

SEQ ID NO: 7982 - RNA, 1332 nt, synthetic construct
  misc_feature 1..1332: note = derived and/or modified sequence opt1 from Goilixiab_HeavyChain1
  source 1..1332: mol_type = other RNA
gaggtgcagctggtcgagagcggcgggggcctcgccaagcccgggggctccctgcgcctgagctgcgccgcgtccgggttccggttcaccttcaacaactactacgactgggtgcgccaggccccgggccagggcctcgagtgggtgagccggatctccagctccggggaccccacctggtacgccgacagcgtcaagggccgcttcaccatctcccgggagaacgccaagaacaccctgttcctgcagaacagcctccgcgccgaggacaccgcggtgtactactgcgcctccctgaccacggggagcgactcctggggccagggggtgctggtcaccgtgagctccgccagcaccaagggcccctccgtgttccccctcgccccgagctccaagagcaccagcggcgggacggcggccctgggctgcctggtcaaggactacttccccgagcccgtgaccgtgtcctggaacagcggggccctcacctccggcgtccacaccttccccgccgtgctgcagagctccggcctgtacagcctctccagcgtggtcacggtgccgtccagctccctggggacccagacctacatctgcaacgtgaaccacaagcccagcaacaccaaggtcgacaagaaggtggagcccaagtcctgcgacaagacgcacacgtgcccgccctgccccgcccccgagctgctcggcgggcccagcgtgttcctgttcccgcccaagcccaaggacaccctgatctcccggacccccgaggtgacctgcgtcgtggtcgacgtgagccacgaggacccggaggtcaagttcaactggtacgtggacggcgtggaggtccacaacgcgaagaccaagccccgcgaggagcagtacaactccacctaccgggtggtgagcgtcctcaccgtgctgcaccaggactggctgaacgggaaggagtacaagtgcaaggtgtccaacaaggccctccccgcccccatcgagaagacgatcagcaaggccaagggccagccgcgcgagccccaggtctacaccctgccgcccagccgggacgagctgaccaagaaccaggtgtccctgacctgcctcgtgaagggcttctaccccagcgacatcgccgtcgagtgggagtccaacgggcagcccgagaacaactacaagacgacgcccccggtgctggacagcgacggctccttcttcctctacagcaagctgaccgtggacaagtcccgctggcagcaggggaacgtcttcagctgctccgtgcacgaggcgctgcacaaccactacacccagaagtccctcagcctgagccccggcaag

SEQ ID NO: 7983 - RNA, 639 nt, synthetic construct
  misc_feature 1..639: note = derived and/or modified sequence opt1 from Goilixiab_LightChain1
  source 1..639: mol_type = other RNA
gacatccagacccagagcccctccagcctgtccgccagcgtgggcgaccgcgtcaccatcacgtgccgggcctcccaggacatccgctactacctcaactggtaccagcagaagccggggaaggcgcccaagctgctgatctacgtggccagctccctccagagcggcgtgccctcccggttcagcgggtccggcagcgggaccgagttcaccctgaccgtctccagcctgcagcccgaggacttcgccacgtactactgcctccaggtgtactccaccccgcgcaccttcggccagggcaccaaggtggagatcaagcggacggtcgccgcccccagcgtgttcatcttcccgccctccgacgagcagctcaagagcgggaccgcgtccgtggtctgcctgctgaacaacttctacccccgcgaggccaaggtgcagtggaaggtggacaacgccctgcagagcggcaacagccaggagtccgtcaccgagcaggacagcaaggactccacctacagcctgtccagcacgctcaccctgtccaaggccgactacgagaagcacaaggtgtacgcgtgcgaggtgacccaccaggggctgagctcccccgtcaccaagagcttcaaccggggcgagtgc

SEQ ID NO: 7984 - RNA, 1338 nt, synthetic construct
  misc_feature 1..1338: note = derived and/or modified sequence opt1 from Guselkumab_HeavyChain1
  source 1..1338: mol_type = other RNA
gaggtgcagctggtccagagcggcgccgaggtgaagaagcccggggagtccctcaagatcagctgcaagggctccgggtacagcttctccaactactggatcggctgggtgcgccagatgcccgggaagggcctggagtggatgggcatcatcgaccccagcaactcctacacccggtacagcccctccttccaggggcaggtcaccatcagcgccgacaagtccatcagcacggcgtacctgcagtggtccagcctcaaggcctccgacaccgccatgtactactgcgcccgctggtactacaagcccttcgacgtgtggggccaggggaccctggtgaccgtcagctccgccagcacgaagggcccgtccgtgttccccctggcgcccagcagcaagtccaccagcgggggcaccgccgccctcggctgcctggtgaaggactacttccccgagccggtcaccgtgtcctggaacagcggggccctgacgtccggcgtgcacaccttccccgcggtcctccagagctccgggctgtacagcctgtccagcgtggtgaccgtcccctccagctccctcggcacccagacgtacatctgcaacgtgaaccacaagcccagcaacaccaaggtggacaagaaggtcgagccgaagtcctgcgacaagacccacacgtgcccgccctgccccgcccccgagctgctgggcgggcccagcgtgttcctcttcccgcccaagcccaaggacaccctgatgatctcccggacccccgaggtgacctgcgtcgtggtggacgtcagccacgaggaccccgaggtgaagttcaactggtacgtcgacggcgtggaggtgcacaacgccaagaccaagccccgcgaggagcagtacaactccacgtaccgggtcgtgagcgtgctgaccgtcctccaccaggactggctgaacgggaaggagtacaagtgcaaggtgagcaacaaggccctgccggcccccatcgagaagaccatctccaaggcgaagggccagccccgcgagccccaggtgtacaccctcccgcccagccgggacgagctgacgaagaaccaggtctccctgacctgcctcgtgaaggggttctaccccagcgacatcgccgtggagtgggagtccaacggccagccggagaacaactacaagaccaccccgcccgtcctggacagcgacggctccttcttcctgtacagcaagctcacggtggacaagtcccgctggcagcaggggaacgtgttcagctgctccgtcatgcacgaggccctgcacaaccactacacccagaagtccctgagcctcagccccggc

SEQ ID NO: 7985 - RNA, 651 nt, synthetic construct
  misc_feature 1..651: note = derived and/or modified sequence opt1 from Guselkumab_LightChain1
  source 1..651: mol_type = other RNA
cagagcgtgctgacccagcccccgtccgtcagcggcgcccccgggcagcgcgtgaccatctcctgcacgggcagctccagcaacatcgggtccggctacgacgtgcactggtaccagcagctccccgggaccgcccccaagctgctgatctacggcaacagcaagcggccgtccggcgtccccgaccgcttcagcgggtccaagagcggcacctccgcgagcctcgccatcaccgggctgcagtccgaggacgaggccgactactactgcgccagctggacggacggcctgtccctcgtggtgttcgggggcggcaccaagctgaccgtcctggggcagcccaaggccgcgcccagcgtgaccctcttcccgccctccagcgaggagctgcaggccaacaaggccacgctggtgtgcctcatcagcgacttctaccccggcgccgtcaccgtggcgtggaaggccgactccagccccgtgaaggccggggtcgagaccaccacgccgtccaagcagagcaacaacaagtacgccgcctccagctacctgtccctgacccccgagcagtggaagtcccaccggagctacagctgccaggtgacccacgagggctccaccgtggagaagacggtcgcgcccaccgagtgcagc

SEQ ID NO: 7986 - RNA, 360 nt, synthetic construct
  misc_feature 1..360: note = derived and/or modified sequence opt1 from HuMab-001_HeavyChain_VDJ-Region
  source 1..360: mol_type = other RNA
caggtgcagctgcagcagtggggcgccgggctcctgaagcccagcgagaccctgtccctgacctgcgccgtctacggcgggagcttctccggctactactggaactggatccgccagccgcccgggaagggcctcgagtggatcggcgagatcaaccacagcgggtccacgaactacaaccccagcctgaagtcccgggtgaccatcagcgtggacacctccaagaaccagttcagcctcaagctgtccagcgtcaccgcggccgacacggccgtgtactactgcgcccgcggcaactacgggtccggctactactacttcgacctgtgggggcggggcacccaggtgaccgtcagctcc

SEQ ID NO: 7987 - RNA, 321 nt, synthetic construct
  misc_feature 1..321: note = derived and/or modified sequence opt1 from HuMab-001_LightChain_VJ-Region
  source 1..321: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatcttcgccgcctccagcctgcagtccggcgtgcccagccgcttctccgggagcggctccgggaccgacttcaccctcaccatcagctccctgcagcccgaggacttcgccacgtactactgccagcagtacatcagcttcccgatcaccttcggccagggcacccggctggagatcaag

SEQ ID NO: 7988 - RNA, 366 nt, synthetic construct
  misc_feature 1..366: note = derived and/or modified sequence opt1 from HuMab-005_HeavyChain_gamma-Chain_VDJ-Region
  source 1..366: mol_type = other RNA
gaggtgcagctggtccagagcggcgccgaggtgaagaagcccggggagtccctcaagatcagctgcaaggcctccggctacagcttccacttctactggatcgggtgggtgcgccagatgccgggcaaggggctggagtggatgggctccatctaccccggcgacagcgacacccggtaccgcccctccttccaggggcaggtcaccatcagcgcggacaagtccatcagcacggcctacctgcagtggacctccctcaaggccagcgacaccgccatctactactgcgcccggcagcgcggcgactactactacttctacgggatggacgtgtggggccaggggaccacggtgaccgtctccagc

SEQ ID NO: 7989 - RNA, 321 nt, synthetic construct
  misc_feature 1..321: note = derived and/or modified sequence opt1 from HuMab-005_LightChain_VJ-Region
  source 1..321: mol_type = other RNA
gagatcgtgctgacccagagccccggcaccctctccctgagcccgggggagcgcgccacgctgtcctgccgggccagccagtccgtcagctccagctacctcgcgtggtaccagcagaagcccggccaggtgccccgcctgctgatctacggggcctccagccgggccaccggcatccccgaccgcttctccgggagcggctccggcaccgacttcaccctcacgatcagccggctggagccggaggacttcgccgtgtactactgccagcagtacgggtccagcctgaccttcggcgggggcaccaaggtcgagatcaag

SEQ ID NO: 7990 - RNA, 357 nt, synthetic construct
  misc_feature 1..357: note = derived and/or modified sequence opt1 from HuMab-006_HeavyChain_VDJ-Region
  source 1..357: mol_type = other RNA
gaggtgcagctgctcgagagcggcgggggcctggtccagcccgggggctccctgcgcctcagctgcgccgcctccgggttcaccttcagcaactacgcgctgatctgggtgcggcaggccccgggcaagggcctggagtgggtgtccatcatccgcgggggcgccgggagcacctactacgccgactccgtcaagggccggttcacgatcagccgcgacaactccaagaacaccctctacctgcagatgaacagcctgcgggccgaggacaccgcggtgtactactgcgccaaggcccgcatctgggggcccctcttcgactactggggccagggcaccctggtgacggtctccagc

SEQ ID NO: 7991 - RNA, 324 nt, synthetic construct
  misc_feature 1..324: note = derived and/or modified sequence opt1 from HuMab-006_LightChain_VJ-Region
  source 1..324: mol_type = other RNA
gagatcgtgctgacccagagccccgccaccctctccctgagccccggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggccgcccctgaccttcggcggcgggaccaaggtggagatcaag

SEQ ID NO: 7992 - RNA, 360 nt, synthetic construct
  misc_feature 1..360: note = derived and/or modified sequence opt1 from HuMab-019_HeavyChain_VDJ-Region
  source 1..360: mol_type = other RNA
caggtgcagctgcagcagtggggcgccgggctcctgaagcccagcgagaccctgtccctgacctgcgccgtctacggcgggagcttctccgactactactggaactggatccgccagccgcccggcaaggggctggagtggatcggcgagatccaccacgtgggcagcacgaactacaacccctccctcaagagccgggtgaccatctccgtcgacaccagcaagtcccagttcagcctcaagctgtccagcgtgaccgcggccgacacggccgtgtactactgcgcccgcgggtactacgactccggcgtctactacttcgactactgggcccaggggaccctggtgaccgtgagctcc

SEQ ID NO: 7993 - RNA, 360 nt, synthetic construct
  misc_feature 1..360: note = derived and/or modified sequence opt1 from HuMab-021_HeavyChain_VDJ-Region
  source 1..360: mol_type = other RNA
caggtgcagctgcagcagtggggcgccgggctcctgaagcccagcgagaccctgtccctgacctgcgccgtctacggcgggagcttctccgactactactggaactggatccgccagccgcccggcaaggggctcgagtggatcggcgagatccaccacagcggctccacgaactacaaccccagcctgaagtcccgggtgaccatcagcgtggacacctccaagaaccagttcagcctcaagctgtccagcgtcaccgcggccgacacggccgtgtactactgcgcccgcgggtactacgcctccggcgtgtactacttcgactactgggggcagggcaccctggtcaccgtgagctcc

SEQ ID NO: 7994 - RNA, 321 nt, synthetic construct
  misc_feature 1..321: note = derived and/or modified sequence opt1 from HuMab-021_LightChain_VJ-Region
  source 1..321: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccgcctccagcctgcagtccggcgtgcccagccgcttctccgggagcggctccgggaccgacttcaccctcaccatcagctccctgcagcccgaggacttcgccacgtactactgccagcagtacaacagctacccgatcaccttcggccagggcacccggctggagatcaag

SEQ ID NO: 7995 - RNA, 360 nt, synthetic construct
  misc_feature 1..360: note = derived and/or modified sequence opt1 from HuMab-025_HeavyChain_VDJ-Region
  source 1..360: mol_type = other RNA
caggtgcagctgcagcagtggggcgccgggctcctgaagcccagcgagaccctgtccctgacctgcgccgtctacggcgggagcttctccgactactactggaactggatccgccagccgcccggcaaggggctcgagtggatcggcgagatccaccacagcggctccacgaactacaaccccagcctgaagtcccgggtgaccatcagcgtggacacctccaagaaccagttcagcctcaagctgtccagcgtcaccgcggccgacacggccgtgtactactgcgcccgcgggtactacgactccggcgtgtactacttcgactactgggcccaggggaccctggtcaccgtgagctcc

SEQ ID NO: 7996 - RNA, 321 nt, synthetic construct
  misc_feature 1..321: note = derived and/or modified sequence opt1 from HuMab-025_LightChain_VJ-Region
  source 1..321: mol_type = other RNA
gacatccagatgacccagagcccctccagcctgtccgccagcgtgggcgaccgcgtcaccatcacgtgccgggcctcccaggggatcagccgctggctcgcgtggtaccagcagaagccggagaaggcccccaagtccctgatctacgccgccagctccctgcggagcggcgtgccctcccgcttcagcgggtccggcagcgggaccgacttcaccctcaccatctccagcctgcagcccgaggacttcgccacgtactactgccagcagtacaactcctacccgatcaccttcggccagggcacccggctggagatcaag

SEQ ID NO: 7997 - RNA, 360 nt, synthetic construct
  misc_feature 1..360: note = derived and/or modified sequence opt1 from HuMab-027_HeavyChain_VDJ-Region
  source 1..360: mol_type = other RNA
caggtgcagctgcagcagtggggcgccgggctcctgaagcccagcgagaccctgtccctgacctgcgccgtctacggcgggagcttctccgactacttctggaactggatccgccagccgcccggcaaggggctcgagtggatcggcgagatccaccacagcggctccacgaactacaaccccagcctgaagtcccgggtgaccatcagcgtggacacctccaagaaccagttcagcctcaacctgtccagcgtcaccgcggccgacacggccgtgtactactgcgcccgcgggctgatcggctccgggtactactacttcgactactgggaccagggcaccctcgtgaccgtcagctcc

SEQ ID NO: 7998 - RNA, 360 nt, synthetic construct
  misc_feature 1..360: note = derived and/or modified sequence opt1 from HuMab-032_HeavyChain_VDJ-Region
  source 1..360: mol_type = other RNA
caggtgcagctgcagcagtggggcgccgggctcctgaagcccagcgagaccctgtccctgacctgcgccgtctacggcgggagcttctccggctactactggagctggatccgccagccgcccgggaagggcctcgagtggatcggcgagatcaaccactccggggacacgaactacaaccccagcctgacctcccgggtgaccatcagcgtggacacctccaagaaccagttcagcctcaagctgtccagcgtcacggcggccgacaccgccgtgtactactgcgcccgcctgttctacggctccgggatctactacttcgactactggggccaggggaccctcgtgaccgtcagctcc

SEQ ID NO: 7999 - RNA, 321 nt, synthetic construct
  misc_feature 1..321: note = derived and/or modified sequence opt1 from HuMab-032_LightChain_VJ-Region
  source 1..321: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccaccttccgcctgcagtccggcgtgcccagccggttctccgggagcggctccgggaccgacttcaccctcacgatcagctccctgcagcccgaggacttcgccacctactactgccagcagtacaacagcttcccgcccaccttcggccagggcaccaaggtggagatcaag

SEQ ID NO: 8000 - RNA, 363 nt, synthetic construct
  misc_feature 1..363: note = derived and/or modified sequence opt1 from HuMab-033_HeavyChain_VDJ-Region
  source 1..363: mol_type = other RNA
caggtgcagctggtcgagagcggcgggggcgtggtgcagaccgggcgctccctccggctgagctgcgccgcctccggcttcaccttcagctcccacgcgatgcactgggtccgccaggcccccgggaagggcctggagtgggtggccgccatcagctacgacggctccaacaagtactacgccgacagcgtgaaggggcggttcacgatctcccgcgacaacagcaagaacaccctctacctgcagatgaactccctgcgggcggaggacaccgccgtctactactgcgcccgcggcgactacatcagctccagcggggtgttcgactactggggccaggggaccctcgtgacggtctccagc

SEQ ID NO: 8001 - RNA, 360 nt, synthetic construct
  misc_feature 1..360: note = derived and/or modified sequence opt1 from HuMab-035_HeavyChain_VDJ-Region
  source 1..360: mol_type = other RNA
caggtgcagctgcagcagtggggcgccgggctcctgaagcccagcgagaccctgtccctgacctgcgccatctacggcgggagcttctccggctactactggagctggatccgccagccgcccgggaagggcctcgagtggatcggcgagatcaaccactccggggacacgaactacaaccccagcctgacctcccgggtcaccatcagcgtggacacctccaagaaccagttcagcctcaagctgtccagcgtgacggcggccgacaccgccgtctactactgcgcccgcctgttctacggctccgggatctactacttcgactactggggccaggggaccctcgtgaccgtgagctcc

SEQ ID NO: 8002 - RNA, 360 nt, synthetic construct
  misc_feature 1..360: note = derived and/or modified sequence opt1 from HuMab-036_HeavyChain_VDJ-Region
  source 1..360: mol_type = other RNA
caggtgcagctgcagcagtggggcgccgggctcctgaagcccagcgagaccctgtccctgacctgcgccgtctacggcgggagcttctccgactactactggagctggatccgccagccgcccggcaaggggctggagtggatcggcgagatcaaccactccggcagcacgaactacaacccctccctcaagagccgggtgaccatctccgtggacaccagcaagaaccagttctccctcaagctgagctccgtcaccgcggccgacacggccgtgtactactgcgcccgcctgtactacgggagcggcacctactacttcgactactgggggcagggcaccctcgtgaccgtctccagc

SEQ ID NO: 8003 - RNA, 321 nt, synthetic construct
  misc_feature 1..321: note = derived and/or modified sequence opt1 from HuMab-036_LightChain_VJ-Region
  source 1..321: mol_type = other RNA
gacatccagatgacccagagcccctccagcctgtccgccagcgtgggcgaccgcgtcaccatcacgtgccgggcctcccaggggatcagctcctggctcacctggtaccagcagaagccggagaaggcgcccaagagcctgatctacgccgcctcccgcctgcagagcggcgtgccctcccggttcagcgggtccggcagcgggaccgacttcaccctcacgatctccagcctgcagcccgaggacttcgccacctactactgccagcagtacaactccttcccgcccaccttcggccagggcaccaaggtggagatcaag

SEQ ID NO: 8004 - RNA, 366 nt, synthetic construct
  misc_feature 1..366: note = derived and/or modified sequence opt1 from HuMab-041_HeavyChain_VDJ-Region
  source 1..366: mol_type = other RNA
gaggtgcagctggtccagagcggcgccgaggtgaagaagcccggggagtccctcaagatcagctgcaagggctccgggtacagcttcacctcctactggatcggctgggtgcgccagatgccggggaagggcctggagtggatgggcagcatctaccccggggactcccacacccggtaccgccccagcttccagggccaggtcacgatctccgccgacaagagcatctccaccgcgtacctgcagtggagctccctcaaggccagcgacaccgccatgtactactgcgcccggcagaagggggacttctactacttcttcggcctggacgtgtgggggcagggcaccgccatcacggtgtccagc

SEQ ID NO: 8005 - RNA, 366 nt, synthetic construct
  misc_feature 1..366: note = derived and/or modified sequence opt1 from HuMab-044_HeavyChain_VDJ-Region
  source 1..366: mol_type = other RNA
gaggtgcagctggtccagagcggcgccgaggtgaagaagcccggggagtccctcaagatcagctgcaagggctccgggtaccgcttcagctcctactggatcggctgggtgcggcagatgccggggaagggcctggagtggatgggcagcatcttccccggggactccgacacccgctacagcccctccttccagggccaggtcaccatcagcgccgacaagtccatcacgaccgcgtacctgcagtggagctccctcaaggccagcgacaccgccatgtactactgcgcccggcaggccggggactactactactacaacggcatggacgtgtgggggcagggcaccacggtgaccgtctccagc

SEQ ID NO: 8006 - RNA, 357 nt, synthetic construct
  misc_feature 1..357: note = derived and/or modified sequence opt1 from HuMab-049_HeavyChain_VDJ-Region
  source 1..357: mol_type = other RNA
gaggtgcagctgctcgagagcggcggggacctggtccagcccggcgggtccctgcgcctcagctgcgccgcctccggcttcaccttcagctcctacgcgatgagctgggtgcggcaggccccggggaagggcctggagtgggtgtccgccatcagcggccgcgggggcaccacgtactacgccgactccgtcaaggggcggttcaccatcagccgcgacaactccaagagcaccctgtgcctccagatgaactccctgcgggccgaggacaccgcggtgtactactgcgccaaggcccgcgccaactgggactacttcgactactggggccaggggacgctggtgaccgtcagctcc

SEQ ID NO: 8007 - RNA, 321 nt, synthetic construct
  misc_feature 1..321: note = derived and/or modified sequence opt1 from HuMab-049_LightChain_VJ-Region
  source 1..321: mol_type = other RNA
gacatccagatgacccagagcccctccagcgtgtccgccagcgtcggcgaccgcgtgaccatcacgtgccgggcctcccaggggatcagctcctggctggcgtggtaccagcacaagccgggcaaggcccccaagctcctgatctacgccgccagcatcctgcagtccggggtgcccagccgcttctccggcagcgggtccggcaccgacttcaccctcaccatcagctccctgcggcccgaggacttcgccacgtactactgccagcaggcgaacagcttcccgatcaccttcggccaggggacccgcctggagatcaag

SEQ ID NO: 8008 - RNA, 357 nt, synthetic construct
  misc_feature 1..357: note = derived and/or modified sequence opt1 from HuMab-050_HeavyChain_VDJ-Region
  source 1..357: mol_type = other RNA
gaggtgcagctgctcgagagcggcgggggcctggtccagcccgggggctccctgcgcctcagctgcgccgcctccgggttcaccttcagctcctacgcgatgaactgggtgcggcaggccccgggcaagggcctggagtgggtgagcgccatctccgggcgcggcgggaccacgtactacgccgacagcgtcaagggccggttcaccatctcccgcgacaacagcaagaacaccctgtacctccagatgtccagcctgcgggccgaggacaccgcggtgtactactgcgccaaggcccgcgccaactgggactacttcgactactgggggcagggcacgctggtgaccgtctccagc

SEQ ID NO: 8009 - RNA, 321 nt, synthetic construct
  misc_feature 1..321: note = derived and/or modified sequence opt1 from HuMab-050_LightChain_VJ-Region
  source 1..321: mol_type = other RNA
gacatccagatgacccagagcccctccagcgtgtccgccagcgtcggcgaccgcgtgaccatcacgtgccgggcctcccaggggatcagctcctggctggcgtggtaccagcacaagccgggcaaggcccccaagctcctgatctacgccgccagcatcctgcagtccggggtgcccagccgcttctccggcagcgggtccggcaccgacttcaccctcaccatcagctccctgcagcccgaggacttcgccacgtactactgccagcaggcgaacagcttcccgatcaccttcggccaggggacccggctggagatcaag

SEQ ID NO: 8010 - RNA, 360 nt, synthetic construct
  misc_feature 1..360: note = derived and/or modified sequence opt1 from HuMab-054_HeavyChain_VDJ-Region
  source 1..360: mol_type = other RNA
caggtgcagctgcagcagtggggcgccgggctcctgaagcccagcgagaccctgtccctgacctgcgccgtctacggcgggagcttctccggctactactggagctggatccgccagccgcccgggaagggcctggagtggatcggcgagatccaccactccgggagcacgaactacaacccctccctcaagagccgggtgaccatctccgtggacaccagcaagaaccagttctccctcaagctgagctccgtcaccgcggccgacacggccgtgtactactgcgcccgcctgtggtacggcagcgggtcctactacttcgactactggggccaggggaccctcgtgaccgtcagctcc

SEQ ID NO: 8011 - RNA, 321 nt, synthetic construct
  misc_feature 1..321: note = derived and/or modified sequence opt1 from HuMab-054_LightChain_VJ-Region
  source 1..321: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccgcctccagcctgcagtccggcgtgcccagccgcttctccgggagcggctccgggaccgacttcaccctcaccatcagctccctgcagcccgaggacttcgccacgtactactgccagcagtacaacagcttcccgcccaccttcggcggcgggaccaaggtggagatcaag

SEQ ID NO: 8012 - RNA, 357 nt, synthetic construct
  misc_feature 1..357: note = derived and/or modified sequence opt1 from HuMab-055_HeavyChain_VDJ-Region
  source 1..357: mol_type = other RNA
gaggtgcagctgctcgagagcggcgggggcctggtccagcccgggggctccctgcgcctcagctgcgccgcctccgggttcaccttcagctcctacgcgatgaactgggtgcggcaggccccgggcaagggcctggagtgggtgagcgccatctccgggcgcggcgggaccacgtactacgccgacagcgtcaagggccggttcaccatctcccgcgacaacagcaagtccaccctgtgcctccagatgaacagcctgcgggccgaggacaccgcggtgtactactgcgccaaggcccgcgccaactgggactacttcgactactgggggcagggcacgctggtgaccgtctccagc

SEQ ID NO: 8013 - RNA, 366 nt, synthetic construct
  misc_feature 1..366: note = derived and/or modified sequence opt1 from HuMab-059_HeavyChain_VDJ-Region
  source 1..366: mol_type = other RNA
caggtgcagctggtccagagcggcgccgaggtgaagaagcccggggcctccgtgcgcgtcccgtgcaaggcgagcggctacaccttcacccggtacgggatctcctgggtgcgccaggcccccggccaggggctcgagtggatgggctggatcagcgcctacaacggcaagacgtactacgcccagaagctgcaggggcgggtgaccatgaccaccgacacgtccaccagcaccgcctacatggagctgcgctccctccggagcgacgacaccgcggtctactactgcgcccgcagccccctgctgtggttcgaggagctctacttcgactactggggccaggggacgctggtgaccgtgtcctcc

SEQ ID NO: 8014 - RNA, 324 nt, synthetic construct
  misc_feature 1..324: note = derived and/or modified sequence opt1 from HuMab-059_LightChain_VJ-Region
  source 1..324: mol_type = other RNA
gagatcgtgctgacccagagccccggcaccctctccctgagcccgggggagcgcgccacgctgtcctgccgggccagccagtccgtcagctccacctacctcgcctggtaccagcagaagcccggccaggcgccccgcctgctgatctacggggccagctcccgggccaccggcatccccgaccgcttcagcgggtccggcagcggcaccgacttcacgctcaccatctcccggctggagccggaggacttcgccgtgtactactgccagcagtacgggaccagcctgttcaccttcggccccgggacgaaggtggacatcaag

SEQ ID NO: 8015 - RNA, 366 nt, synthetic construct
  misc_feature 1..366: note = derived and/or modified sequence opt1 from HuMab-060_HeavyChain_VDJ-Region
  source 1..366: mol_type = other RNA
gaggtgcagctggtccagagcggcgccgaggtgaagaagcccggggagtccctcaagatcagctgcaagggctccgggtaccgcttcaccagctactggatcggctgggtgcggcagatgccggggaagggcctggagtggatgggctccatctaccccggggacagctacacccgcaactcccccagcttccagggccaggtcacgatctccgccgacaagagcatcgcgaccgcctacctgcagtggaactccctcaaggccagcgacaccgccatgtactactgcgcccggcacgcgggggacttctactacttcgacggcctggacgtgtgggggcagggcaccacggtgaccgtctccagc

SEQ ID NO: 8016 - RNA, 327 nt, synthetic construct
  misc_feature 1..327: note = derived and/or modified sequence opt1 from HuMab-060_LightChain_VJ-Region
  source 1..327: mol_type = other RNA
gagatcgtgctgacccagagccccggcaccctctccctgagccccggggagcgcgccacgctgtcctgccgggccagccagtccgtcagctccagctacctcgcctggtaccagcagaagcccggccaggcgccccgcctgctgatctacggggcctccagccgggccaccggcatccccgaccgcttctccgggagcggctccggcaccgacttcaccctcacgatcagccggctggagccggaggacttcgccgtgtactactgccagcagtacgggtccagcccgcccatcaccttcggccaggggacccgcctggagatcaag

SEQ ID NO: 8017 - RNA, 366 nt, synthetic construct
  misc_feature 1..366: note = derived and/or modified sequence opt1 from HuMab-067_HeavyChain_VDJ-Region
  source 1..366: mol_type = other RNA
gaggtgcagctggtccagagcggcgccgaggtgaagaagcccggggagtccctcaagatcagctgcaagggctccgggtacagcttcacctcctactggatcggctgggtgcgccagatgccggggaagggcctggagtggatgggcatcatctaccccggggacagcgacacccggtactcccccagcttccagggccaggtcacgatctccgtggacaagagcatctccaccgcctacctgcagtggagctccctcaaggcgagcgacaccgccatgtactactgcgcccgccagaagggggactactactaccactacggcctggacgtgtgggggcagggcaccacggtcaccgtgtccagc

SEQ ID NO: 8018 - RNA, 366 nt, synthetic construct
  misc_feature 1..366: note = derived and/or modified sequence opt1 from HuMab-072_HeavyChain_VDJ-Region
  source 1..366: mol_type = other RNA
gaggtgcagctggtccagagcggcgccgaggtgaagaagcccggggagtccctcaagatcagctgcaagggctccgggtacagcttcacctcctactggatcggctgggtgcgccagatgccggggaagggcctggagtggatgggcatcatctaccccggggacagcgacacccggtactcccccagcttccagggccaggtcacgatctccgccgacaagagcatctccaccgcgtacctgcagtggagctccctcaaggccagcgacaccgccatgtactactgcgcccgccagaagggggactactactacttcaacggcctggacgtgtgggggcagggcaccacggtgaccgtctccagc

SEQ ID NO: 8019 - RNA, 327 nt, synthetic construct
  misc_feature 1..327: note = derived and/or modified sequence opt1 from HuMab-072_LightChain_VJ-Region
  source 1..327: mol_type = other RNA
gagatcgtgctgacccagagccccggcaccctctccctgagcccgggggagcgcgccacgctgtcctgccgggccagccagtccgtcagctccagctacctcgcctggtaccagcagaagcccggccaggcgccccgcctgctgatctacggggcctccagccgggccaccggcatccccgaccgcttctccgggagcggctccggcaccgacttcaccctcacgatcagccggctggagccggaggacttcgccgtgtactactgccagcagtacgggtccagcccccgcctgaccttcggcgggggcaccaaggtggagatcaag

SEQ ID NO: 8020 - RNA, 363 nt, synthetic construct
  misc_feature 1..363: note = derived and/or modified sequence opt1 from HuMab-084_HeavyChain_VDJ-Region
  source 1..363: mol_type = other RNA
caggtgcagctggtccagagcggcgccgaggtgaagaagcccgggtccagcgtgaaggtctcctgcaaggccagcggcgggaccttccgcacctacgcgatcaactgggtgcggcaggccccgggccaggggctcgagtggatgggccgcatcaacacggtgctgggcatcgtcaaccacgcccagaagttccaggggcgggtgaccatcaccgccgacaagtccaccaacacggcctacatggagctgaacagcctccgctccgaggacaccgcggtgtactactgcgcccgggagaagggcgtcgactactactacgggatcgaggtgtggggccaggggaccaccgtgacggtcagctcc

SEQ ID NO: 8021 - RNA, 321 nt, synthetic construct
  misc_feature 1..321: note = derived and/or modified sequence opt1 from HuMab-084_LightChain_VJ-Region
  source 1..321: mol_type = other RNA
gacatccagatgacccagagcccctccagcgtgtccgccagcgtcggcgaccgcgtgaccatcacgtgccgggcctcccaggggatcagctcctggctggcgtggtaccagcacaagccgggcaaggcccccaagctcctgatctacgtggccagcaccctgcagtccggggtccccagccgcttctccggcagcgggtccggcaccgacttcaccctcacgatcagctccctgcagcccgaggacttcgccacctactactgccagcaggccaacagcttcccgctgaccttcggcgggggcaccaaggtggagatcaag

SEQ ID NO: 8022 - RNA, 360 nt, synthetic construct
  misc_feature 1..360: note = derived and/or modified sequence opt1 from HuMab-091_HeavyChain_VDJ-Region
  source 1..360: mol_type = other RNA
caggtgcagctgcagcagtggggcgccgggctcctgaagcccagcgagaccctgtccctgacctgcgccgtcagcggcgggtccttcagcggctactactggacgtggatccgccagccgcccgggaagggcctcgagtggatcggcgagatctaccactccggggacaccaactacaaccccagcctgaagtcccgggtgaccatcagcgtggacacctccaagaaccagttcagcctcaagctgtactccgtcacggcggccgacaccgccgtgtactactgcgcccgcctgtacttcggcagcgggatctactacctcgactactggggccaggggaccctggtgaccgtctccagc

SEQ ID NO: 8023 - RNA, 321 nt, synthetic construct
  misc_feature 1..321: note = derived and/or modified sequence opt1 from HuMab-091_LightChain_VJ-Region
  source 1..321: mol_type = other RNA
gacatccagatgacccagagcccctccagcctgtccgccagcgtgggcgaccgcgtcaccatcacgtgccgggcctcccaggggatcagctcctggctcgtgtggtaccagcagaagccggagaaggcgcccaagagcctgatctacgccgcctccagcctgcagtccggcgtgcccagccgcttctccgggagcggctccgggaccgacttcaccctcaccatcagctccctgcagcccgaggacttcgccacgtactactgccagcagtacaacagcttcccgcccaccttcggccagggcaccaaggtcgagatcaag

SEQ ID NO: 8024 - RNA, 366 nt, synthetic construct
  misc_feature 1..366: note = derived and/or modified sequence opt1 from HuMab-093_HeavyChain_VDJ-Region
  source 1..366: mol_type = other RNA
gaggtgcagctggtccagagcggcgccgaggtgaagaagcccggggagtccctcaagatcagctgcaagggctccgggtacagcttcacctcctactggatcggctgggtgcggcagatgccggggaagggcctggagtggatgggccggatctaccccggggacagcgacacccgctactcccccagcttccagggccaggtcacgatctccgccgacaagagcatcaccaccgcgtacctgcagtggtccagcctccgggcctccgacaccgccatgtactactgcgcccgccagcgcggggactactactacttcttcggcctggacatctgggggcagggcacgaccgtgaccgtgagcctg

SEQ ID NO: 8025 - RNA, 372 nt, synthetic construct
  misc_feature 1..372: note = derived and/or modified sequence opt1 from HuMab-098_HeavyChain_VDJ-Region
  source 1..372: mol_type = other RNA
gaggtgcagctgctcgagagcggcgggggcctggtccagcccgggggctccctgcgcctcagctgcgccgcctccgggttcaccttcagcaactacggcatgtcctgggtgcggcaggcgccgggcaaggggctggagtgggtgagcgccatctccggcagcgcctactccacctactacgccgacagcgtcaaggggcgcttcacgatctcccgggacaacagcaagaacaccctgtggctccagatgaactccctgcgcgccgaggacaccgcggtgtactactgcgccaaggcccactaccacggcagcgggtcctactacaccctgttcgactactggggccagggcacgctcgtgaccgtcagctcc

SEQ ID NO: 8026 - RNA, 321 nt, synthetic construct
  misc_feature 1..321: note = derived and/or modified sequence opt1 from HuMab-098_LightChain_VJ-Region
  source 1..321: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccgcctccagcctgcagtccggcgtgcccagccgcttctccgggagcggctccgggaccgacttcaccctcaccatcagctccctgcagcccgaggacttcgccacgtactactgccagcagtacaacagctacccgtacaccttcggccagggcaccaagctggagatcaag

SEQ ID NO: 8027 - RNA, 372 nt, synthetic construct
  misc_feature 1..372: note = derived and/or modified sequence opt1 from HuMab-100_HeavyChain_VDJ-Region
  source 1..372: mol_type = other RNA
gaggtgcagctgctcgagagcggcgggggcctggtccagcccgggggctccctgcgcctcagctgcgccgcctccgggttcaccttcaacaactacggcatgaactgggtgcggcaggcgccgggcaaggggctggagtgggtgagcgccatctccggcaccgggtacagcacgtactacgccgactccgtcaagggccgcttcaccatcagccgggacaactccaagaacaccctgtacctccagatgaacagcctgcgcgccgaggacaccgccgtgtactactgcgcgaaggcccactacttcgggtccggcagctactacacgctgttcgactactggggccaggggaccctcgtgaccgtctccagc

SEQ ID NO: 8028 - RNA, 372 nt, synthetic construct
  misc_feature 1..372: note = derived and/or modified sequence opt1 from HuMab-106_HeavyChain_VDJ-Region
  source 1..372: mol_type = other RNA
gaggtgcagctggtccagagcggcgccgaggtgaagaagcccggggagtccctcaagatcagctgcaagggctccgggtacagcttcacccgctactggatcggctgggtgcggcagatgccggggaagggcctggagtggatgggcatcatctaccccggggactccgacacccgctacagcccctccttccagggccaggtcacgatcagcgccgacaagtccatcagcaccgcgtacctgcagtggtccagcctcaaggcctccgacaccgccatgtactactgcgcccggctgaccggggaccgcggcttcgactactacagcgggatggacgtgtggggccagggcacgaccgtgaccgtctccagc

SEQ ID NO: 8029 - RNA, 321 nt, synthetic construct
  misc_feature 1..321: note = derived and/or modified sequence opt1 from HuMab-106_LightChain_VJ-Region
  source 1..321: mol_type = other RNA
gagatcgtgctgacccagagccccggcaccctctccctgagcccgggggagcgcgccacgctgtcctgccgggccagccagtccgtcagctccagctacctcgcctggtaccagcagaagcccggccaggcgccccgcctgctgatctacggggcctccagccgggccaccggcatccccgaccgcttctccgggagcggctccggcaccgacttcaccctcacgatcagccggctggagccggaggacttcgccgtgtactactgccagcagtacgggtccagcttcaccttcggccccgggaccaaggtggacatcaag

SEQ ID NO: 8030 - RNA, 351 nt, synthetic construct
  misc_feature 1..351: note = derived and/or modified sequence opt1 from HuMab_10F8_HeavyChain_V-Region
  source 1..351: mol_type = other RNA
caggtgcagctggtcgagagcggcgggggcgtggtgcagcccgggcgctccctccggctgagctgcaccgcctccggcttcaccttcagccactacgggatgtactgggtccgccaggccccgggcaagggcctggagtgggtggcggtgatctggtacgacgggtcctacgagtacaacgaggacagcgtcaagggccggttcacgatctcccgcgacaacagcaagaacaccctctacctgcagatgaactccctgcgggccgaggacaccgccgtgtactactgcgcccgcgaccgggtgggcctcttcgactactgggggcaggggaccctggtcacggtgagctcc

SEQ ID NO: 8031 - RNA, 408 nt, synthetic construct
  misc_feature 1..408: note = derived and/or modified sequence opt1 from HuMab_10F8_HeavyChain_V-Region_Precursor
  source 1..408: mol_type = other RNA
atggagttcggcctgagctgggtgttcctcgtcgccctgctgcgcggggtgcagtgccaggtgcagctcgtcgagtccggcgggggcgtggtgcagcccgggcggagcctgcgcctgtcctgcaccgccagcggcttcaccttctcccactacggcatgtactgggtccggcaggcgccggggaagggcctcgagtgggtggccgtgatctggtacgacgggagctacgagtacaacgccgactccgtcaagggccgcttcacgatcagccgggacaactccaagaacaccctgtacctgcagatgaacagcctccgcgccgaggacaccgccgtgtactactgcgcgcgggaccgcgtggggctgttcgactactggggccagggcaccctggtcacggtgtccagc

SEQ ID NO: 8032 - RNA, 321 nt, synthetic construct
  misc_feature 1..321: note = derived and/or modified sequence opt1 from HuMab_10F8_LightChain_V-Region
  source 1..321: mol_type = other RNA
gagatcgtgctgacccagagccccggcaccctctccctgagcccgggggagcgcgccacgctgtcctgccgggccagccagtccatcagctccagctacctcgcctggtaccagcagaagcccggccaggcgccccgcctgctgatctacgggccctccagccgggccaccggcatcccggaccgcttctccgggagcggctccggcaccgacttcaccctcacgatcagccggctggagcccgaggacttcgccgtctactactgccagcagtacgccgggtccctgaccttcggccccgggaccaaggtggacatcaag

SEQ ID NO: 8033 - RNA, 381 nt, synthetic construct
  misc_feature 1..381: note = derived and/or modified sequence opt1 from HuMab_10F8_LightChain_V-Region_Precursor
  source 1..381: mol_type = other RNA
atggagacccccgcccagctcctgttcctgctgctcctgtggctgccggacaccacgggcgagatcgtgctcacccagagccccgggaccctgtccctgagccccggcgagcgcgccaccctctcctgccgggcgagccagtccatcagctccagctacctggcctggtaccagcagaagcccgggcaggccccgcgcctgctcatctacggcccctccagccgggccacggggatccccgaccgcttctccggcagcggctccgggaccgacttcaccctgaccatcagccggctggagcccgaggacttcgccgtctactactgccagcagtacgcgggctccctcacgttcgggccgggcaccaaggtggacatcaag

SEQ ID NO: 8034 - RNA, 357 nt, synthetic construct
  misc_feature 1..357: note = derived and/or modified sequence opt1 from HuMab-111_HeavyChain_VDJ-Region
  source 1..357: mol_type = other RNA
caggtgcagctggtccagagcggcgccgaggtgaagaagcccgggtccagcgtgaaggtctcctgcaaggccagcggcgggaccttctccagctacggcatctcctgggtgcgccaggcgccggggcccggcctcgagtggatgggccggatcatccccatcctggggatcgccaactacgcccagaagttccagggccgcgtgaccatcacggccgacaagagcaccaacaccgcctacatggagctgtccagcctccggtccgaggacaccgcggtctactactgcgcccgcgaccaggagtacagctccaactggtactactgggggcagggcacgctggtgaccgtgagctcc

SEQ ID NO: 8035 - RNA, 321 nt, synthetic construct
  misc_feature 1..321: note = derived and/or modified sequence opt1 from HuMab-111_LightChain_VJ-Region
  source 1..321: mol_type = other RNA
gagatcgtgctgacccagagccccggcaccctctccctgagcccgggggagcgcgccacgctgtcctgccgggccagccagtccgtccgcagctcctacctcgcctggtaccagcagaagcccggccaggcgccccggctgctgatctacggggccagctcccgcgccaccggcatccccgaccggttcagcgggtccggcagcggcaccgacttcaccctcacgatctcccgcctggagccggaggacttcgccgtgtactactgccagctgtacgggagctcccccaccttcggccccgggaccaaggtggacatcaag

SEQ ID NO: 8036 - RNA, 363 nt, synthetic construct
  misc_feature 1..363: note = derived and/or modified sequence opt1 from HuMab-123_HeavyChain_VDJ-Region
  source 1..363: mol_type = other RNA
caggtgcagctggtccagagcggcgccgaggtgaagaagcccggggcctccgtgaaggtcagctgcaaggcggccggctacaccttcaccaactacgggatctcctgggtgcgccaggccccgggccaggccctcgagtggatggggtggatcacgacctacagctccaacaccatctacgcccagaagctgcagggccgggtgaccatgacgaccgacaccagcacctccacggcgtacatggagctgcgcagcctccggtccgacgacaccgccgtctactactgcgcccgcgaccgggtggtggtccgccccgactacttcgactactggggccaggggaccctggtgaccgtgagctcc

SEQ ID NO: 8037 - RNA, 321 nt, synthetic construct
  misc_feature 1..321: note = derived and/or modified sequence opt1 from HuMab-123_LightChain_VJ-Region
  source 1..321: mol_type = other RNA
gagatcgtgctgacccagagccccgccaccctctccctgagcccgggcgagcgcgccacgctgtcctgccgggcgagccagtccgtcagctcctacctcgcctggtaccagcagaagcccgggcaggcgccccgcctgctgatctacgacaccagcaaccgggccaccggcatccccgcccgcttctccgggagcggctccgggaccgacttcacgctcaccatcagctccctggagccggaggacttcgccgtgtactactgccagcagcggagccactggccccgcaccttcggccagggcaccaaggtggagatcaag

SEQ ID NO: 8038 - RNA, 363 nt, synthetic construct
  misc_feature 1..363: note = derived and/or modified sequence opt1 from HuMab-124_HeavyChain_VDJ-Region
  source 1..363: mol_type = other RNA
caggtgcagctggtccagagcggcgccgaggtgaagaagcccggggcctccgtgaaggtcagctgcaaggcggccggctacaccttcaccaactacgggatctcctgggtgcgccaggccccgggccaggggctcgagtggatgggctggatcatcacgtacaacggcaacaccatctacgcccagcggttccaggaccgcgtgaccatgaccacggacaccagcacctccaccgcctacatggagctgcggagcctgcgctccgacgacacggcggtctactactgcgcccgggaccgcatcatcgtgcggcccgactacttcgactactgggggcagggcaccctcgtgaccgtcagctcc

SEQ ID NO: 8039 - RNA, 372 nt, synthetic construct
  misc_feature 1..372: note = derived and/or modified sequence opt1 from HuMab-125_HeavyChain_VDJ-Region
  source 1..372: mol_type = other RNA
gaggtgcagctgctcgagagcggcgggggcctggtccagcccgggggctccctgcgcctcagctgcgccgcctccgggttcaccttcaccgactacgcgatgaactgggtgcggcaggccccgggcaagggcctggagtgggtgagcacgatctccgggagcggctacgccacctactacgccgactccgtcaaggggcgcttcaccatcagccgggacaactccaagaccacgctgtacctccagatgaacagcctgcgcgccgaggacaccgcggtgtactactgcgccaagggccacaccctggggtccggcagctactacaccctcttcgactactggggccaggggacgctggtgaccgtctccagc

SEQ ID NO: 8040 - RNA, 321 nt, synthetic construct
  misc_feature 1..321: note = derived and/or modified sequence opt1 from HuMab-125_LightChain_VJ-Region
  source 1..321: mol_type = other RNA
gacatccagatgacccagagcccctccagcctgtccgccagcgtgggcgaccgcgtcaccatcacgtgccgggcctcccaggggatcaacagctggctcgcgtggtaccagcagaagccggagaaggcccccaagtccctgatctacgccgccagctccctgcagagcggcgtgccctcccgcttcagcgggtccggcagcgggaccgacttcaccctcaccatctccagcctgcagcccgaggacttcgccacgtactactgccagcagtacaactcctacccgtacaccttcggccagggcaccaagctggagatcaag

SEQ ID NO: 8041 - RNA, 369 nt, synthetic construct
  misc_feature 1..369: note = derived and/or modified sequence opt1 from HuMab-127_HeavyChain_VDJ-Region
  source 1..369: mol_type = other RNA
gaggtgcagctggtccagagcggcgccgaggtgaagaagcccggggagtccctcaccatcagctgcaagggctccgggtacagcttctccatctactggatcggctgggtgcgccagatgccggggaagggcctggagtggatgggcatcatcttccccggggacagcgacatccggtactcccccagcttccagggccaggtcaccatctccgccgacaagagcatctccacggcgtacctgcagtggagctccctcaaggccagcgacaccgccatgtactactgcgcccgccagcccggggactggtccccgcggcactggtacttcgacctgtggggccgcgggaccctggtgaccgtgagctcc

SEQ ID NO: 8042 - RNA, 321 nt, synthetic construct
  misc_feature 1..321: note = derived and/or modified sequence opt1 from HuMab-127_LightChain_VJ-Region
  source 1..321: mol_type = other RNA
gtgatctggatgacccagagcccctccctgctcagcgcctccaccggcgaccgcgtcacgatcagctgccggatgtcccaggggatcagctcctacctggcctggtaccagcagaagccgggcaaggcgcccgagctgctcatctacgccgccagcaccctgcagtccggggtgcccagccgcttctccggcagcgggtccggcaccgacttcaccctgacgatcagctacctccagtccgaggacttcgccacctactactgccagcagtactacagcttccccctgaccttcggcgggggcaccaaggtggagatcaag

SEQ ID NO: 8043 - RNA, 357 nt, synthetic construct
  misc_feature 1..357: note = derived and/or modified sequence opt1 from HuMab-129_HeavyChain_VDJ-Region
  source 1..357: mol_type = other RNA
caggtgcagctggtcgagagcggcgggggcgtggtgcagcccgggcgctccctccggctgagctgcgccgcctccggcttcaccttcagcaccttcgcgatccactgggtccgccaggccccggggaagggcctggagtgggtggccgtgatctcctacgacggcgggcacaagttctacgccgacagcgtcaagggccggttcacgatctcccgcgacaacagcaagaacaccctctacctgcagatgaactccctgcgggccgaggacaccgcgatgtactactgcgcccgcgggctcggcgtgtggggcgccttcgactactgggggcagggcaccctggtgacggtcagctcc

SEQ ID NO: 8044 - RNA, 318 nt, synthetic construct
  misc_feature 1..318: note = derived and/or modified sequence opt1 from HuMab-129_LightChain_VJ-Region
  source 1..318: mol_type = other RNA
gagatcgtgctgacccagagccccgccaccctctccctgagcccgggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggtggaccttcggccagggcaccaaggtggagatcaag

SEQ ID NO: 8045 - RNA, 375 nt, synthetic construct
  misc_feature 1..375: note = derived and/or modified sequence opt1 from HuMab-132_HeavyChain_VDJ-Region
  source 1..375: mol_type = other RNA
caggtgcagctggtccagagcggcgccgaggtgaagaagcccggggcctccgtgaaggtcagctgcaaggcgtccggctacaccttcaccagctacgggatctcctgggtgcgccaggccccgggccaggggctcgagtggatgggctggatcagcgcctacaacggcaactccaactacgtgcagaagttccaggggcgggtcacgatgaccaccgacaccacgaccagcaccgcctacatggagctgcgctccctgaccagcgacgacacggccgtgtactactgcgcgcgggagtactcctacgacagcggcacctacttctactacgggatggacgtgtggggccaggggaccaccgtcacggtgtccagc

SEQ ID NO: 8046 - RNA, 324 nt, synthetic construct
  misc_feature 1..324: note = derived and/or modified sequence opt1 from HuMab-132_LightChain_VJ-Region
  source 1..324: mol_type = other RNA
gagatcgtgctgacccagagccccgccaccctctccctgagcccgggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggcccatgtacaccttcggccagggcaccaagctggagatcaag

SEQ ID NO: 8047 - RNA, 360 nt, synthetic construct
  misc_feature 1..360: note = derived and/or modified sequence opt1 from HuMab-143_HeavyChain_VDJ-Region
  source 1..360: mol_type = other RNA
caggtgcagctgcagcagtggggcgccgggctcctgaagcccagcgagaccctgtccctgacctgcgccgtctacggcgggagcttctccggctactactggaactggatccgccagccgcccgggaagggcctcgagtggatcggcgagatccaccacagcgggtccgcgaactacaaccccagcctgatgtcccgggtgacgatcagcgtggacacctccaagaaccagttcagcctccagctgtccagcgtcaccgccgccgacaccgccgtgtactactgcgcccgcggctactacgggtccggctactactacttcgactactgggggcagggcacgctggtgaccgtcagctcc

SEQ ID NO: 8048 - RNA, 321 nt, synthetic construct
  misc_feature 1..321: note = derived and/or modified sequence opt1 from HuMab-143_LightChain_VJ-Region
  source 1..321: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccgcctcccgcctgcagagcggcgtgccctcccggttcagcgggtccggcagcgggaccgacttcaccctcaccatctccagcctgcagcccgaggacttcgccacgtactactgccagcagtacaactcctacccgatcaccttcggccagggcacccgcctggagatcaag

SEQ ID NO: 8049 - RNA, 366 nt, synthetic construct
  misc_feature 1..366: note = derived and/or modified sequence opt1 from HuMab-150_HeavyChain_VDJ-Region
  source 1..366: mol_type = other RNA
gaggtgcagctggtccagagcggcgccgaggtgaagaagcccggggagtccctcaagatcagctgcaagggctccgggtacagcttcacctcctactggatcggctgggtgcgccagatgccggggaagggcctggagtggatgggcagcatctaccccggggactcccacacccggtaccgccccagcttccagggccaggtcacgatctccgccgacaagagcatctccaccgcgtacctgcagtggagctccctcaaggccagcgacaccgccatgtactactgcgcccggcaggccggggactactactactacaacggcatggacgtgtgggggcagggcaccacggtgaccgtctccagc

SEQ ID NO: 8050 - RNA, 321 nt, synthetic construct
  misc_feature 1..321: note = derived and/or modified sequence opt1 from HuMab-150_LightChain_VJ-Region
  source 1..321: mol_type = other RNA
gagatcgtgctgacccagagccccggcaccctctccctgagcccgggggagcgcgccacgctgtcctgccgggccagccagtccgtcagctccagctacctcacctggtaccagcagaagcccggccaggcgccccgcctgctgatctacggggcctccagccgggccaccggcatccccgaccgcttctccgggagcggctccggcaccgacttcacgctcaccatcagccggctggagccggaggacttcgccgtgtactactgccagcagtacgggtccagcctgaccttcggcgggggcaccaaggtggagatcaag

SEQ ID NO: 8051 - RNA, 363 nt, synthetic construct
  misc_feature 1..363: note = derived and/or modified sequence opt1 from HuMab-152_HeavyChain_VDJ-Region
  source 1..363: mol_type = other RNA
caggtgcaggtcgtggagagcggcgggggcgtggtccagcccgggcgctccctgcggctcagctgcgccgcctccggcttcaccttcagctcctacgcgatgcactgggtgcgccaggccccggggaagggcctggagtgggtggccgtcatcagctacgacggctcctacaagtactacgccgacagcgtgaaggggcggttcaccatctcccgcgacaacagcaagaacacgctgtacctccagatgaactccctgcgggccgaggacaccgcggtgtactactgcgcccgcggcagcatcaccgggtccaccggcgtcttcgactactgggggcagggcacgctggtgaccgtgagctcc

SEQ ID NO: 8052 - RNA, 321 nt, synthetic construct
  misc_feature 1..321: note = derived and/or modified sequence opt1 from HuMab-152_LightChain_VJ-Region
  source 1..321: mol_type = other RNA
gacatccagatgacccagagcccctccagcctgtccgccagcgtgggcgaccgcgtcaccatcacgtgccgggcctcccaggggatcaacagctggctcgcgtggtaccagcagaagccggagaaggcccccaagtccctgatctacgacgccagctccctgcagagcggcgtgccctcccgcttcagcgggtccggcagcgggaccgacttcaccctcaccatctccagcctgcagcccgagaacttcgccacgtactactgccagcagtacaactcctacccgatcaccttcggccagggcacccggctggagatcaag

SEQ ID NO: 8053 - RNA, 363 nt, synthetic construct
  misc_feature 1..363: note = derived and/or modified sequence opt1 from HuMab-153_HeavyChain_VDJ-Region
  source 1..363: mol_type = other RNA
caggtgcagctggtcgagagcggcgggggcgtggtgcagcccgggcgctccctccggctgagctgcgccgcctccggcttcaccttcagcgactacgtcatccactgggtgcgccaggcgccggggaagggcctggagtgggtgaccgtcatctcctacgacggcagcaacaagtactacgccgactccgtgaaggggcggttcacgatcagccgcgacaactccaagaacaccctctacctgcagatgaacagcctgtccgccgaggacaccgccatgtactactgcgcccggggcgggatcaccggcacgaccggggtgttcgactactggggccagggcaccctcgtcaccgtgagctcc

SEQ ID NO: 8054 - RNA, 321 nt, synthetic construct
  misc_feature 1..321: note = derived and/or modified sequence opt1 from HuMab-153_LightChain_VJ-Region
  source 1..321: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgacgcctccagcctgcagtccggcgtgcccagccgcttctccgggagcggctacgggaccgacttctccctcaccatcagctccctgcagcccgaggacttcgccatctactactgccagcagtacaagagctacccgatcaccttcggccagggcacgcggctggagatcaag

SEQ ID NO: 8055 - RNA, 378 nt, synthetic construct
  misc_feature 1..378: note = derived and/or modified sequence opt1 from HuMab-159_HeavyChain_VDJ-Region
  source 1..378: mol_type = other RNA
gaggtgcagctggtccagagcggcgccgaggtgaagaagcccggggagtccctcaagatcagctgcaagggctccgggtacaacttcaccagctactggatcggctgggtgcgccagatgccggggaagggcctggagtggatgggcatcatctaccccggggactccgacacccggtacagcccctccttccagggccaggtcacgatcagcgccgacaagtccatcagcaccgcgtacctgcagtggtccagcctcaaggcctccgacaccgccatgtactactgcgcccgctgggggacctactacgacatcctgacgggctacttcaactggttcgacccctgggggcagggcaccctggtgaccgtgagctcc

SEQ ID NO: 8056 - RNA, 321 nt, synthetic construct
  misc_feature 1..321: note = derived and/or modified sequence opt1 from HuMab-159_LightChain_VJ-Region
  source 1..321: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccgcctccagcctgcagtccggcgtgcccagccgcttctccgggagcggctccgggaccgacttcaccctcaccatcagctccctgcagcccgaggacttcgccacgtactactgccagcagtactacatctacccgtggaccttcggccagggcaccaaggtggagatcaag

SEQ ID NO: 8057 - RNA, 363 nt, synthetic construct
  misc_feature 1..363: note = derived and/or modified sequence opt1 from HuMab-160_HeavyChain_VDJ-Region
  source 1..363: mol_type = other RNA
caggtgcagctggtcgagagcggcgggggcgtggtgcagcccgggcgctccctccggctgagctgcgccgcctccggcttcaccttcagctcccacgcgatgcactgggtccgccaggccccggggaagggcctggagtgggtggccgccatcagctacgacggctccaacaagtactacgccgacagcgtgaaggggcggttcaccatctcccgcgacaacagcaagaacacgatgtacctccagatgaactccctgcgggcggaggacaccgccatgtgctactgcgcccgcggcagcatcaccgggtccaccggcgtcttcgactactgggggcagggcacgctggtgaccgtgagctcc

SEQ ID NO: 8058 - RNA, 321 nt, synthetic construct
  misc_feature 1..321: note = derived and/or modified sequence opt1 from HuMab-160_LightChain_VJ-Region
  source 1..321: mol_type = other RNA
gacatccagatgacccagagcccctccagcctgtccgccagcgtgggcgaccgcgtcaccatcacgtgccgggcctcccaggacatcagctcctggctcgcgtggtaccagcagaagccggagaaggcccccaagagcctgatctacgccgcctccagcctgcagtccggggtgcccagccgcttctccggcagcgggtccggcaccgacttcaccctcaccatcagctccctgcagcccgaggacttcgccacgtactactgccagcagtacaacagctacccgatcaccttcgggcagggcacccggctggagatcaag

SEQ ID NO: 8059 - RNA, 372 nt, synthetic construct
  misc_feature 1..372: note = derived and/or modified sequence opt1 from HuMab-162_HeavyChain_VDJ-Region
  source 1..372: mol_type = other RNA
gaggtgcagctgtgggagagcggcgggggctccgtccagcccgggggcagcctccgcctgtcctgcgccgccagcgggttcaccttctccagctacggcatgtcctgggtgcggcaggcgccgggcaaggggctggagtgggtgagcggcatctccgggagcggctactccacctactacgccgacagcgtcaaggggcgcttcacgatctcccgggacaacagcaagaacaccctctacctgcagatgaactccctgcgcgccgaggacaccgccgtgtactactgcgccaagggctactaccacggcagcgggtcctactacaccagcttcgactactggggccaggggacgctcgtgaccgtctccagc

SEQ ID NO: 8060 - RNA, 321 nt, synthetic construct
  misc_feature 1..321: note = derived and/or modified sequence opt1 from HuMab-162_LightChain_VJ-Region
  source 1..321: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccgcctccagcctgcagtccggcgtgcccagccgcttctccgggagcggctccgggaccgacttcaccctcaccatcagctccctgcagcccgaggacttcgccacgtactactgccagcagtacaacagctacccgctgaccttcggcggcgggaccaaggtggagatcaag

SEQ ID NO: 8061 - RNA, 366 nt, synthetic construct
  misc_feature 1..366: note = derived and/or modified sequence opt1 from HuMab-163_HeavyChain_VDJ-Region
  source 1..366: mol_type = other RNA
gaggtgcagctggtccagagcggcgccgaggtgaagaagcccggggagtccctcaagatcagctgccagggctccgggtaccggttcatcagctactggatcggctgggtgcggcagatgccggggaagggcctggagtggatgggccgcatctaccccggggactccgacacccggtacagcccctccttccagggccaggtcaccatcagcgtggacaagtccatcagcacggcctacctgcagtggtccagcctcaaggcgtccgacaccgccatgtactactgcgcccgccagcgcggggactactactacttcaacggcctggacgtgtgggggcagggcaccaccgtcacggtgagctcc

SEQ ID NO: 8062 - RNA, 321 nt, synthetic construct
  misc_feature 1..321: note = derived and/or modified sequence opt1 from HuMab-163_LightChain_VJ-Region
  source 1..321: mol_type = other RNA
gagatcgtgctgacccagagccccggcaccctctccctgagcccgggggagcgcgccacgctgtcctgccgggccagccagtccgtcagctccagctacctcgcctggtaccagcagaagcccggccaggcgccccgcctgctgatctacggggcctccagccgggccaccggcatccccgaccgcttctccgggagcggctccggcaccgacttcaccctcacgatcagccggctggagccggaggacttcgccgtgtactactgccagcagtacgggtccagcctgaccttcggcgggggcaccaaggtggagatcaag

SEQ ID NO: 8063 - RNA, 363 nt, synthetic construct
  misc_feature 1..363: note = derived and/or modified sequence opt1 from HuMab-166_HeavyChain_VDJ-Region
  source 1..363: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccgtgatcagctacgacggctccaacgagtactacgccgacagcgtcaaggggcggttcaccatctcccgcgacaacagcaagaacacgctctacctgcagatgaactccctgcgggccgaggacaccgcggtgtactactgcgcccgcggcagcatcatcgggtccaccggcgtgttcgactactgggggcagggcaccctcgtcacggtgagctcc

SEQ ID NO: 8064 - RNA, 321 nt, synthetic construct
  misc_feature 1..321: note = derived and/or modified sequence opt1 from HuMab-166_LightChain_VJ-Region
  source 1..321: mol_type = other RNA
gacatccagatgacccagagcccctccagcctgtccgccagcgtgggcgaccgcgtcaccatcacgtgccgggcctcccaggggatcagcaactggctcgcgtggtaccagcagaagccggagaaggcccccaagtccctgatctacgacgccagctccctgcagagcggcgtgccctcccgcttcagcgggtccggcagcgggaccgacttcaccctcaccatctccagcctgcagcccgaggacttcgccacgtactactgccagcagtacaactcctacccgatcaccttcggccagggcacccggctggagatcaag

SEQ ID NO: 8065 - RNA, 363 nt, synthetic construct
  misc_feature 1..363: note = derived and/or modified sequence opt1 from HuMab-167_HeavyChain_VDJ-Region
  source 1..363: mol_type = other RNA
caggtgcagctggtcgagagcggcgggggcgtggtgcagcccgggcgctccctccggctgagctgcgccgcctccggcttcaccttcagctcctacgcgatccactgggtccgccaggccccggggaagggcctggagtgggtggccgtgatcagctacgacggctccaacaagtactacgccgacagcgtcaaggggcggttcaccatctcccgcgacaacagcaagaacacgctctacctgcagatgaactccctgcgggccgaggacaccgcggtgtactactgcgcccgcggcagcatcaccgggtccaccggcgtgttcgactactgggggcagggcacgctcgtcaccgtgagctcc

SEQ ID NO: 8066 - RNA, 363 nt, synthetic construct
  misc_feature 1..363: note = derived and/or modified sequence opt1 from HuMab-169_HeavyChain_VDJ-Region
  source 1..363: mol_type = other RNA
caggtgcagctggtccagagcggcgccgaggtgaagaagcccggggcctccgtgaaggtcagctgcaaggcgtccggctacaccttcaccaactacgggatcagctgggtgcgccaggccccgggccaggggctcgagtggatgggctggctgtccgcctacagcggcaacacgatctacgcccagaagctgcaggggcgggtgaccatgaccaccgacacgtccaccaccaccgcctacatggagctccgcagcctgcggtccgacgacacggcggtctactactgcgcccgcgaccggatcgtggtgcgccccgactacttcgactactggggccaggggaccctggtcaccgtgagctcc

SEQ ID NO: 8067 - RNA, 321 nt, synthetic construct
  misc_feature 1..321: note = derived and/or modified sequence opt1 from HuMab-169_LightChain_VJ-Region
  source 1..321: mol_type = other RNA
gagatcgtgctgacccagagccccgccaccctctccctgagcccgggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggccccgcaccttcggccagggcaccaaggtggagatcaag

SEQ ID NO: 8068 - RNA, 366 nt, synthetic construct
  misc_feature 1..366: note = derived and/or modified sequence opt1 from HuMab-7D8_HeavyChain_VH-Region
  source 1..366: mol_type = other RNA
gaggtgcagctggtcgagagcggcgggggcctcgtgcagcccgaccgctccctgcggctgagctgcgccgcctccgggttcaccttccacgactacgcgatgcactgggtgcgccaggccccgggcaaggggctcgagtgggtcagcaccatctcctggaacagcggcacgatcggctacgccgactccgtgaaggggcggttcaccatcagccgcgacaacgccaagaactccctgtacctgcagatgaacagcctccgggccgaggacaccgcgctgtactactgcgccaaggacatccagtacggcaactactactacgggatggacgtgtggggccaggggaccacggtcaccgtgtccagc

SEQ ID NO: 8069 - RNA, 366 nt, synthetic construct; identical to SEQ ID NO: 8068
  misc_feature 1..366: note = derived and/or modified sequence opt1 from HuMab-7D8_HeavyChain_V-Region
  source 1..366: mol_type = other RNA

SEQ ID NO: 8070 - RNA, 321 nt, synthetic construct
  misc_feature 1..321: note = derived and/or modified sequence opt1 from HuMab-7D8_LightChain_VL-Region
  source 1..321: mol_type = other RNA
gagatcgtgctgacccagagccccgccaccctctccctgagcccgggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggcccatcaccttcggccagggcacccgcctggagatcaag

SEQ ID NO: 8071 - RNA, 321 nt, synthetic construct; identical to SEQ ID NO: 8070
  misc_feature 1..321: note = derived and/or modified sequence opt1 from HuMab-7D8_LightChain_V-Region
  source 1..321: mol_type = other RNA

SEQ ID NO: 8072 - RNA, 324 nt, synthetic construct
  misc_feature 1..324: note = derived and/or modified sequence opt1 from huMAb-anti-MSP10.1_LightChain_VJ-Region
  source 1..324: mol_type = other RNA
gagatcgtgctgacccagagccccgacatcctctccctgagcccgggcgagcgcgccaccctgtcctgccgggccagccaggcgctcacggccaagtacctggcctggtaccagcagaagcccgggcaggtcccccgcctgctcatctacggctccagcacccgggccaccgggatccccgaccgcttccggggctccgggagcggcaccgacttcacgctgaccatctcccgcctggagccggccgacagcgcggtgtactactgccagcagtacgaggactccccctggaccttcggccaggggaccaagctcgagatcaag

SEQ ID NO: 8073 - RNA, 324 nt, synthetic construct
  misc_feature 1..324: note = derived and/or modified sequence opt1 from huMAb-anti-MSP10.2_LightChain_VJ-Region
  source 1..324: mol_type = other RNA
gagatcgtgctgacccagagccccgacaccctctccctgagcccgggcgagacggccaccctgtcctgccgcgccagccagaccgtccggcgcaactccctcgcctggtaccagcagaagcccgggcaggcgccccggctgctgatctacggcgccagcgaccgcgccaccgggatccccgaccggttctccggcagcgggttcggcacggacttcaccctcaccgtgtccggcctggagccggaggacttcgccgtgtactactgccagcagtacgggaccagcccccgcacgttcggccaggggaccaagctggagatcaag

SEQ ID NO: 8074 - RNA, 324 nt, synthetic construct
  misc_feature 1..324: note = derived and/or modified sequence opt1 from HUMAB-Clone_18_VJ-Region
  source 1..324: mol_type = other RNA
gagatcgtgctgacccagagccccgccaccctctccctgagccccggcgagcgcgccacgctgtcctgccgggcgagccagtccgtcagctcctacctcgcctggtaccagcagaagcccgggcaggcgccccgcctgctgatctacgacgccagcaagcgggccaccggcatccccgcccgcttctccgggagcggctccgggaccgacttcaccctcacgatcagctccctggagccggaggacttcgccgtgtactactgccagcagcggagcaagtggccgccctggaccttcggccagggcaccaaggtggagtccaag

SEQ ID NO: 8075 - RNA, 324 nt, synthetic construct
  misc_feature 1..324: note = derived and/or modified sequence opt1 from HUMAB-Clone_22_VJ-Region
  source 1..324: mol_type = other RNA
gagatcgtgctgacccagagccccgccaccctctccctgagccccggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaagtggccgccctggaccttcggccagggcaccaaggtggagatcaag

SEQ ID NO: 8076 - RNA, 432 nt, synthetic construct
  misc_feature 1..432: note = derived and/or modified sequence opt1 from HuMab-L612_Chain_VDJ-Region_Precursor
  source 1..432: mol_type = other RNA
atggagttcggcctgacctggctgttcctcgtggccaacctgaagggggtccagtgcgaggtgcagctcctggacagcggcgggggcctggtgcagcccgggggctgcctccgcctgtcctgcgccgcgagcggcttcaccttctccagctgcgccatgtcctgggtccggcaggccccggggaagggcctggagtgggtgagcgccatctccgggagcggcgggtccacgtactacgccgacagcgtgaagggccgcttcaccatctcccgggacaagagcaagaacaccctctacctgcagatgaactccctgcgcgcggaggacaccgccgtctactactgcgccaagggcgggaacgacatcctcacgggctactacgcctgggggcagggcaccctggtgaccgtgagctccggcagcgcgtccgcc

SEQ ID NO: 8077 - RNA, 321 nt, synthetic construct
  misc_feature 1..321: note = derived and/or modified sequence opt1 from HuMab_LC5002-002_LightChain_V-Region
  source 1..321: mol_type = other RNA
gacatccagatgacccagagcccctccagcctgtccgccagcgtgggcgaccgcgtcaccatcacgtgccgggcctcccaggggatcagccgctgggtggcgtggtaccagcagaagccggagaaggcccccaagtccctcatctacgccgccagctccctgcagagcggcgtgccctcccggttcagcgggtccggcagcgggaccgacttcaccctgaccatctccagcctccagcccgaggacttcgccacgtactactgccagcagtacaactcctacccgtggaccttcggccagggcaccaaggtcgagatcaag

SEQ ID NO: 8078 - RNA, 357 nt, synthetic construct
  misc_feature 1..357: note = derived and/or modified sequence opt1 from HuMab_LC5002-002_gamma1-Chain_V-Region
  source 1..357: mol_type = other RNA
gaggtgcagctgctcgagagcggcgggggcctggtccagcccgggggctccctgcgcctcagctgcgccgcctccgggttcaccttcaacatctacgcgatgaactgggtgcggcaggccccgggcaagggcctggagtgggtgagcgtcatctccgggcgcggcatcaccacgtactacgccgacagcgtgaaggggcggttcaccatctcccgcgacaacagcaagaacaccctgtacctccagatgaactccctgcgggccgacgacaccgccgtgtactactgcgcgaagggcagctccagctggacggacttcgactactgggggcagggcaccctggtcaccgtgtccagc

SEQ ID NO: 8079 - RNA, 321 nt, synthetic construct
  misc_feature 1..321: note = derived and/or modified sequence opt1 from HuMab_LC5002-003_LightChain_V-Region
  source 1..321: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccgcctccagcctgcagtccggcgtgcccagccgcttctccgggagcggctccgggaccgacttcaccctcaccatcagctccctgcagcccgaggacttcgccacgtactactgccagcagtacaacagctacccgtggaccttcggccagggcaccaaggtggagatcaag

SEQ ID NO: 8080 - RNA, 357 nt, synthetic construct
  misc_feature 1..357: note = derived and/or modified sequence opt1 from HuMab_LC5002-003_gamma1-Chain_V-Region
  source 1..357: mol_type = other RNA
gaggtgcagctgctcgagagcggcggggacctgatccagcccggcgggtccctgcgcctcagctgcgccgcctccggcttcaccttcaacatctacgcgatgaactgggtccggcaggccccggggaagggcctggagtgggtgagcgtgatctccggccgcgggatcaccacgtactacgccgacagcgtcaagggccggttcaccatctcccgcgacaacagcaagaacaccctgtacctccagatggactccctgcgggccgaggacaccgccgtgtactactgcgcgaaggggagctcctactggacggacttcgactactggggccaggggaccctggtgaccgtcagctcc

SEQ ID NO: 8081 - RNA, 321 nt, synthetic construct
  misc_feature 1..321: note = derived and/or modified sequence opt1 from HuMab_LC5002-005_LightChain_V-Region
  source 1..321: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccgcctccagcctgcagtccggcgtgcccagccgcttctccgggagcggctccgggaccgacttcaccctcaccatcagctccctgcagcccgaggacttcgccacgtactactgccagcagtacaacagccacccgcccaccttcggccagggcaccaagctggagatcaag

SEQ ID NO: 8082 - RNA, 354 nt, synthetic construct
  misc_feature 1..354: note = derived and/or modified sequence opt1 from HuMab_LC5002-005_gamma1-Chain_V-Region
  source 1..354: mol_type = other RNA
gaggtgcaggtcctggacagcggcgggggcctcgtgcagcccgggggctccctgcgcctgagctgcaccgcctccgggttcaccttccggctctacacgatgagctgggtgcgccagaccccgggccggggcctggagtgggtctccgggatcagcggctccgggctgagcacctacttcgccgactccgtgaagggccgcttcaccatcagccgggacaactccaagaacacggtgtacctccagatgaacagcctgcgcgcggaggacaccgccgtctactactgcgccaaggagggggactggatctacttcgactcctggggccagggcaccctggtgatcgtgagctcc

SEQ ID NO: 8083 - RNA, 321 nt, synthetic construct
  misc_feature 1..321: note = derived and/or modified sequence opt1 from HuMab_LC5002-007_LightChain_V-Region
  source 1..321: mol_type = other RNA
gagatcgtgctgacccagagccccggcaccctctccctgagcccgggggagcgcgccacgctgtcctgccgggccagccagtccgtcagctccagctacctcgcctggtaccagcagaagcccggccaggcgccccgcctgctgatctacggggcctccagccgggccatcggcatccccgaccgcttctccgggagcggctccggcaccgacttcaccctcaccatcagccggctggagccggaggacttcgccgtgtactactgccagcactacgggtccagcctgacgttcggcgggggcaccaaggtggagatcaag

SEQ ID NO: 8084 - RNA, 369 nt, synthetic construct
  misc_feature 1..369: note = derived and/or modified sequence opt1 from HuMab_LC5002-007__gamma1-Chain_V-Region
  source 1..369: mol_type = other RNA
caggtgcagctggtccagagcggcgccgaggtgaagaagcccgggtccagcgtgaaggtctcctgcaaggtgagcggcgggaccttctccagctacgccttctcctgggtgcgccaggcgccgggccaggggctcgagtggatgggccggatcatccccatcctgggccgcaccaactacgcccagaagttccaggggcgggtcacgatcaccgccgacaagagcacctccaccgcctacatggaggtgagctccctgcgcagcgaggacacggccgtgtactactgcgcgcgggagggcgagaccctcgactacttctactacgggatggacgtctggggccaggggaccaccgtgacggtgtccagc

SEQ ID NO: 8085 - RNA, 357 nt, synthetic construct
  misc_feature 1..357: note = derived and/or modified sequence opt1 from HuMab_LC5002-018_gamma1-Chain_V-Region
  source 1..357: mol_type = other RNA
gaggtgcagctgctcgagagcggcgggggcctggtccagcccgggggctccctgcgcctcagctgcgccgcctccgggttcaccttcaacatctacgcgatgaactgggtgcggcaggccccgggcaagggcctggagtgggtgagcgtcatctccgggagcggcgtgaccacgtactacgccgactccgtgaaggggcgcttcaccatcagccgggacaactccaagaacaccctgtacctccagatgaacagcctgcgcgccgaggacaccgccgtctactactgcgcgaagggctccagctggtacgtggacttcgactactgggggcagggcacgctggtgaccgtctccagc

SEQ ID NO: 8086 - RNA, 1347 nt, synthetic construct
  misc_feature 1..1347: note = derived and/or modified sequence opt1 from Ibalizumab_HeavyChain1
  source 1..1347: mol_type = other RNA
caggtgcagctgcagcagagcggccccgaggtcgtgaagccgggggcctccgtgaagatgagctgcaaggcctccggctacaccttcaccagctacgtcatccactgggtgcgccagaagcccgggcagggcctcgactggatcgggtacatcaacccctacaacgacggcacggactacgacgagaagttcaagggcaaggcgaccctgacctccgacaccagcacgtccaccgcctacatggagctgagctccctccggagcgaggacaccgccgtgtactactgcgcccgcgagaaggacaactacgccaccggggcgtggttcgcctactggggccaggggacgctggtcaccgtgtccagcgcctccaccaagggccccagcgtgttcccgctggccccctgctcccggagcacctccgagagcacggcggccctcgggtgcctggtcaaggactacttccccgagcccgtgaccgtgtcctggaacagcggcgccctgaccagcggcgtccacaccttcccggccgtgctccagtccagcgggctgtactccctgagctccgtggtcacggtgcccagctccagcctcggcaccaagacctacacgtgcaacgtggaccacaagccctccaacaccaaggtcgacaagcgcgtggagagcaagtacgggcccccgtgcccctcctgccccgcccccgagttcctgggcggcccgagcgtgttcctgttcccgcccaagcccaaggacaccctcatgatctcccggacccccgaggtgacctgcgtcgtggtcgacgtgagccaggaggaccccgaggtccagttcaactggtacgtggacggggtggaggtccacaacgcgaagacgaagccccgcgaggagcagttcaactccacctaccgggtggtgagcgtcctgaccgtgctgcaccaggactggctcaacggcaaggagtacaagtgcaaggtgtccaacaaggggctgcccagctccatcgagaagaccatcagcaaggccaagggccagccgcgcgagccccaggtctacacgctgccgcccagccaggaggagatgaccaagaaccaggtgtccctgacctgcctcgtgaaggggttctaccccagcgacatcgccgtcgagtgggagtccaacggccagcccgagaacaactacaagaccacgcccccggtgctggacagcgacggctccttcttcctctacagccggctgaccgtggacaagtcccgctggcaggaggggaacgtcttcagctgctccgtgatgcacgaggccctgcacaaccactacacccagaagtccctcagcctgagcctgggcaag

SEQ ID NO: 8087 - RNA, 657 nt, synthetic construct
  misc_feature 1..657: note = derived and/or modified sequence opt1 from Ibalizumab_LightChain1
  source 1..657: mol_type = other RNA
gacatcgtgatgacccagagccccgactccctggccgtcagcctcggcgagcgcgtgaccatgaactgcaagtccagccagtccctgctgtacagcacgaaccagaagaactacctcgcctggtaccagcagaagccggggcagtcccccaagctgctgatctactgggcgagcacccgggagtccggcgtgcccgaccgcttcagcgggtccggcagcgggaccgacttcaccctcacgatctccagcgtccaggccgaggacgtggccgtgtactactgccagcagtactactcctaccggaccttcggcggcgggaccaagctggagatcaagcgcaccgtcgccgcccccagcgtgttcatcttcccgccctccgacgagcagctcaagagcggcacggcgtccgtggtctgcctgctgaacaacttctacccccgggaggccaaggtgcagtggaaggtggacaacgccctgcagagcgggaacagccaggagtccgtcaccgagcaggacagcaaggactccacctacagcctctccagcaccctgacgctgtccaaggccgactacgagaagcacaaggtgtacgcgtgcgaggtgacccaccagggcctcagctcccccgtcaccaagagcttcaaccgcggggagtgc

SEQ ID NO: 8088 - RNA, 1329 nt, synthetic construct
  misc_feature 1..1329: note = derived and/or modified sequence opt1 from Ibritumomab_tiuxetan_HeavyChain
  source 1..1329: mol_type = other RNA
caggcctacctgcagcagagcggcgccgagctcgtgcgccccggggcctccgtcaagatgagctgcaaggcctccggctacaccttcaccagctacaacatgcactgggtgaagcagacgccgcggcaggggctggagtggatcggcgccatctaccccgggaacggcgacacctcctacaaccagaagttcaagggcaaggccaccctgaccgtggacaagagctccagcacggcctacatgcagctctccagcctgacctccgaggacagcgcggtctacttctgcgcccgcgtggtgtactactccaacagctactggtacttcgacgtctgggggaccggcaccacggtgaccgtgtccgcccccagcgtctaccccctggccccggtgtgcggggacaccaccggctccagcgtgacgctcgggtgcctggtcaagggctacttccccgagcccgtgaccctgacctggaactccggcagcctcagctccggggtgcacaccttccccgcggtcctgcagagcgacctgtacacgctctccagctccgtgaccgtgaccagctccacctggccgagccagtccatcacgtgcaacgtcgcccaccccgccagctccaccaaggtggacaagaagatcgagccccggggccccaccatcaagccgtgcccgccctgcaagtgccccgcccccaacctgctcgggggccccagcgtgttcatcttcccgcccaagatcaaggacgtcctcatgatctccctgagccccatcgtgacctgcgtggtcgtggacgtctccgaggacgaccccgacgtgcagatcagctggttcgtgaacaacgtcgaggtgcacacggcccagacccagacccaccgcgaggactacaactccaccctgcgggtggtcagcgcgctccccatccagcaccaggactggatgtccggcaaggagttcaagtgcaaggtgaacaacaaggacctgcccgccccgatcgagcgcacgatcagcaagcccaaggggagcgtgcgggcgccccaggtctacgtgctgcccccgcccgaggaggagatgaccaagaagcaggtcaccctgacctgcatggtgacggacttcatgcccgaggacatctacgtggagtggaccaacaacggcaagaccgagctgaactacaagaacaccgagccggtgctggactccgacgggagctacttcatgtactccaagctccgcgtcgagaagaagaactgggtggagcggaacagctactcctgcagcgtggtccacgagggcctgcacaaccaccacacgaccaagtccttcagccgc

SEQ ID NO: 8089 - RNA, 627 nt, synthetic construct
  misc_feature 1..627: note = derived and/or modified sequence opt1 from Ibritumomab_tiuxetan_LightChain
  source 1..627: mol_type = other RNA
cagatcgtgctgagccagtcccccgccatcctcagcgcctccccgggcgagaaggtcacgatgacctgccgcgcgagctccagcgtgtcctacatgcactggtaccagcagaagcccgggagctcccccaagccctggatctacgccccgagcaacctggcctccggcgtgcccgcccggttcagcgggtccggcagcgggacgtcctacagcctgaccatctcccgcgtcgaggccgaggacgcggccacctactactgccagcagtggagcttcaacccgcccaccttcggcgccggcacgaagctcgagctgaagcgggccgacgcggcccccaccgtgttcatcttcccgccctccgacgagcagctcaagagcgggaccgccagcgtggtctgcctgctgaacaacttctacccccgcgaggccaaggtgcagtggaaggtggacaacgccctgcagtccggcaacagccaggagtccgtcaccgagcaggacagcaaggactccacgtacagcctctccagcaccctgaccctgtccaaggcggactacgagaagcacaaggtgtacgcctgcgaggtgacccaccaggggctcagctcccccgtcaccaagagcttcaac

SEQ ID NO: 8090 - RNA, 1368 nt, synthetic construct
  misc_feature 1..1368: note = derived and/or modified sequence opt1 from Icrucumab_HeavyChain1
  source 1..1368: mol_type = other RNA
caggcccaggtggtcgagagcggcgggggcgtggtgcagtccgggcgcagcctgcggctctcctgcgccgcgagcggcttcgccttctccagctacgggatgcactgggtccgccaggcccccggcaagggcctggagtgggtggccgtgatctggtacgacgggtccaacaagtactacgccgacagcgtccggggccgcttcaccatctcccgggacaacagcgagaacaccctgtacctccagatgaactccctgcgcgcggaggacacggccgtgtactactgcgcccgggaccactacgggagcggcgtgcaccactacttctactacgggctggacgtctggggccagggcaccaccgtgaccgtgtccagcgcctccacgaaggggccgagcgtcttccccctcgcgccctccagcaagtccaccagcggcgggaccgccgccctgggctgcctggtgaaggactacttccccgagccggtgaccgtcagctggaactccggcgccctcacgagcggggtgcacaccttccccgccgtgctgcagtccagcggcctgtactccctcagctccgtcgtgaccgtgcccagctccagcctggggacccagacgtacatctgcaacgtcaaccacaagccctccaacaccaaggtggacaagcgcgtggagcccaagagctgcgacaagacccacacgtgcccgccctgccccgcgccggagctgctcggcgggccctccgtcttcctgttcccgcccaagcccaaggacaccctgatgatcagccggacccccgaggtgacctgcgtcgtggtggacgtctcccacgaggaccccgaggtgaagttcaactggtacgtggacggcgtcgaggtgcacaacgccaagaccaagccccgcgaggagcagtacaacagcacgtaccgggtggtctccgtgctcaccgtgctgcaccaggactggctgaacggcaaggagtacaagtgcaaggtcagcaacaaggccctcccggcccccatcgagaagaccatctccaaggccaaggggcagccccgcgagccccaggtgtacaccctgccgcccagccgggaggagatgacgaagaaccaggtgagcctgacctgcctcgtcaagggcttctacccctccgacatcgcggtggagtgggagagcaacgggcagcccgagaacaactacaagaccaccccgcccgtgctggactccgacggcagcttcttcctgtactccaagctcacggtcgacaagagccgctggcagcaggggaacgtgttctcctgcagcgtgatgcacgaggccctgcacaaccactacacccagaagtccctgagcctctcccccggcaag

SEQ ID NO: 8091 - RNA, 645 nt, synthetic construct
  misc_feature 1..645: note = derived and/or modified sequence opt1 from Icrucumab_LightChain1
  source 1..645: mol_type = other RNA
gagatcgtgctgacccagagccccggcaccctctccctgagcccgggggagcgcgccacgctgtcctgccgggccagccagtccgtcagctccagctacctcgcgtggtaccagcagaagcccggccaggcgccccgcctgctgatctacggggcctccagccgggccaccggcatccccgaccgcttctccgggagcggctccggcaccgacttcaccctcacgatcagccggctggagccggaggacttcgccgtgtactactgccagcagtacgggtccagccccctgaccttcggcgggggcaccaaggtggagatcaagcgcaccgtcgccgccccctccgtgttcatcttcccgcccagcgacgagcagctcaagtccgggacggccagcgtggtctgcctgctgaacaacttctacccccgggaggccaaggtgcagtggaaggtggacaacgcgctccagagcggcaactcccaggagagcgtcaccgagcaggactccaaggacagcacctactccctgagctccaccctgacgctcagcaaggccgactacgagaagcacaaggtgtacgcctgcgaggtgacccaccagggcctgtccagccccgtcaccaagtccttcaaccgcggggagtgc

SEQ ID NO: 8092 - RNA, 675 nt, synthetic construct
  misc_feature 1..675: note = derived and/or modified sequence opt1 from Idarucizumab_HeavyChain1
  source 1..675: mol_type = other RNA
caggtgcagctgcaggagagcggccccgggctcgtcaagccgtccgagaccctgagcctgacctgcacggtgtccggcttcagcctcacctcctacatcgtggactggatccgccagccgcccgggaagggcctggagtggatcggggtcatctgggccggcggcagcaccgggtacaactccgccctgcggagccgcgtgtccatcaccaaggacacgagcaagaaccagttctccctcaagctgagctccgtgaccgcggccgacaccgccgtctactactgcgccagcgccgcgtactactcctactacaactacgacggcttcgcctactgggggcagggcaccctggtgacggtgagctccgccagcaccaaggggccctccgtcttccccctcgcccccagcagcaagtccaccagcggcggcaccgcggccctggggtgcctggtgaaggactacttccccgagcccgtgacggtctcctggaacagcggcgccctcacctccggggtgcacaccttcccggccgtgctgcagagctccggcctgtacagcctctccagcgtcgtgaccgtgccctccagctccctgggcacgcagacctacatctgcaacgtcaaccacaagcccagcaacaccaaggtggacaagaaggtggagcccaagtcctgc

SEQ ID NO: 8093 - RNA, 657 nt, synthetic construct
  misc_feature 1..657: note = derived and/or modified sequence opt1 from Idarucizumab_LightChain1
  source 1..657: mol_type = other RNA
gacgtggtcatgacccagagccccctgtccctcccggtgaccctgggccagcccgccagcatctcctgcaagagctcccagagcctgctctacacggacgggaagacctacctgtactggttcctgcagcgccccggccagagcccccggcgcctcatctacctggtgtccaagctggactccggggtcccggaccggttcagcggctccgggagcggcaccgacttcaccctcaagatctcccgcgtggaggccgaggacgtgggcgtctactactgcctgcagagcacgcacttcccccacaccttcgggggcgggaccaaggtggagatcaagcggaccgtggcggccccctccgtcttcatcttcccgcccagcgacgagcagctgaagtccggcacggccagcgtggtgtgcctcctgaacaacttctacccccgcgaggccaaggtccagtggaaggtggacaacgccctgcagtccgggaacagccaggagagcgtgaccgagcaggactccaaggacagcacctactccctcagctccaccctgacgctgagcaaggcggactacgagaagcacaaggtctacgcctgcgaggtgacccaccagggcctctccagccccgtgaccaagtccttcaaccggggcgagtgc

SEQ ID NO: 8094 - RNA, 1332 nt, synthetic construct
  misc_feature 1..1332: note = derived and/or modified sequence opt1 from Igatuzuab_HeavyChain1
  source 1..1332: mol_type = other RNA
caggtgcagctggtccagagcggcgccgaggtgaagaagcccgggtccagcgtgaaggtctcctgcaaggccagcggcttcaccttcaccgactacaagatccactgggtgcgccaggcgccggggcagggcctcgagtgggggtacttcaaccccaactccggctacagcacgtacgcccagaagttccagggccgggtgaccatcaccgccgacaagtccaccagcacggcctacgagctgtccagcctgcgctccgaggacaccgccgtctactactgcgcgcggctcagccccgggggctactacgtggacgcctgggggcagggcaccaccgtgacggtctccagcgcctccaccaaggggcccagcgtgttcccgctggccccctccagcaagtccaccagcggcggcaccgcggccctggggtgcctcgtgaaggactacttccccgagcccgtcacggtgagctggaactccggcgccctgaccagcggggtgcacaccttcccggccgtcctgcagtccagcggcctctactccctgagctccgtggtgaccgtccccagctccagcctgggcacgcagacctacatctgcaacgtgaaccacaagccctccaacaccaaggtggacaagaaggtcgagcccaagagctgcgacaagacccacacgtgcccgccctgccccgcccccgagctcctcgggggcccgtccgtgttcctgttcccgcccaagcccaaggacaccctgatcagccgcacccccgaggtgacctgcgtcgtggtcgacgtgtcccacgaggaccccgaggtgaagttcaactggtacgtcgacggggtggaggtgcacaacgcgaagacgaagccccgggaggagcagtacaacagcacctaccgcgtcgtgtccgtgctgaccgtcctgcaccaggactggctcaacggcaaggagtacaagtgcaaggtgagcaacaaggccctgcccgccccgatcgagaagaccatctccaaggccaaggggcagccccgggagccccaggtgtacacgctgcccccgagccgcgacgagctcaccaagaaccaggtcagcctgacctgcctggtgaagggcttctacccctccgacatcgccgtggagtgggagagcaacggccagcccgagaacaactacaagaccacgccgcccgtcctcgactccgacgggagcttcttcctgtactccaagctgaccgtggacaagagccggtggcagcagggcaacgtgttctcctgcagcgtccacgaggcgctccacaaccactacacccagaagtccctgagcctgtcccccggg

SEQ ID NO: 8095 - RNA, 636 nt, synthetic construct
  misc_feature 1..636: note = derived and/or modified sequence opt1 from Igatuzuab_LightChain1
  source 1..636: mol_type = other RNA
gacatccagacccagagcccctccagcctgtccgccagcgtgggcgaccgcgtcaccatcacgtgccgggcctcccaggggatcaacaactacctcaactggtaccagcagaagccgggcaaggcgcccaagcgcctgatctacaacaccaacaacctgcagaccggggtgcccagccggttctccggcagcgggtccggcaccgagttcacgctcaccatcagctccctgcagcccgaggacttcgccacctactactgcctgcagcacaacagcttcccgaccttcggccaggggacgaagctcgagatcaagcgcaccgtggccgccccctccgtcttcatcttcccgcccagcgacgagcagctgaagtccggcaccgccagcgtggtgtgcctgctcaacaacttctacccccgggaggcgaaggtccagtggaaggtggacaacgccctgcagtccgggaacagccaggagtccgtgaccgagcaggacagcaaggacagcacgtactccctgagctccaccctcaccctgagcaaggccgactacgagaagcacaaggtctacgcctgcgaggtgacccaccagggcctgtccagccccgtgacgaagtccttcaaccgcggggagtgc

SEQ ID NO: 8096 - RNA, 357 nt, synthetic construct
  misc_feature 1..357: note = derived and/or modified sequence opt1 from IGF-IR_HUMAB-1A_HeavyChain
  source 1..357: mol_type = other RNA
gaggtgcagctggtccagagcggcgggggcctcgtgcaccccgggggctccctgcgcctgagctgcgccgggtccggcttcaccttccggaactacgccatgtactgggtgcgccaggcgccgggcaaggggctcgagtgggtcagcgccatcggctccgggggcgggacctactacgccgacagcgtgaagggccggttcacgatctcccgcgacaacgccaagaacagcctgtacctgcagatgaactccctccgggccgaggacatggcggtgtactactgcgcccgcgcccccaactggggcagcgacgccttcgacatctgggggcagggcaccatggtcaccgtgtccagc

SEQ ID NO: 8097 - RNA, 357 nt, synthetic construct
  misc_feature 1..357: note = derived and/or modified sequence opt1 from IGF-IR_HUMAB-23_HeavyChain
  source 1..357: mol_type = other RNA
gaggtgcagctggtccagagcggcgggggcctcgtgcaccccgggggctccctgcgcctgagctgcgccgggtccggcttcaccttcagcaactacgccatgtactgggtgcggcaggcgccgggcaaggggctcgagtgggtctccgccatcggcagcgggggcgggacctactacgccgactccgtgaagggccgcttcacgatcagccgggacaacgccaagaactccctgtacctgcagatgaacagcctccgcgccgaggacatggcggtgtaccactgcgcccgggcccccaactggggctccgaggccttcgacatctgggggcagggcaccatggtcaccgtgagctcc

SEQ ID NO: 8098 - RNA, 321 nt, synthetic construct; identical to SEQ ID NO: 7994
  misc_feature 1..321: note = derived and/or modified sequence opt1 from IGF-IR_HUMAB-23_LightChain
  source 1..321: mol_type = other RNA

SEQ ID NO: 8099 - RNA, 357 nt, synthetic construct
  misc_feature 1..357: note = derived and/or modified sequence opt1 from IGF-IR_HUMAB-8_HeavyChain
  source 1..357: mol_type = other RNA
gaggtgcagctggtccagagcggcgggggcctcgtgcaccccgggggctccctgcgcctgagctgcgccgggtccggcttcaccttccggagctacgccatgtactgggtgcgccaggcgccgggcaaggggctcgagtgggtctccgccatcggcagcgggggcgggacctactacgccgactccgtgaagggccggttcacgatcagccgcgacaacgccaagaactccctgtacctgcagatgaacagcctccgggccgaggacatggcggtgtactactgcgcccgcgcccccaactggggctccgacgccttcgacatctgggggcagggcaccatggtcaccgtgagctcc

SEQ ID NO: 8100 - RNA, 321 nt, synthetic construct
  misc_feature 1..321: note = derived and/or modified sequence opt1 from IGF-IR_HUMAB-8_LightChain
  source 1..321: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccgcctccagcctgcagtccggcgtgcccagccgcttctccgggagcggctccgggaccgacttcaccctcaccatcagctccctgcagcccgaggacttcgccacgtactactgccagcagtacaacagctacccgcccaccttcggccccggcaccaaggtggacatcaag

SEQ ID NO: 8101 - RNA, 708 nt, synthetic construct
  misc_feature 1..708: note = derived and/or modified sequence opt1 from ImAb1_LightChain
  source 1..708: mol_type = other RNA
atggacatgcgcgcccccgcccagttcttcggcatcctgctcctgtggttcccggggatccggtgcgacatcaagatgacccagagcccctccagcatgtacgcgtccctgggcgagcgcgtgaccatcacgtgcaaggccagccaggacatcaagtcctacctcagctggtaccagcagaagccctggaagtcccccaagatcctgatctactacgccaccagcctggccgacggggtcccgtcccggatcagcggctccgggagcggccaggactactccctcaccatcagctccctggagagcgacgacaccgccacgtactactgcctgcagcacggcgagtccccctacaccttcgggggcgggaccaagctcgagatcaagcgcgcggacgccgcccccaccgtgagcatcttcccgccctccagcgagcagctgacgagcggcggggcctccgtggtctgcttcctgaacaacttctaccccaaggacatcaacgtgaagtggaagatcgacggcagcgagcggcagaacggcgtgctcaactcctggaccgaccaggacagcaaggactccacctacagcatgtccagcaccctgacgctgaccaaggacgagtacgagcgccacaactcctacacgtgcgaggcgacccacaagaccagcacctcccccatcgtcaagagcttcaaccggaacgagtgc

SEQ ID NO: 8102 - RNA, 681 nt, synthetic construct
  misc_feature 1..681: note = derived and/or modified sequence opt1 from ImAb1_gamma1-Chain
  source 1..681: mol_type = other RNA
atgaacttcggcttcagcctgatcttcctcgtgctggtcctgaagggggtgcagtgcgaggtgaagctcgtcgagtccggcgggggcctggtgaagcccgggggcagcctgaagctctcctgcgccgccagcggcttcaccttctccaactacgcgatgagctgggtgcgccagaccccggagaagcggctggagtgggtcgcctccatcagctccgacggggacacgtacttccccgacaacgtgaagggccgcttcaccatcagccgggagaacgccgggaacatcctgttcctccagatgtccagcctgcgctccgaggacaccgccatgtactactgcgcccggggcttcatgatcaccttctgggggcagggcacgctggtgaccgtcagcgcggccaagaccaccccgccctccgtgtaccccctcgcccccggctgcggggacacgaccggcagctccgtgaccctggggtgcctggtcaagggctacttccccgagagcgtgaccgtgacgtggaactccggcagcctcagctccagcgtccacaccttccccgccctgctgcagtccgggctctacaccatgagctccagcgtgaccgtgccgtccagcacgtggccctcccagaccgtgacctgcagcgtcgcgcaccccgcctccagcaccacggtggac

SEQ ID NO: 8103 - RNA, 1344 nt, synthetic construct
  misc_feature 1..1344: note = derived and/or modified sequence opt1 from Imalumab_HeavyChain1
  source 1..1344: mol_type = other RNA
gaggtgcagctgctcgagagcggcgggggcctggtccagcccgggggctccctgcgcctcagctgcgccgcctccgggttcaccttcagcatctactccatgaactgggtgcggcaggcgccgggcaagggcctggagtgggtgagctccatcgggagctccggcgggaccacgtactacgccgacagcgtcaagggccgcttcaccatctcccgggacaacagcaagaacaccctgtacctccagatgaactccctgcgcgccgaggacaccgccgtgtactactgcgccgggagccagtggctgtacggcatggacgtgtggggccaggggacgaccgtcaccgtgtccagcgcgtccaccaagggccccagcgtgttccccctcgccccctccagcaagagcacgtccgggggcaccgccgccctgggctgcctggtcaaggactacttcccggagcccgtgaccgtgagctggaactccggggcgctcaccagcggcgtccacacgttccccgccgtgctgcagtccagcgggctgtactccctcagctccgtggtcaccgtgcccagctccagcctgggcacccagacctacatctgcaacgtgaaccacaagccgtccaacacgaaggtcgacaagcgggtggagcccaagagctgcgacaagacccacacgtgcccgccctgccccgcccccgagctgctcgggggcccctccgtgttcctgttcccgcccaagcccaaggacaccctgatgatcagccgcacccccgaggtgacctgcgtcgtggtcgacgtgtcccacgaggaccccgaggtcaagttcaactggtacgtggacggcgtggaggtccacaacgccaagaccaagccgcgggaggagcagtacaacagcacctaccgcgtggtgtccgtcctcacggtgctgcaccaggactggctgaacgggaaggagtacaagtgcaaggtgagcaacaaggccctccccgcgcccatcgagaagaccatcagcaaggccaagggccagccccgggagccgcaggtctacaccctgccgccctcccgcgaggagatgaccaagaaccaggtgagcctgacgtgcctcgtgaaggggttctacccctccgacatcgccgtcgagtgggagagcaacggccagcccgagaacaactacaagaccaccccgcccgtgctggactccgacgggagcttcttcctgtactccaagctcaccgtggacaagagccggtggcagcagggcaacgtcttctcctgcagcgtgatgcacgaggccctgcacaaccactacacgcagaagtccctgagcctctcccccggcaag

SEQ ID NO: 8104 - RNA, 642 nt, synthetic construct
  misc_feature 1..642: note = derived and/or modified sequence opt1 from Imalumab_LightChain1
  source 1..642: mol_type = other RNA
gacatccagatgacgcagagcccctccagcctgtccgccagcgtgggcgaccgggtcaccatcacgtgccggtccagccagcgcatcatgacctacctcaactggtaccagcagaagccggggaaggcccccaagctgctgatcttcgtggcgtcccacagccagtccggcgtgcccagccggttccgcgggtccggcagcgagaccgacttcaccctcacgatctccgggctgcagcccgaggacagcgccacctactactgccagcagtccttctggaccccgctgaccttcggcggcgggacgaaggtcgagatcaagcggaccgtggccgcccccagcgtgttcatcttcccgccctccgacgagcagctcaagagcggcaccgcctccgtcgtgtgcctgctgaacaacttctacccccgcgaggcgaaggtgcagtggaaggtcgacaacgccctccagagcgggaacagccaggagtccgtgaccgagcaggacagcaaggactccacgtacagcctgtccagcaccctgaccctctccaaggccgactacgagaagcacaaggtgtacgcctgcgaggtcacccaccagggcctgagctcccccgtgaccaagagcttcaaccgcggggagtgc

SEQ ID NO: 8105 - RNA, 1347 nt, synthetic construct
  misc_feature 1..1347: note = derived and/or modified sequence opt1 from Imgatuzumab_HeavyChain1
  source 1..1347: mol_type = other RNA
caggtgcagctggtccagagcggcgccgaggtgaagaagcccgggtccagcgtgaaggtctcctgcaaggccagcggcttcaccttcaccgactacaagatccactgggtgcgccaggcgccggggcagggcctcgagtggatggggtacttcaaccccaactccggctacagcacgtacgcccagaagttccagggccgggtgaccatcaccgccgacaagtccaccagcacggcctacatggagctgtccagcctgcgctccgaggacaccgccgtctactactgcgcgcggctcagccccgggggctactacgtgatggacgcctgggggcagggcaccaccgtgacggtctccagcgcctccaccaaggggcccagcgtgttcccgctggccccctccagcaagtccaccagcggcggcaccgcggccctggggtgcctcgtgaaggactacttccccgagcccgtcacggtgagctggaactccggcgccctgaccagcggggtgcacaccttcccggccgtcctgcagtccagcggcctctactccctgagctccgtggtgaccgtccccagctccagcctgggcacgcagacctacatctgcaacgtgaaccacaagccctccaacaccaaggtggacaagaaggtcgagcccaagagctgcgacaagacccacacgtgcccgccctgccccgcccccgagctcctcgggggcccgtccgtgttcctgttcccgcccaagcccaaggacaccctgatgatcagccgcacccccgaggtgacctgcgtcgtggtcgacgtgtcccacgaggaccccgaggtgaagttcaactggtacgtcgacggggtggaggtgcacaacgcgaagacgaagccccgggaggagcagtacaacagcacctaccgcgtcgtgtccgtgctgaccgtcctgcaccaggactggctcaacggcaaggagtacaagtgcaaggtgagcaacaaggccctgcccgccccgatcgagaagaccatctccaaggccaaggggcagccccgggagccccaggtgtacacgctgcccccgagccgcgacgagctcaccaagaaccaggtcagcctgacctgcctggtgaagggcttctacccctccgacatcgccgtggagtgggagagcaacggccagcccgagaacaactacaagaccacgccgcccgtcctcgactccgacgggagcttcttcctgtactccaagctgaccgtggacaagagccggtggcagcagggcaacgtgttctcctgcagcgtcatgcacgaggcgctccacaaccactacacccagaagtccctgagcctgtcccccggg

SEQ ID NO: 8106 - RNA, 639 nt, synthetic construct
  misc_feature 1..639: note = derived and/or modified sequence opt1 from Imgatuzumab_LightChain1
  source 1..639: mol_type = other RNA
gacatccagatgacccagagcccctccagcctgtccgccagcgtgggcgaccgcgtcaccatcacgtgccgggcctcccaggggatcaacaactacctcaactggtaccagcagaagccgggcaaggcgcccaagcgcctgatctacaacaccaacaacctgcagaccggggtgcccagccggttctccggcagcgggtccggcaccgagttcacgctcaccatcagctccctgcagcccgaggacttcgccacctactactgcctgcagcacaacagcttcccgaccttcggccaggggacgaagctcgagatcaagcgcaccgtggccgccccctccgtcttcatcttcccgcccagcgacgagcagctgaagtccggcaccgccagcgtggtgtgcctgctcaacaacttctacccccgggaggcgaaggtccagtggaaggtggacaacgccctgcagtccgggaacagccaggagtccgtgaccgagcaggacagcaaggacagcacgtactccctgagctccaccctcaccctgagcaaggccgactacgagaagcacaaggtctacgcctgcgaggtgacccaccagggcctgtccagccccgtgacgaagtccttcaaccgcggggagtgc

SEQ ID NO: 8107 - RNA, 1353 nt, synthetic construct
  misc_feature 1..1353: note = derived and/or modified sequence opt1 from Inclacumab_HeavyChain1
  source 1..1353: mol_type = other RNA
gaggtgcagctggtcgagagcggcgggggcctcgtgcgccccgggggctccctgcggctgagctgcgccgcctccgggttcaccttcagcaactacgacatgcactgggtgcgccaggcgaccggcaagggcctcgagtgggtctccgccatcacggccgccggggacatctactaccccggcagcgtgaaggggcggttcaccatctcccgcgagaacgccaagaacagcctgtacctgcagatgaactccctccgggcgggcgacaccgccgtgtactactgcgcccgcgggcggtacagcggctccggcagctactacaacgactggttcgacccctgggggcagggcaccctggtcacggtgtccagcgcctccaccaaggggcccagcgtgttccccctggcgccgtgctcccgcagcacctccgagagcaccgccgccctcggctgcctggtcaaggactacttccccgagcccgtgacggtgagctggaactccggcgccctgaccagcggggtccacaccttccccgccgtgctccagtccagcggcctgtactccctgagctccgtggtcaccgtgccgagctccagcctcgggacgaagacctacacgtgcaacgtggaccacaagccctccaacaccaaggtcgacaagcgggtggagagcaagtacggcccgccctgcccgccctgccccgcgcccgagttcgagggcgggccgtccgtgttcctgttcccgcccaagcccaaggacaccctgatgatcagccgcacccccgaggtgacctgcgtcgtggtcgacgtgtcccaggaggaccccgaggtccagttcaactggtacgtggacggcgtggaggtccacaacgccaagaccaagccccgggaggagcagttcaacagcacgtaccgcgtggtgtccgtcctcaccgtgctgcaccaggactggctgaacgggaaggagtacaagtgcaaggtgagcaacaagggcctcccctccagcatcgagaagaccatcagcaaggccaaggggcagccgcgggagccccaggtctacaccctgccgccctcccaggaggagatgacgaagaaccaggtgagcctgacctgcctcgtgaagggcttctacccctccgacatcgccgtcgagtgggagagcaacgggcagcccgagaacaactacaagaccaccccgcccgtgctggactccgacggcagcttcttcctgtactcccgcctcacggtggacaagagccggtggcaggagggcaacgtcttctcctgcagcgtgatgcacgaggccctgcacaaccactacacccagaagtccctgagcctctccctggggaag

SEQ ID NO: 8108 - RNA, 642 nt, synthetic construct
  misc_feature 1..642: note = derived and/or modified sequence opt1 from Inclacumab_LightChain1
  source 1..642: mol_type = other RNA
gagatcgtgctgacccagagccccgccaccctctccctgagcccgggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggcccctgaccttcggcggcgggaccaaggtggagatcaagcgcaccgtcgccgccccctccgtgttcatcttcccgcccagcgacgagcagctcaagtccggcacggcgagcgtggtctgcctgctgaacaacttctacccccgggaggccaaggtgcagtggaaggtggacaacgccctccagtccgggaacagccaggagagcgtcaccgagcaggactccaaggacagcacctactccctgagctccaccctgacgctcagcaaggccgactacgagaagcacaaggtgtacgcctgcgaggtgacccaccagggcctgtccagccccgtcaccaagtccttcaaccgcggggagtgc

SEQ ID NO: 8109 - RNA, 1347 nt, synthetic construct
  misc_feature 1..1347: note = derived and/or modified sequence opt1 from Indatuximab_ravtansine_HeavyChain1
  source 1..1347: mol_type = other RNA
caggtgcagctgcagcagagcggctccgagctcatgatgcccggggccagcgtcaagatctcctgcaaggccaccggctacaccttcagcaactactggatcgagtgggtgaagcagcgccccgggcacggcctggagtggatcggggagatcctgcccggcacgggccggaccatctacaacgagaagttcaaggggaaggcgaccttcaccgccgacatctccagcaacacggtgcagatgcagctctccagcctgacctccgaggacagcgccgtctactactgcgcccgccgggactactacggcaacttctactacgccatggactactgggggcagggcacctccgtgaccgtgagctccgcgagcacgaaggggccctccgtcttccccctggccccgtgcagccgctccaccagcgagtccaccgccgccctcggctgcctggtgaaggactacttccccgagcccgtgaccgtcagctggaacagcggcgcgctgacgtccggggtgcacaccttccccgccgtgctccagagctccggcctgtacagcctgtccagcgtcgtgaccgtgccgtccagctccctcgggaccaagacgtacacgtgcaacgtcgaccacaagcccagcaacaccaaggtggacaagcgggtggagtccaagtacggcccgccctgcccgagctgccccgcccccgagttcctgggcgggccctccgtcttcctgttcccgcccaagcccaaggacaccctcatgatcagccgcacccccgaggtgacctgcgtggtcgtggacgtgtcccaggaggacccggaggtccagttcaactggtacgtggacggcgtcgaggtgcacaacgccaagaccaagccccgggaggagcagttcaacagcacctaccgcgtggtctccgtgctgacggtgctgcaccaggactggctcaacgggaaggagtacaagtgcaaggtcagcaacaagggcctgccctccagcatcgagaagaccatcagcaaggccaaggggcagccccgggagccccaggtgtacaccctgccgccctcccaggaggagatgaccaagaaccaggtgagcctcacgtgcctggtcaagggcttctacccctccgacatcgcggtggagtgggagagcaacggccagcccgagaacaactacaagaccaccccgcccgtgctggactccgacgggagcttcttcctctactcccgcctgaccgtcgacaagagccggtggcaggagggcaacgtgttctcctgcagcgtgatgcacgaggccctgcacaaccactacacgcagaagtccctcagcctgtccctggggaag

SEQ ID NO: 8110 - RNA, 642 nt, synthetic construct
  misc_feature 1..642: note = derived and/or modified sequence opt1 from Indatuximab_ravtansine_LightChain1
  source 1..642: mol_type = other RNA
gacatccagatgacccagagcacctccagcctgtccgccagcctcggcgaccgcgtgacgatctcctgcagcgcctcccaggggatcaacaactacctgaactggtaccagcagaagcccgacggcaccgtcgagctgctcatctactacaccagcaccctgcagtccggggtgccgagccggttctccggcagcgggtccggcacggactacagcctgaccatctccaacctcgagcccgaggacatcggcacctactactgccagcagtacagcaagctgccccgcaccttcgggggcgggacgaagctggagatcaagcggaccgtggcggccccctccgtcttcatcttcccgcccagcgacgagcagctcaagtccggcaccgccagcgtggtgtgcctgctgaacaacttctacccccgcgaggccaaggtccagtggaaggtggacaacgccctccagagcgggaactcccaggagagcgtgaccgagcaggactccaaggacagcacgtactccctgagctccaccctgaccctcagcaaggcggactacgagaagcacaaggtctacgcctgcgaggtgacccaccagggcctgtccagccccgtgacgaagtccttcaaccggggcgagtgc

SEQ ID NO: 8111 - RNA, 1347 nt, synthetic construct
  misc_feature 1..1347: note = derived and/or modified sequence opt1 from Indusatumab_vedotin_HeavyChain1
  source 1..1347: mol_type = other RNA
caggtgcagctgcagcagtggggcgccgggctcctgaagcccagcgagaccctgtccctgacctgcgccgtcttcggcgggagcttctccggctactactggagctggatccgccagccgcccgggaagggcctggagtggatcggcgagatcaaccaccgggggaacacgaacgacaacccctccctcaagagccgcgtgaccatctccgtggacaccagcaagaaccagttcgcgctcaagctgtccagcgtcaccgccgccgacacggccgtgtactactgcgcccgggagcgcggctacacctacgggaacttcgaccactggggccaggggaccctggtgaccgtctccagcgcgtccacgaagggccccagcgtgttcccgctcgccccctccagcaagtccaccagcggcgggaccgccgccctgggctgcctggtgaaggactacttccccgagcccgtcaccgtgtcctggaacagcggggcgctcacgagcggcgtgcacaccttcccggccgtcctgcagtccagcggcctgtactccctcagctccgtggtgaccgtccccagctccagcctggggacccagacgtacatctgcaacgtgaaccacaagccctccaacaccaaggtggacaagaaggtcgagcccaagagctgcgacaagacccacacgtgcccgccctgccccgcccccgagctgctcggcgggccgtccgtgttcctgttcccgcccaagcccaaggacaccctgatgatcagccggacccccgaggtgacctgcgtcgtggtggacgtctcccacgaggaccccgaggtgaagttcaactggtacgtcgacggcgtggaggtgcacaacgccaagaccaagccccgcgaggagcagtacaacagcacgtaccgggtcgtgtccgtgctcaccgtcctgcaccaggactggctgaacgggaaggagtacaagtgcaaggtgagcaacaaggccctccccgcgccgatcgagaagaccatctccaaggccaagggccagccccgcgagccccaggtgtacaccctgcccccgagccgggacgagctgacgaagaaccaggtctccctgacctgcctcgtgaagggcttctaccccagcgacatcgccgtggagtgggagagcaacgggcagcccgagaacaactacaagaccaccccgcccgtcctggactccgacggcagcttcttcctctactccaagctgacggtggacaagagccgctggcagcaggggaacgtgttctcctgcagcgtcatgcacgaggccctgcacaaccactacacccagaagtccctcagcctgtcccccggcaag

SEQ ID NO: 8112 - RNA, 642 nt, synthetic construct
  misc_feature 1..642: note = derived and/or modified sequence opt1 from Indusatumab_vedotin_LightChain1
  source 1..642: mol_type = other RNA
gagatcgtgatgacccagagccccgccaccctgtccgtcagcccgggcgagcgcgccacgctctcctgccgggcgagccagtccgtgagccgcaacctggcctggtaccagcagaagcccgggcaggcgccccggctgctcatctacggcgcctccacccgcgccaccgggatccccgcccggttcagcggctccgggagcggcaccgagttcacgctgaccatcggctccctgcagagcgaggacttcgccgtgtactactgccagcagtacaagacctggccgcgcaccttcgggcagggcacgaacgtcgagatcaagcggaccgtggccgccccctccgtgttcatcttcccgcccagcgacgagcagctcaagtccgggaccgcgagcgtcgtgtgcctgctgaacaacttctacccccgcgaggccaaggtgcagtggaaggtcgacaacgccctccagtccggcaacagccaggagtccgtgaccgagcaggacagcaaggacagcacgtactccctgagctccaccctgaccctcagcaaggccgactacgagaagcacaaggtgtacgcctgcgaggtcacccaccaggggctgtccagccccgtgacgaagtccttcaaccggggcgagtgc

SEQ ID NO: 8113 - RNA, 1353 nt, synthetic construct
  misc_feature 1..1353: note = derived and/or modified sequence opt1 from Inebilizumab_HeavyChain1
  source 1..1353: mol_type = other RNA
gaggtgcagctggtcgagagcggcgggggcctcgtgcagcccgggggctccctgcgcctgagctgcgccgcctccgggttcaccttcagctccagctggatgaactgggtgcggcaggcgccgggcaagggcctcgagtgggtcgggcgcatctaccccggcgacggggacaccaactacaacgtgaagttcaagggccggttcacgatctcccgcgacgacagcaagaactccctgtacctgcagatgaacagcctcaagaccgaggacaccgccgtgtactactgcgcccggtccgggttcatcaccacggtccgcgacttcgactactggggccagggcaccctggtgaccgtgagctccgccagcaccaaggggccctccgtcttccccctggccccgagctccaagagcacgtccggcgggaccgcggccctcggctgcctggtgaaggactacttccccgagcccgtgaccgtcagctggaacagcggcgccctgacctccggggtgcacacgttccccgccgtgctccagagctccggcctgtacagcctgtccagcgtcgtgaccgtgccgtccagctccctcgggacccagacctacatctgcaacgtcaaccacaagcccagcaacacgaaggtggacaagcgggtggagcccaagtcctgcgacaagacccacacgtgcccgccctgccccgcgcccgagctgctgggcgggcccagcgtcttcctcttcccgcccaagcccaaggacaccctgatgatctcccgcacccccgaggtgacctgcgtggtcgtggacgtcagccacgaggacccggaggtgaagttcaactggtacgtggacggcgtcgaggtgcacaacgccaagaccaagccccgggaggagcagtacaactccacctaccgcgtggtcagcgtgctgacggtgctccaccaggactggctgaacggcaaggagtacaagtgcaaggtctccaacaaggccctgcccgcccccatcgagaagaccatcagcaaggccaaggggcagccgcgggagccccaggtgtacaccctcccgccctcccgcgaggagatgaccaagaaccaggtgagcctgacgtgcctggtcaagggcttctaccccagcgacatcgcggtggagtgggagtccaacgggcagcccgagaacaactacaagaccacgcccccggtgctcgacagcgacggctccttcttcctgtacagcaagctgaccgtcgacaagtcccggtggcagcaggggaacgtgttcagctgctccgtgatgcacgaggccctccacaaccactacacccagaagtccctgagcctgagccccggcaag

SEQ ID NO: 8114 - RNA, 654 nt, synthetic construct
  misc_feature 1..654: note = derived and/or modified sequence opt1 from Inebilizumab_LightChain1
  source 1..654: mol_type = other RNA
gagatcgtgctgacccagagccccgacttccagtccgtcaccccgaaggagaaggtgacgatcacgtgccgcgccagcgagtccgtggacaccttcggcatcagcttcatgaactggttccagcagaagcccgaccagtcccccaagctcctgatccacgaggccagcaaccaggggtccggcgtccccagccggttctccgggagcggctccgggaccgacttcacgctgaccatcaacagcctcgaggcggaggacgccgccacctactactgccagcagtccaaggaggtgccgttcaccttcggcggcgggacgaaggtggagatcaagcgcaccgtcgccgcccccagcgtgttcatcttcccgccctccgacgagcagctcaagagcggcaccgcgtccgtggtctgcctgctgaacaacttctacccccgggaggccaaggtgcagtggaaggtggacaacgccctgcagagcgggaactcccaggagagcgtcaccgagcaggacagcaaggactccacgtacagcctgtccagcaccctcaccctgtccaaggccgactacgagaagcacaaggtgtacgcgtgcgaggtgacccaccagggcctgagctcccccgtcaccaagagcttcaaccgcggggagtgc

SEQ ID NO: 8115 - RNA, 90 nt, synthetic construct
  misc_feature 1..90: note = derived and/or modified sequence opt1 from Insulin_peglispro_Fragment1
  source 1..90: mol_type = other RNA
ttcgtgaaccagcacctgtgcggcagccacctcgtcgaggccctgtacctggtgtgcggggagcgcggcttcttctacaccaagcccacc

SEQ ID NO: 8116 - RNA, 63 nt, synthetic construct
  misc_feature 1..63: note = derived and/or modified sequence opt1 from Insulin_peglispro_Fragment2
  source 1..63: mol_type = other RNA
ggcatcgtggagcagtgctgcaccagcatctgctccctgtaccagctcgagaactactgcaac

SEQ ID NO: 8117 - RNA, 495 nt, synthetic construct
  misc_feature 1..495: note = derived and/or modified sequence opt1 from Interferon_beta-1b_chain1
  source 1..495: mol_type = other RNA
agctacaacctgctcggcttcctgcagcgctccagcaacttccagtcccagaagctgctctggcagctgaacgggcggctggagtactgcctcaaggaccgcatgaacttcgacatccccgaggagatcaagcagctgcagcagttccagaaggaggacgccgccctgaccatctacgagatgctccagaacatcttcgcgatcttccggcaggacagctccagcaccggctggaacgagacgatcgtggagaacctgctggccaacgtctaccaccagatcaaccacctcaagaccgtgctggaggagaagctggagaaggaggacttcacccgcgggaagctcatgtccagcctgcacctgaagcggtactacggccgcatcctccactacctgaaggccaaggagtactcccactgcgcctggaccatcgtgcgggtcgagatcctgcgcaacttctacttcatcaaccggctcacggggtacctgcgcaac

SEQ ID NO: 8118 - RNA, 1347 nt, synthetic construct
  misc_feature 1..1347: note = derived and/or modified sequence opt1 from Intetumumab_HeavyChain1
  source 1..1347: mol_type = other RNA
caggtgcagctggtcgagagcggcgggggcgtggtgcagcccgggcgctcccggcgcctcagctgcgccgcctccggcttcaccttcagccggtacaccatgcactgggtccgccaggcgccggggaagggcctggagtgggtggccgtgatctccttcgacggcagcaacaagtactacgtcgactccgtgaaggggcggttcacgatcagccgcgacaactccgagaacaccctgtacctccaggtgaacatcctgcgggccgaggacaccgccgtctactactgcgcccgcgaggcgcggggcagctacgccttcgacatctgggggcagggcaccatggtgacggtgtccagcgcctccaccaaggggcccagcgtcttccccctggccccctccagcaagtccaccagcggcggcaccgcggccctcgggtgcctggtgaaggactacttcccggagcccgtgacggtctcctggaacagcggcgccctgaccagcggggtgcacaccttccccgccgtgctccagtccagcggcctgtactccctgagctccgtcgtgaccgtgcccagctccagcctcggcacgcagacctacatctgcaacgtcaaccacaagccgtccaacaccaaggtggacaagaaggtggagcccaagagctgcgacaagacccacacgtgcccgccctgcccggcccccgagctgctcgggggcccctccgtcttcctgttcccgcccaagcccaaggacaccctgatgatcagccgcacccccgaggtgacctgcgtcgtggtggacgtctcccacgaggaccccgaggtgaagttcaactggtacgtggacggggtcgaggtgcacaacgcgaagacgaagccgcgggaggagcagtacaacagcacctaccgcgtggtctccgtgctgaccgtgctccaccaggactggctgaacggcaaggagtacaagtgcaaggtcagcaacaaggccctgcccgcccccatcgagaagaccatctccaaggccaaggggcagccccgggagccccaggtgtacacgctcccgcccagccgcgacgagctgaccaagaaccaggtgtccctgacctgcctcgtcaagggcttctaccccagcgacatcgccgtggagtgggagagcaacggccagcccgagaacaactacaagaccacgccgcccgtgctggactccgacgggagcttcttcctgtactccaagctcaccgtcgacaagagccggtggcagcagggcaacgtgttctcctgcagcgtgatgcacgaggcgctgcacaaccactacacccagaagtccctgagcctctcccccgggaag

SEQ ID NO: 8119 - RNA, 645 nt, synthetic construct
  misc_feature 1..645: note = derived and/or modified sequence opt1 from Intetumumab_LightChain1
  source 1..645: mol_type = other RNA
gagatcgtgctgacccagagccccgccaccctctccctgagcccgggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggccgcccttcaccttcggccccggcaccaaggtggacatcaagcgcaccgtcgccgccccctccgtgttcatcttcccgcccagcgacgagcagctgaagtccgggacggcgagcgtggtctgcctcctgaacaacttctacccccgggaggccaaggtgcagtggaaggtggacaacgccctgcagtccggcaacagccaggagagcgtcaccgagcaggactccaaggacagcacctactccctcagctccaccctgacgctgagcaaggccgactacgagaagcacaaggtgtacgcctgcgaggtgacccaccaggggctctccagccccgtcaccaagtccttcaaccgcggcgagtgc

SEQ ID NO: 8120 - RNA, 1347 nt, synthetic construct; identical to SEQ ID NO: 7978
  misc_feature 1..1347: note = derived and/or modified sequence opt1 from Iodine_(124I)_Girentuximab_HeavyChain1
  source 1..1347: mol_type = other RNA

SEQ ID NO: 8121 - RNA, 642 nt, synthetic construct; identical to SEQ ID NO: 7979
  misc_feature 1..642: note = derived and/or modified sequence opt1 from Iodine_(124I)_Girentuximab_LightChain1
  source 1..642: mol_type = other RNA

SEQ ID NO: 8122 - RNA, 1335 nt, synthetic construct
  misc_feature 1..1335: note = derived and/or modified sequence opt1 from Iodine_(131I)_derlotuxiab_biotin_HeavyChain1
  source 1..1335: mol_type = other RNA
caggtgcagctgaaggagagcggccccgggctcgtcgccccgtcccagagcctgtccatcacgtgcaccgtgagcggcttctccctgaccgactacggggtgcgctggatccggcagccgcccggcaaggggctcgagtggctgggcgtcatctggggcgggggcagcacctactacaactccgccctcaagagccgcctctccatcagcaaggacaactccaagagccaggtgttcctgaagaactccctgcagaccgacgacaccgcgtactactgcgccaaggagaagcggcgcgggtactactacgccgactactggggccaggggacgagcgtgaccgtctccagcgcctccaccaagggccccagcgtgttccccctcgccccctccagcaagagcacctccggcgggacggcggccctgggctgcctggtgaaggactacttccccgagcccgtcaccgtgagctggaactccggggccctcaccagcggcgtgcacaccttcccggccgtcctgcagtccagcggcctgtactccctcagctccgtggtgacggtccccagctccagcctggggacccagacctacatctgcaacgtgaaccacaagccctccaacaccaaggtggacaagaaggcggagcccaagagctgcgacaagacgcacacgtgcccgccctgccccgcccccgagctgctcggcgggccgtccgtcttcctgttcccgcccaagcccaaggacaccctgatcagccggacccccgaggtgacctgcgtggtcgtggacgtgtcccacgaggaccccgaggtcaagttcaactggtacgtggacggcgtcgaggtgcacaacgccaagaccaagccccgcgaggagcagtacaacagcacctaccgggtggtctccgtgctcaccgtgctgcaccaggactggctgaacgggaaggagtacaagtgcaaggtcagcaacaaggccctccccgccccgatcgagaagacgatcagcaaggcgaagggccagccccgcgagccccaggtgtacaccctgcccccgtcccgggacgagctgaccaagaaccaggtgagcctgacctgcctggtcaagggcttctacccctccgacatcgccgtggagtgggagagcaacgggcagcccgagaacaactacaagacgaccccgcccgtgctggactccgacggcagcttcttcctctactccaagctgaccgtcgacaagagccgctggcagcaggggaacgtgttctcctgcagcgtgcacgaggccctgcacaaccactacacccagaagtccctcagcctgtcccccggcaag

SEQ ID NO: 8123 - RNA, 639 nt, synthetic construct
  misc_feature 1..639: note = derived and/or modified sequence opt1 from Iodine_(131I)_derlotuxiab_biotin_LightChain1
  source 1..639: mol_type = other RNA
gagaacgtgctgacccagagccccgccatctccgccagcccgggcgagaaggtcaccacgtgccgcgcgtccagctccgtgagctccagctacctccactggtaccagcagaagtccggggccagccccaagctgtggatctactccaccagcaacctggcctccggcgtgcccgcccggttcagcgggtccggcagcgggacctcctacagcctcaccatctccagcgtcgaggccgaggacgcggccacgtactactgccagcagtacagcggctaccccctgaccttcggcgggggcaccaagctggagatcaagcgcaccgtggccgccccgtccgtgttcatcttcccgcccagcgacgagcagctcaagtccgggacggcgagcgtcgtgtgcctgctgaacaacttctacccccgggaggccaaggtgcagtggaaggtcgacaacgccctccagtccggcaacagccaggagtccgtgaccgagcaggacagcaaggactccacctacagcctgtccagcaccctgacgctctccaaggccgactacgagaagcacaaggtgtacgcctgcgaggtcacccaccaggggctgagctcccccgtgaccaagagcttcaaccgcggcgagtgc

SEQ ID NO: 8124 - RNA, 1350 nt, synthetic construct
  misc_feature 1..1350: note = derived and/or modified sequence opt1 from Iodine_(131I)_Derlotuximab_biotin_HeavyChain1
  source 1..1350: mol_type = other RNA
caggtgcagctgaaggagagcggccccgggctcgtcgccccgtcccagagcctgtccatcacgtgcaccgtgagcggcttctccctgaccgactacggggtgcgctggatccggcagccgcccggcaaggggctcgagtggctgggcgtcatctggggcgggggcagcacctactacaactccgccctcaagagccgcctctccatcagcaaggacaactccaagagccaggtgttcctgaagatgaactccctgcagaccgacgacaccgcgatgtactactgcgccaaggagaagcggcgcgggtactactacgccatggactactggggccaggggacgagcgtgaccgtctccagcgcctccaccaagggccccagcgtgttccccctcgccccctccagcaagagcacctccggcgggacggcggccctgggctgcctggtgaaggactacttccccgagcccgtcaccgtgagctggaactccggggccctcaccagcggcgtgcacaccttcccggccgtcctgcagtccagcggcctgtactccctcagctccgtggtgacggtccccagctccagcctggggacccagacctacatctgcaacgtgaaccacaagccctccaacaccaaggtggacaagaaggcggagcccaagagctgcgacaagacgcacacgtgcccgccctgccccgcccccgagctgctcggcgggccgtccgtcttcctgttcccgcccaagcccaaggacaccctgatgatcagccggacccccgaggtgacctgcgtggtcgtggacgtgtcccacgaggaccccgaggtcaagttcaactggtacgtggacggcgtcgaggtgcacaacgccaagaccaagccccgcgaggagcagtacaacagcacctaccgggtggtctccgtgctcaccgtgctgcaccaggactggctgaacgggaaggagtacaagtgcaaggtcagcaacaaggccctccccgccccgatcgagaagacgatcagcaaggcgaagggccagccccgcgagccccaggtgtacaccctgcccccgtcccgggacgagctgaccaagaaccaggtgagcctgacctgcctggtcaagggcttctacccctccgacatcgccgtggagtgggagagcaacgggcagcccgagaacaactacaagacgaccccgcccgtgctggactccgacggcagcttcttcctctactccaagctgaccgtcgacaagagccgctggcagcaggggaacgtgttctcctgcagcgtgatgcacgaggccctgcacaaccactacacccagaagtccctcagcctgtcccccggcaag

SEQ ID NO: 8125 - RNA, 645 nt, synthetic construct
  misc_feature 1..645: note = derived and/or modified sequence opt1 from Iodine_(131I)_Derlotuximab_biotin_LightChain1
  source 1..645: mol_type = other RNA
gagaacgtgctgacccagagccccgccatcatgtccgccagcccgggcgagaaggtcaccatgacgtgccgcgcgtccagctccgtgagctccagctacctccactggtaccagcagaagtccggggccagccccaagctgtggatctactccaccagcaacctggcctccggcgtgcccgcccggttcagcgggtccggcagcgggacctcctacagcctcaccatctccagcgtcgaggccgaggacgcggccacgtactactgccagcagtacagcggctaccccctgaccttcggcgggggcaccaagctggagatcaagcgcaccgtggccgccccgtccgtgttcatcttcccgcccagcgacgagcagctcaagtccgggacggcgagcgtcgtgtgcctgctgaacaacttctacccccgggaggccaaggtgcagtggaaggtcgacaacgccctccagtccggcaacagccaggagtccgtgaccgagcaggacagcaaggactccacctacagcctgtccagcaccctgacgctctccaaggccgactacgagaagcacaaggtgtacgcctgcgaggtcacccaccaggggctgagctcccccgtgaccaagagcttcaaccgcggcgagtgc

SEQ ID NO: 8126 - RNA, 1344 nt, synthetic construct
  misc_feature 1..1344: note = derived and/or modified sequence opt1 from Ipilimumab_HeavyChain
  source 1..1344: mol_type = other RNA
caggtgcagctggtcgagagcggcgggggcgtggtgcagcccgggcgctccctccggctgagctgcgccgcctccggcttcaccttcagctcctacaccatgcactgggtccgccaggcgccggggaagggcctggagtgggtgacgttcatcagctacgacggcaacaacaagtactacgccgactccgtgaaggggcggttcaccatcagccgcgacaactccaagaacaccctctacctgcagatgaacagcctgcgggccgaggacaccgccatctactactgcgcccgcacgggctggctcgggcccttcgactactggggccaggggaccctggtcaccgtgtccagcgcgtccaccaagggccccagcgtgttccccctggccccgtccagcaagtccacgagcggcgggaccgccgccctcggctgcctggtcaaggactacttccccgagcccgtgaccgtgtcctggaacagcggggcgctgaccagcggcgtccacacgttccccgccgtgctccagtccagcggcctgtactccctgagctccgtggtcaccgtgccgagctccagcctcgggacccagacctacatctgcaacgtgaaccacaagccctccaacacgaaggtcgacaagcgggtggagcccaagagctgcgacaagacccacacgtgcccgccctgccccgcccccgagctgctgggcgggccctccgtgttcctcttcccgcccaagcccaaggacaccctgatgatcagccgcacccccgaggtgacctgcgtcgtggtcgacgtgtcccacgaggacccggaggtcaagttcaactggtacgtggacggcgtggaggtccacaacgccaagaccaagccccgggaggagcagtacaacagcacctaccgcgtggtgtccgtcctgacggtgctccaccaggactggctgaacgggaaggagtacaagtgcaaggtgagcaacaaggccctgcccgcgcccatcgagaagaccatctccaaggccaagggccagccgcgggagccccaggtctacaccctcccgcccagccgcgacgagctgaccaagaaccaggtgtccctgacgtgcctcgtgaagggcttctaccccagcgacatcgccgtcgagtgggagagcaacgggcagcccgagaacaactacaagaccacgcccccggtgctggactccgacggcagcttcttcctgtactccaagctcaccgtggacaagagccggtggcagcaggggaacgtcttctcctgcagcgtgatgcacgaggccctgcacaaccactacacccagaagtccctgagcctctcccccggcaag

SEQ ID NO: 8127 - RNA, 645 nt, synthetic construct
  misc_feature 1..645: note = derived and/or modified sequence opt1 from Ipilimumab_LightChain
  source 1..645: mol_type = other RNA
gagatcgtgctgacccagagccccggcaccctctccctgagcccgggggagcgcgccacgctgtcctgccgggccagccagtccgtcggcagctcctacctcgcgtggtaccagcagaagcccgggcaggcgccccgcctgctgatctacggcgccttcagccgggccaccgggatccccgaccgcttctccggcagcggctccgggaccgacttcaccctcacgatcagccggctggagccggaggacttcgccgtgtactactgccagcagtacggctccagcccctggaccttcgggcagggcaccaaggtggagatcaagcgcaccgtcgccgccccctccgtgttcatcttcccgcccagcgacgagcagctgaagtccgggacggccagcgtggtctgcctcctgaacaacttctacccccgggaggccaaggtgcagtggaaggtggacaacgcgctgcagtccggcaacagccaggagagcgtcaccgagcaggactccaaggacagcacctactccctcagctccaccctgacgctgagcaaggccgactacgagaagcacaaggtgtacgcctgcgaggtgacccaccagggcctctccagccccgtcaccaagtccttcaaccgcggggagtgc

SEQ ID NO: 8128 - RNA, 186 nt, synthetic construct
  misc_feature 1..186: note = derived and/or modified sequence opt1 from Iratumumab_HeavyChain1
  source 1..186: mol_type = other RNA
caggtgcagctgcagcagtggggcgccgggctcctgaagcccagcgagaccctgtccctgacctgcgccgtctacggcgggagcttctccgcgtactactggagctggatccgccagccgcccggcaaggggctcgagtggatcggcgactactggggccaggggtccctggtgacggtgagctcc

SEQ ID NO: 8129 - RNA, 321 nt, synthetic construct
  misc_feature 1..321: note = derived and/or modified sequence opt1 from Iratumumab_LightChain1
  source 1..321: mol_type = other RNA
gacatccagatgacccagagccccacctccctgagcgcctccgtgggcgaccgcgtcacgatcacgtgccgggccagccaggggatctccagctggctcacctggtaccagcagaagccggagaaggcgcccaagtccctgatctacgccgccagctccctgcagagcggcgtgccctcccgcttcagcgggtccggcagcgggaccgacttcaccctcaccatctccagcctgcagcccgaggacttcgccacctactactgccagcagtacgactcctacccgatcaccttcggccagggcacgcggctggagatcaag

SEQ ID NO: 8130 - RNA, 1350 nt, synthetic construct
  misc_feature 1..1350: note = derived and/or modified sequence opt1 from Isatuximab_HeavyChain1
  source 1..1350: mol_type = other RNA
caggtgcagctggtccagagcggcgccgaggtggccaagcccgggacctccgtgaagctcagctgcaaggcgtccggctacaccttcacggactactggatgcagtgggtcaagcagcgcccggggcagggcctggagtggatcgggaccatctaccccggcgacggcgacaccgggtacgcccagaagttccagggcaaggccaccctgacggccgacaagagctccaagaccgtgtacatgcacctcagctccctggccagcgaggactccgcggtgtactactgcgcccgcggggactactacggcagcaactccctggactactgggggcagggcaccagcgtcaccgtgtccagcgcctccacgaagggccccagcgtgttccccctcgccccgtccagcaagtccaccagcgggggcaccgcggccctggggtgcctggtcaaggactacttccccgagcccgtgaccgtgagctggaactccggcgccctcacgagcggcgtccacaccttccccgccgtgctgcagtccagcgggctgtactccctcagctccgtggtcaccgtgccgagctccagcctgggcacccagacgtacatctgcaacgtgaaccacaagccctccaacaccaaggtcgacaagaaggtggagcccaagagctgcgacaagacccacacgtgcccgccctgccccgcccccgagctgctcgggggcccctccgtgttcctgttcccgcccaagcccaaggacaccctgatgatcagccggacccccgaggtgacctgcgtcgtggtcgacgtgtcccacgaggacccggaggtcaagttcaactggtacgtggacggggtggaggtccacaacgcgaagaccaagccccgggaggagcagtacaacagcacgtaccgcgtggtgtccgtcctcaccgtgctgcaccaggactggctgaacggcaaggagtacaagtgcaaggtgagcaacaaggccctccccgcccccatcgagaagaccatctccaaggccaagggccagccgcgggagccccaggtctacaccctgccgcccagccgcgacgagctgacgaagaaccaggtgagcctgacctgcctcgtgaaggggttctacccctccgacatcgccgtcgagtgggagagcaacggccagcccgagaacaactacaagaccacgcccccggtgctggactccgacgggagcttcttcctctactccaagctgaccgtggacaagagccggtggcagcagggcaacgtcttctcctgcagcgtgatgcacgaggcgctgcacaaccactacacccagaagtccctcagcctgtcccccgggaag

SEQ ID NO: 8131 - RNA, 642 nt, synthetic construct
  misc_feature 1..642: note = derived and/or modified sequence opt1 from Isatuximab_LightChain1
  source 1..642: mol_type = other RNA
gacatcgtgatgacccagagccacctgtccatgagcacctccctcggcgaccccgtcagcatcacgtgcaaggcctcccaggacgtgagcaccgtggtcgcctggtaccagcagaagccggggcagagcccccgccggctgatctacagcgcgtcctaccgctacatcggcgtgcccgaccggttcaccgggagcggcgccgggaccgacttcacgttcaccatctccagcgtgcaggccgaggacctggccgtctactactgccagcagcactactccccgccctacaccttcggcggcgggaccaagctcgagatcaagcgcacggtggccgcgcccagcgtgttcatcttcccgccctccgacgagcagctgaagtccggcaccgcctccgtcgtgtgcctgctcaacaacttctacccccgggaggccaaggtgcagtggaaggtcgacaacgccctgcagagcgggaactcccaggagagcgtgaccgagcaggacagcaaggactccacctacagcctgtccagcacgctcaccctgtccaaggcggactacgagaagcacaaggtgtacgcctgcgaggtcacccaccagggcctgagctcccccgtgaccaagagcttcaaccgcggggagtgc

SEQ ID NO: 8132 - RNA, 1347 nt, synthetic construct
  misc_feature 1..1347: note = derived and/or modified sequence opt1 from Itolizumab_HeavyChain1
  source 1..1347: mol_type = other RNA
gaggtgcagctggtcgagagcggcgggggcctcgtgaagcccgggggctccctgaagctgagctgcgccgcctccgggttcaagttcagccgctacgcgatgtcctgggtgcggcaggccccgggcaagcgcctcgagtgggtcgccaccatcagctccggcgggagctacatctactaccccgactccgtgaagggccggttcaccatcagccgcgacaacgtgaagaacacgctgtacctgcagatgtccagcctccggtccgaggacaccgccatgtactactgcgcccgccgggactacgacctggactacttcgacagctgggggcagggcaccctggtcaccgtgtccagcgcgtccacgaaggggcccagcgtgttccccctcgccccgtccagcaagagcacctccggcggcaccgccgccctggggtgcctggtcaaggactacttccccgagcccgtgaccgtgagctggaactccggcgcgctcacgagcggggtccacaccttccccgccgtgctgcagtccagcggcctgtactccctcagctccgtggtcaccgtgccgagctccagcctgggcacccagacgtacatctgcaacgtgaaccacaagccctccaacaccaaggtcgacaagaaggtggagcccaagagctgcgacaagacccacacgtgcccgccctgccccgcccccgagctgctcgggggcccctccgtgttcctgttcccgcccaagcccaaggacaccctgatgatcagccgcacccccgaggtgacctgcgtcgtggtcgacgtgtcccacgaggacccggaggtcaagttcaactggtacgtggacggggtggaggtccacaacgccaagaccaagccccgggaggagcagtacaacagcacgtaccgcgtggtgtccgtcctcaccgtgctgcaccaggactggctgaacggcaaggagtacaagtgcaaggtgagcaacaaggccctccccgcgcccatcgagaagaccatcagcaaggccaaggggcagccgcgggagccccaggtctacaccctgccgccctcccgcgacgagctgacgaagaaccaggtgagcctgacctgcctcgtgaagggcttctacccctccgacatcgccgtcgagtgggagagcaacggccagcccgagaacaactacaagaccacgcccccggtgctggactccgacgggagcttcttcctctactccaagctgaccgtggacaagagccggtggcagcagggcaacgtcttctcctgcagcgtgatgcacgaggccctgcacaaccactacacccagaagtccctcagcctgtcccccgggaag

SEQ ID NO: 8133 - RNA, 642 nt, synthetic construct
  misc_feature 1..642: note = derived and/or modified sequence opt1 from Itolizumab_LightChain1
  source 1..642: mol_type = other RNA
gacatccagatgacgcagagcccctccagcctgtccgccagcgtgggcgaccgcgtcaccatcacgtgcaaggcctcccgggacatccgcagctacctcacctggtaccagcagaagccggggaaggcgcccaagaccctgatctactacgccacctccctggccgacggcgtgcccagccggttctccgggagcggctccgggcaggactacagcctcacgatctccagcctggagtccgacgacaccgccacctactactgcctgcagcacggcgagagccccttcaccctcggctccgggacgaagctggagatcaagcgcaccgtggccgcgccgagcgtcttcatcttcccgccctccgacgagcagctcaagagcggcaccgccagcgtggtgtgcctgctgaacaacttctacccccgggaggccaaggtccagtggaaggtggacaacgccctgcagtccgggaacagccaggagtccgtgaccgagcaggacagcaaggactccacgtacagcctctccagcaccctgaccctgtccaaggcggactacgagaagcacaaggtctacgcctgcgaggtgacccaccagggcctcagctcccccgtgaccaagagcttcaaccgcggggagtgc

SEQ ID NO: 8134 - RNA, 1335 nt, synthetic construct
  misc_feature 1..1335: note = derived and/or modified sequence opt1 from Ixekizumab_HeavyChain1
  source 1..1335: mol_type = other RNA
caggtgcagctggtccagagcggcgccgaggtgaagaagcccgggtccagcgtgaaggtctcctgcaaggccagcggctactccttcaccgactaccacatccactgggtgcgccaggcgccggggcagggcctcgagtggatgggggtgatcaaccccatgtacggcaccacggactacaaccagcggttcaagggccgcgtcaccatcaccgccgacgagagcacctccacggcctacatggagctgagctccctgcggagcgaggacaccgccgtgtactactgcgcccgctacgactacttcaccgggaccggcgtgtactgggggcagggcacgctcgtcaccgtgtccagcgcgtccaccaaggggcccagcgtgttccccctggccccgtgctcccggagcacctccgagagcacggccgccctgggctgcctcgtcaaggactacttccccgagcccgtgaccgtgtcctggaacagcggcgcgctgaccagcggggtccacaccttccccgccgtgctgcagtccagcggcctctactccctgagctccgtggtcacggtgccgagctccagcctggggaccaagacctacacgtgcaacgtggaccacaagccctccaacaccaaggtcgacaagcgcgtggagagcaagtacggcccgccctgcccgccctgccccgcccccgagttcctcggcgggccctccgtgttcctgttcccgcccaagcccaaggacaccctgatgatcagccggacccccgaggtgacctgcgtcgtcgtggacgtgtcccaggaggaccccgaggtccagttcaactggtacgtggacggcgtggaggtccacaacgccaagacgaagccccgcgaggagcagttcaacagcacctaccgggtggtgtccgtcctcaccgtgctgcaccaggactggctgaacgggaaggagtacaagtgcaaggtgagcaacaagggcctcccctccagcatcgagaagaccatctccaaggccaaggggcagccgcgcgagccccaggtctacacgctgccgcccagccaggaggagatgaccaagaaccaggtgagcctgacctgcctcgtgaagggcttctacccctccgacatcgcggtcgagtgggagagcaacggccagcccgagaacaactacaagaccacgcccccggtgctggactccgacgggagcttcttcctgtactcccggctcaccgtggacaagagccgctggcaggagggcaacgtcttctcctgcagcgtgatgcacgaggccctgcacaaccactacacccagaagtccctgagcctctccctgggg

SEQ ID NO: 8135 - RNA, 657 nt, synthetic construct
  misc_feature 1..657: note = derived and/or modified sequence opt1 from Ixekizumab_LightChain1
  source 1..657: mol_type = other RNA
gacatcgtgatgacccagacgcccctgagcctctccgtcaccccgggccagcccgccagcatctcctgccgcagctcccggagcctggtgcactcccgcgggaacacctacctgcactggtacctccagaagcccggccagagcccccagctgctgatctacaaggtgtccaaccggttcatcggggtcccggaccgcttcagcggctccgggagcggcaccgacttcaccctcaagatctcccgggtggaggccgaggacgtgggcgtctactactgcagccagtccacgcacctccccttcaccttcgggcagggcaccaagctggagatcaagcgcaccgtggcggcccccagcgtgttcatcttcccgccctccgacgagcagctcaagagcgggacggcctccgtcgtgtgcctgctgaacaacttctacccccgggaggccaaggtgcagtggaaggtcgacaacgccctgcagagcggcaacagccaggagtccgtgaccgagcaggacagcaaggactccacctacagcctgtccagcaccctgacgctctccaaggcggactacgagaagcacaaggtgtacgcctgcgaggtcacccaccaggggctgagctcccccgtgaccaagagcttcaaccgcggcgagtgc

SEQ ID NO: 8136 - RNA, 1347 nt, synthetic construct
  misc_feature 1..1347: note = derived and/or modified sequence opt1 from Labetuzumab_govitecan_HeavyChain1
  source 1..1347: mol_type = other RNA
gaggtgcagctggtcgagagcggcgggggcgtggtgcagcccgggcgctccctccggctgagctgctccgccagcggcttcgacttcaccacctactggatgtcctgggtccgccaggccccggggaagggcctggagtggatcggcgagatccaccccgacagctccaccatcaactacgcgcccagcctcaaggaccggttcaccatctcccgcgacaacgccaagaacaccctgttcctgcagatggacagcctccggcccgaggacaccggggtgtacttctgcgcctccctgtacttcggcttcccgtggttcgcctactgggggcagggcacgcccgtgaccgtcagctccgccagcaccaaggggccctccgtgttccccctggcgccgagctccaagagcacctccggcggcacggccgccctcgggtgcctggtgaaggactacttccccgagcccgtcaccgtgagctggaacagcggcgccctgacctccggggtgcacaccttccccgcggtcctccagagctccggcctgtacagcctgtccagcgtggtgacggtcccgtccagctccctcggcacccagacctacatctgcaacgtgaaccacaagcccagcaacaccaaggtggacaagcgcgtcgagcccaagtcctgcgacaagacgcacacgtgcccgccctgccccgcccccgagctgctcgggggccccagcgtgttcctcttcccgcccaagcccaaggacaccctgatgatctcccggacccccgaggtgacctgcgtcgtggtggacgtcagccacgaggacccggaggtgaagttcaactggtacgtcgacggggtggaggtgcacaacgccaagaccaagccccgcgaggagcagtacaactccacctaccgggtcgtgagcgtgctgaccgtcctccaccaggactggctgaacggcaaggagtacaagtgcaaggtgtccaacaaggccctgcccgcccccatcgagaagacgatcagcaaggcgaaggggcagccgcgcgagccccaggtgtacaccctgcccccgtcccgggaggagatgaccaagaaccaggtcagcctgacctgcctggtgaagggcttctaccccagcgacatcgccgtggagtgggagtccaacggccagcccgagaacaactacaagacgacgcccccggtcctcgacagcgacgggtccttcttcctgtacagcaagctgaccgtggacaagtcccgctggcagcagggcaacgtgttcagctgctccgtcatgcacgaggccctccacaaccactacacccagaagtccctgagcctgagccccgggaag

SEQ ID NO: 8137 - RNA, 639 nt, synthetic construct
  misc_feature 1..639: note = derived and/or modified sequence opt1 from Labetuzumab_govitecan_LightChain1
  source 1..639: mol_type = other RNA
gacatccagctgacccagagcccctccagcctctccgccagcgtgggcgaccgcgtcaccatcacgtgcaaggcctcccaggacgtggggaccagcgtggcgtggtaccagcagaagccgggcaaggcccccaagctgctgatctactggacctccacccggcacacgggggtccccagccgcttctccggcagcgggtccggcaccgacttcaccttcaccatcagctccctccagcccgaggacatcgccacgtactactgccagcagtacagcctgtaccggtccttcggccaggggaccaaggtggagatcaagcgcaccgtggccgccccgagcgtcttcatcttcccgccctccgacgagcagctcaagagcggcaccgcgtccgtggtgtgcctgctgaacaacttctacccccgggaggccaaggtccagtggaaggtggacaacgccctgcagagcgggaacagccaggagtccgtgacggagcaggacagcaaggactccacctacagcctctccagcaccctgaccctgtccaaggccgactacgagaagcacaaggtctacgcgtgcgaggtgacgcaccagggcctcagctcccccgtgaccaagagcttcaaccgcggggagtgc

SEQ ID NO: 8138 - RNA, 1341 nt, synthetic construct
  misc_feature 1..1341: note = derived and/or modified sequence opt1 from Lambrolizumab_HeavyChain1
  source 1..1341: mol_type = other RNA
caggtgcagctggtccagagcggcgtggaggtgaagaagcccggggcctccgtcaaggtgagctgcaaggcctccggctacaccttcaccaactactacatgtactgggtgcgccaggcgcccgggcagggcctcgagtggatgggcgggatcaaccccagcaacggcgggacgaacttcaacgagaagttcaagaaccgggtcaccctgaccaccgactccagcacgaccaccgcctacatggagctgaagtccctccagttcgacgacaccgccgtgtactactgcgcccgccgggactaccgcttcgacatgggcttcgactactgggggcagggcacgaccgtgaccgtcagctccgccagcaccaaggggccctccgtgttccccctggcgccgtgcagccggtccacgagcgagtccaccgccgccctgggctgcctcgtgaaggactacttccccgagcccgtcaccgtgagctggaactccggcgccctgaccagcggggtgcacacgttccccgcggtcctgcagtccagcggcctctacagcctgtccagcgtggtgaccgtcccgtccagctccctggggaccaagacctacacgtgcaacgtggaccacaagcccagcaacaccaaggtggacaagcgcgtcgagtccaagtacggcccgccctgcccgccctgccccgcccccgagttcctcggcgggccgagcgtgttcctgttcccgcccaagcccaaggacaccctgatgatctcccggacccccgaggtgacgtgcgtcgtggtcgacgtgagccaggaggaccccgaggtgcagttcaactggtacgtcgacggcgtggaggtgcacaacgccaagaccaagccccgcgaggagcagttcaactccacctaccgggtcgtgagcgtgctcaccgtcctgcaccaggactggctgaacgggaaggagtacaagtgcaaggtgtccaacaagggcctccccagctccatcgagaagacgatcagcaaggccaaggggcagccgcgcgagccccaggtgtacaccctgccgccctcccaggaggagatgaccaagaaccaggtcagcctgacctgcctcgtgaagggcttctacccctccgacatcgccgtggagtgggagagcaacggccagcccgagaacaactacaagacgaccccgcccgtcctggacagcgacgggtccttcttcctgtacagccggctcaccgtggacaagtcccgctggcaggagggcaacgtgttcagctgctccgtcatgcacgaggcgctgcacaaccactacacccagaagtccctgagcctcagcctggggaag

SEQ ID NO: 8139 - RNA, 654 nt, synthetic construct
  misc_feature 1..654: note = derived and/or modified sequence opt1 from Lambrolizumab_LightChain1
  source 1..654: mol_type = other RNA
gagatcgtgctgacccagagccccgccaccctctccctgagcccgggcgagcgcgccacgctgtcctgccgggcgagcaagggggtctccaccagcggctactcctacctccactggtaccagcagaagcccgggcaggcgccccgcctgctgatctacctcgccagctacctggagtccggcgtgcccgcccggttcagcgggtccggcagcggcaccgacttcaccctgacgatctccagcctcgagccggaggacttcgccgtgtactactgccagcactcccgcgacctgcccctgaccttcgggggcgggaccaaggtcgagatcaagcggaccgtggccgcccccagcgtgttcatcttcccgccctccgacgagcagctcaagagcggcacggcctccgtcgtgtgcctgctgaacaacttctacccccgcgaggccaaggtgcagtggaaggtcgacaacgcgctccagagcgggaacagccaggagtccgtgaccgagcaggacagcaaggactccacctacagcctgtccagcaccctgacgctctccaaggccgactacgagaagcacaaggtgtacgcctgcgaggtcacccaccagggcctgagctcccccgtgaccaagagcttcaaccggggcgagtgc

SEQ ID NO: 8140 - RNA, 669 nt, synthetic construct
  misc_feature 1..669: note = derived and/or modified sequence opt1 from Lampalizumab_HeavyChain1
  source 1..669: mol_type = other RNA
gaggtgcagctggtccagagcggccccgagctcaagaagccgggggcctccgtgaaggtgagctgcaaggcctccggctacaccttcaccaactacgggatgaactgggtccgccaggcgcccggccaggggctggagtggatgggctggatcaacacgtacaccggcgagaccacctacgccgacgacttcaaggggcggttcgtgttcagcctggacacgtccgtgagcaccgcctacctccagatctccagcctgaaggccgaggacaccgccgtctactactgcgagcgcgagggcggggtgaacaactggggccaggggaccctggtgacggtctccagcgcgtccaccaagggccccagcgtgttccccctcgccccgtccagcaagtccaccagcggcgggaccgccgccctgggctgcctggtgaaggactacttccccgagcccgtcacggtgtcctggaacagcggggcgctcacctccggcgtgcacaccttccccgccgtcctgcagagcagcggcctgtactccctcagctccgtggtgaccgtcccgagctccagcctggggacgcagacctacatctgcaacgtgaaccacaagccctccaacaccaaggtggacaagaaggtcgagcccaagagctgcgacaagacccacacg

SEQ ID NO: 8141 - RNA, 642 nt, synthetic construct
  misc_feature 1..642: note = derived and/or modified sequence opt1 from Lampalizumab_LightChain1
  source 1..642: mol_type = other RNA
gacatccaggtgacccagagcccctccagcctgtccgccagcgtcggcgaccgcgtgaccatcacgtgcatcacctccaccgacatcgacgacgacatgaactggtaccagcagaagccggggaaggtgcccaagctcctgatcagcggcgggaacaccctgcggcccggcgtcccctcccgcttcagcgggtccggcagcggcacggacttcaccctcaccatctccagcctgcagccggaggacgtggccacctactactgcctgcagtccgacagcctcccctacacgttcgggcagggcaccaaggtggagatcaagcggaccgtcgcggccccctccgtgttcatcttcccgcccagcgacgagcagctgaagtccgggaccgccagcgtggtctgcctgctcaacaacttctacccccgcgaggccaaggtgcagtggaaggtggacaacgccctgcagtccggcaacagccaggagagcgtcacggagcaggactccaaggacagcacctactccctgagctccaccctcaccctgagcaaggcggactacgagaagcacaaggtgtacgcctgcgaggtgacgcaccaggggctgtccagccccgtcaccaagtccttcaaccggggcgagtgc

SEQ ID NO: 8142 - RNA, 1353 nt, synthetic construct
  misc_feature 1..1353: note = derived and/or modified sequence opt1 from Lanadelumab_HeavyChain1
  source 1..1353: mol_type = other RNA
gaggtgcagctgctcgagagcggcgggggcctggtccagcccgggggctccctgcgcctcagctgcgccgcctccgggttcaccttcagccactacatcatgatgtgggtgcggcaggcgccgggcaagggcctggagtgggtgtccgggatctacagctccggcgggatcaccgtctacgccgacagcgtgaagggccgcttcacgatctcccgggacaacagcaagaacaccctgtacctccagatgaactccctgcgcgccgaggacaccgccgtgtactactgcgcctaccggcgcatcggggtcccccggcgcgacgagttcgacatctggggccagggcaccatggtgacggtgagctccgcgagcaccaaggggccctccgtcttccccctggccccgagctccaagagcacctccggcgggaccgccgccctcggctgcctggtgaaggactacttccccgagcccgtgacggtcagctggaacagcggcgcgctgacctccggggtgcacaccttccccgccgtgctccagagctccggcctgtacagcctgtccagcgtcgtgaccgtgccgtccagctccctcgggacgcagacctacatctgcaacgtcaaccacaagcccagcaacaccaaggtggacaagcgggtggagcccaagtcctgcgacaagacccacacgtgcccgccctgccccgcccccgagctgctgggcgggcccagcgtcttcctcttcccgcccaagcccaaggacaccctgatgatctcccgcacccccgaggtgacctgcgtggtcgtggacgtcagccacgaggacccggaggtgaagttcaactggtacgtggacggcgtcgaggtgcacaacgccaagacgaagccccgggaggagcagtacaactccacctaccgcgtggtcagcgtgctgaccgtgctccaccaggactggctgaacggcaaggagtacaagtgcaaggtctccaacaaggccctgcccgcgcccatcgagaagaccatcagcaaggccaaggggcagccgcgggagccccaggtgtacacgctcccgccctcccgcgaggagatgaccaagaaccaggtgagcctgacctgcctggtcaagggcttctaccccagcgacatcgccgtggagtgggagtccaacgggcagcccgagaacaactacaagaccacgcccccggtgctcgacagcgacggctccttcttcctgtacagcaagctgaccgtcgacaagtcccggtggcagcaggggaacgtgttcagctgctccgtgatgcacgaggccctccacaaccactacacccagaagtccctgagcctgagccccggc

SEQ ID NO: 8143 - RNA, 639 nt, synthetic construct
  misc_feature 1..639: note = derived and/or modified sequence opt1 from Lanadelumab_LightChain1
  source 1..639: mol_type = other RNA
gacatccagatgacccagagcccctccaccctgagcgcctccgtgggcgaccgcgtcacgatcacgtgccgggccagccagtccatcagctcctggctcgcgtggtaccagcagaagccggggaaggcccccaagctgctgatctacaaggccagcaccctcgagtccggcgtgcccagccgcttctccgggagcggctccgggaccgagttcaccctgaccatcagctccctgcagcccgacgacttcgccacctactactgccagcagtacaacacctactggacgttcggccagggcaccaaggtggagatcaagcggaccgtcgccgcgccgagcgtgttcatcttcccgccctccgacgagcagctcaagagcgggaccgcctccgtggtctgcctgctgaacaacttctacccccgcgaggccaaggtgcagtggaaggtggacaacgccctccagagcggcaacagccaggagtccgtcacggagcaggacagcaaggactccacctacagcctgtccagcaccctgaccctctccaaggcggactacgagaagcacaaggtgtacgcctgcgaggtgacgcaccaggggctgagctcccccgtcaccaagagcttcaaccggggcgagtgc

SEQ ID NO: 8144 - RNA, 1317 nt, synthetic construct
  misc_feature 1..1317: note = derived and/or modified sequence opt1 from Landogrozumab_HeavyChain1
  source 1..1317: mol_type = other RNA
gaggtgcagctggtcgagagcggcgggggcctcgtgcagcccgggggctccctgcgcctgagctgcgccgcctccgggctcaccttcagccggtacccgatgtcctgggtgcgccaggcgcccggcaagggcctggtctgggtgagcgccatcacctccagcgggggctccacgtactacagcgacaccgtgaaggggcggttcaccatctcccgcgacaacgccaagaacaccctgtacctccagatgaacagcctgcgggccgaggacacggccgtctactactgcgcgcgcctgcccgactactggggccaggggaccctcgtgaccgtgtccagcgcctccaccaagggccccagcgtcttcccgctggccccctgctcccggagcacgtccgagagcaccgccgcgctgggctgcctcgtgaaggactacttccccgagcccgtgaccgtcagctggaactccggggccctgaccagcggcgtgcacacgttcccggccgtgctgcagtccagcgggctctactccctgagctccgtcgtgaccgtgcccagctccagcctgggcaccaagacctacacgtgcaacgtcgaccacaagccctccaacaccaaggtggacaagcgcgtggagagcaagtacgggcccccgtgcccgccctgccccgcccccgagttcctcggcggcccctccgtcttcctgttcccgcccaagcccaaggacaccctgatgatcagccggacccccgaggtgacgtgcgtggtcgtggacgtctcccaggaggaccccgaggtgcagttcaactggtacgtggacggggtcgaggtgcacaacgccaagaccaagccccgcgaggagcagttcaacagcacctaccgggtggtctccgtgctcaccgtgctgcaccaggactggctgaacggcaaggagtacaagtgcaaggtcagcaacaaggggctcccgtccagcatcgagaagacgatcagcaaggcgaagggccagccccgcgagccccaggtgtacaccctgcccccgtcccaggaggagatgaccaagaaccaggtgagcctgacctgcctcgtcaagggcttctacccctccgacatcgccgtggagtgggagagcaacgggcagcccgagaacaactacaagacgaccccgcccgtgctggactccgacggcagcttcttcctgtactcccggctcaccgtcgacaagagccgctggcaggaggggaacgtgttctcctgcagcgtgatgcacgaggccctgcacaaccactacacccagaagtccctgagcctctccctgggc

SEQ ID NO: 8145 - RNA, 645 nt, synthetic construct
  misc_feature 1..645: note = derived and/or modified sequence opt1 from Landogrozumab_LightChain1
  source 1..645: mol_type = other RNA
gagatcgtgctgacccagagccccggcaccctctccctgagcccgggggagcgcgccacgctgtcctgccgggccagctccagcgtctccagctcctacctccactggtaccagcagaagcccggccaggcgccccgcctgctgatctacagcacctccaacctcgtggccgggatccccgaccggttcagcggctccgggagcggcaccgacttcaccctgacgatctcccgcctggagccggaggacttcgccgtgtactactgccagcaccacagcggctaccacttcaccttcgggggcgggaccaaggtcgagatcaagcggaccgtggccgccccctccgtgttcatcttcccgcccagcgacgagcagctcaagtccggcacggcgagcgtcgtgtgcctgctgaacaacttctacccccgcgaggccaaggtgcagtggaaggtcgacaacgccctccagagcgggaactcccaggagagcgtgaccgagcaggactccaaggacagcacctactccctgagctccaccctgacgctcagcaaggccgactacgagaagcacaaggtgtacgcgtgcgaggtcacccaccagggcctgtccagccccgtgaccaagtccttcaaccggggcgagtgc

SEQ ID NO: 8146 - RNA, 1344 nt, synthetic construct
  misc_feature 1..1344: note = derived and/or modified sequence opt1 from Laprituximab_emtansine_HeavyChain1
  source 1..1344: mol_type = other RNA
caggtgcagctggtccagagcggcgccgaggtggccaagcccggggcgtccgtgaagctcagctgcaaggcctccggctacaccttcaccagctactggatgcagtgggtcaagcagcgcccggggcagggcctggagtgcatcgggacgatctaccccggcgacggcgacaccacctacacccagaagttccaggggaaggccacgctgaccgccgacaagtccagctccaccgcctacatgcagctcagctccctgcggagcgaggactccgcggtgtactactgcgcccgctacgacgcccccggctacgccatggactactgggggcagggcaccctggtgacggtcagctccgcgagcaccaaggggccctccgtgttcccgctcgcccccagctccaagagcacctccggcggcaccgccgccctggggtgcctggtgaaggactacttccccgagcccgtcacggtgagctggaacagcggcgccctcacctccggggtgcacaccttcccggcggtcctgcagagctccggcctgtacagcctctccagcgtggtgaccgtcccctccagctccctgggcacgcagacctacatctgcaacgtgaaccacaagcccagcaacaccaaggtggacaagaaggtcgagcccaagtcctgcgacaagacccacacgtgcccgccctgccccgcccccgagctgctcgggggcccgagcgtgttcctgttcccgcccaagcccaaggacaccctgatgatctcccggacccccgaggtgacctgcgtcgtggtggacgtcagccacgaggaccccgaggtgaagttcaactggtacgtcgacggggtggaggtgcacaacgccaagacgaagccccgcgaggagcagtacaactccacctaccgggtcgtgagcgtgctcaccgtcctgcaccaggactggctgaacggcaaggagtacaagtgcaaggtgtccaacaaggccctccccgccccgatcgagaagaccatcagcaaggcgaaggggcagccccgcgagccccaggtgtacacgctgcccccgtcccgggacgagctgaccaagaaccaggtcagcctgacctgcctcgtgaagggcttctaccccagcgacatcgccgtggagtgggagtccaacggccagcccgagaacaactacaagaccacgccgcccgtcctggacagcgacgggtccttcttcctctacagcaagctgaccgtggacaagtcccgctggcagcagggcaacgtgttcagctgctccgtcatgcacgaggccctgcacaaccactacacccagaagtccctcagcctgagccccggg

SEQ ID NO: 8147 - RNA, 642 nt, synthetic construct
  misc_feature 1..642: note = derived and/or modified sequence opt1 from Laprituximab_emtansine_LightChain1
  source 1..642: mol_type = other RNA
gacatccagatgacccagagcccctccagcctgtccgccagcgtgggcgaccgcgtcaccatcacgtgccgggcctcccaggacatcaacaactacctcgcgtggtaccagcacaagccggggaagggccccaagctgctgatccactacaccagcaccctccaccccgggatcccctcccgcttcagcggctccgggagcggccgggactactccttcagcatctccagcctggagccggaggacatcgccacctactactgcctgcagtacgacaacctcctgtacacgttcggccaggggaccaagctggagatcaagcgcaccgtggccgccccctccgtgttcatcttcccgcccagcgacgagcagctcaagtccggcaccgccagcgtcgtgtgcctgctgaacaacttctacccccgggaggcgaaggtgcagtggaaggtcgacaacgccctccagtccgggaacagccaggagagcgtgacggagcaggactccaaggacagcacctactccctgagctccaccctgaccctcagcaaggccgactacgagaagcacaaggtgtacgcctgcgaggtcacgcaccagggcctgtccagccccgtgaccaagtccttcaaccgcggggagtgc

SEQ ID NO: 8148 - RNA, 1314 nt, synthetic construct
  misc_feature 1..1314: note = derived and/or modified sequence opt1 from Lealesoab_HeavyChain1
  source 1..1314: mol_type = other RNA
caggtgcagctgcaggagagcggccccgagctcaagaagccgggggagaccgtcaagatctcctgcaaggccagcggctacaccttccgcaactacgggaactgggtgaagcaggcccccggcaaggggctgaagtggggctggatcaacacctacaccggcgagcccacctacgcggacgacttcaaggggcggttcgccttctccctggagaccagcgcctccacggcctacctccagatcaacaacgtgaagaacgaggacaccgccacctacttctgcgcgcgcaagggctgggacttcaacgggagctccctggactactggggccaggggaccacggtcaccgtgagctccgccaagaccacgcccccgagcgtgtaccccctggcccccggctccgccgcgcagaccaacagcgtcaccctcggctgcctggtgaaggggtacttccccgagccggtgaccgtcacctggaactccggcagcctgtccagcggggtgcacacgttccccgccgtgctccagtccgacctgtacaccctgagctccagcgtcaccgtgcccagcagcccccggccgtccgagaccgtgacgtgcaacgtcgcccaccccgcctccagcaccaaggtggacaagaagatcgtgccccgcgactgcggctgcaagccctgcatctgcaccgtcccggaggtgtccagcgtgttcatcttcccgcccaagcccaaggacgtcctcaccatcacgctgacccccaaggtgacctgcgtggtcgtggacatctccaaggacgaccccgaggtccagttcagctggttcgtggacgacgtggaggtccacaccgcccagacgcagccccgggaggagcagttcaactccaccttccgcagcgtgtccgagctgcccatccaccaggactggctcaacggcaaggagttcaagtgccgggtgaacagcgcggccttcccggcccccatcgagaagaccatctccaagaccaaggggcgccccaaggcgccccaggtctacacgatcccgccgcccaaggagcaggccaaggacaaggtgagcctgacctgcatcaccgacttcttccccgaggacatcaccgtggagtggcagtggaacggccagcccgccgagaactacaagaacacgcagcccatcaacaccaacgggtcctacttcgtctacagcaagctgaacgtgcagaagtccaactgggaggccggcaacaccttcacgtgcagcgtgctccacgaggggctgcacaaccaccacaccgagaagtccctgagccacagccccggcaag

SEQ ID NO: 8149 - RNA, 654 nt, synthetic construct
  misc_feature 1..654: note = derived and/or modified sequence opt1 from Lealesoab_LightChain1
  source 1..654: mol_type = other RNA
gacatccagctgacccagacgcccctcagcctgccggtgtccctgggcgaccaggccagcatctcctgccgcagctcccagagcatcgtgcactccaacgggaacacctacctcgagtggtacctgcagaagcccggccagagccccaacctgctcatctacaaggtgtccaaccggttcagcggggtgcccgaccgcttctccggcagcgggtccggcaccgacttcaccctgaagatcagccgggtcgaggccgaggacctgggcgtgtactactgcttccaggggtcccacgtgccgcccaccttcggcgggggcacgaagctcgagatcaagcgcgcggacgccgcccccaccgtcagcatcttcccgccctccagcgagcagctgacctccgggggcgccagcgtggtgtgcttcctgaacaacttctaccccaaggacatcaacgtcaagtggaagatcgacggcagcgagcggcagaacggggtgctcaactcctggaccgaccaggacagcaaggactccacgtacagctccagcaccctgaccctgaccaaggacgagtacgagcgccacaactcctacacgtgcgaggccacccacaagaccagcacctcccccatcgtcaagagcttcaaccggaacgagtgc

SEQ ID NO: 8150 - RNA, 1335 nt, synthetic construct
  misc_feature 1..1335: note = derived and/or modified sequence opt1 from Lebrikizumab_HeavyChain1
  source 1..1335: mol_type = other RNA
caggtgaccctgcgcgagagcggccccgccctcgtcaagcccacccagacgctgaccctgacctgcaccgtgtccgggttcagcctctccgcctacagcgtgaactggatccggcagccgcccggcaaggcgctggagtggctggccatgatctggggcgacgggaagatcgtctacaactccgccctcaagagccgcctgacgatctccaaggacaccagcaagaaccaggtggtgctgaccatgaccaacatggaccccgtcgacacggccacctactactgcgccggggacggctactacccgtacgcgatggacaactggggccaggggtccctcgtgaccgtgagctccgccagcaccaagggcccctccgtcttccccctggccccctgcagccggtccacgagcgagtccaccgccgcgctggggtgcctcgtgaaggactacttcccggagcccgtgaccgtcagctggaactccggcgccctgaccagcggggtgcacacgttccccgccgtgctgcagagctccggcctctacagcctgtccagcgtcgtgaccgtgccctccagctccctgggcaccaagacctacacgtgcaacgtcgaccacaagccgagcaacaccaaggtggacaagcgcgtggagtccaagtacgggccgccctgcccgccctgccccgcccccgagttcctcggcgggcccagcgtcttcctgttcccgcccaagcccaaggacaccctgatgatctcccggacccccgaggtgacgtgcgtggtcgtggacgtcagccaggaggaccccgaggtgcagttcaactggtacgtggacggcgtcgaggtgcacaacgccaagaccaagccccgcgaggagcagttcaactccacctaccgggtggtcagcgtgctcaccgtgctgcaccaggactggctgaacggcaaggagtacaagtgcaaggtctccaacaaggggctccccagctccatcgagaagacgatcagcaaggcgaagggccagccccgcgagccccaggtgtacaccctgccgccctcccaggaggagatgaccaagaaccaggtgagcctgacctgcctcgtcaaggggttctaccccagcgacatcgccgtggagtgggagtccaacggccagcccgagaacaactacaagacgaccccgcccgtgctggacagcgacgggtccttcttcctgtacagccggctcaccgtcgacaagtcccgctggcaggagggcaacgtgttcagctgctccgtgatgcacgaggccctgcacaaccactacacccagaagtccctgagcctcagcctgggcaag

SEQ ID NO: 8151 - RNA, 654 nt, synthetic construct
  misc_feature 1..654: note = derived and/or modified sequence opt1 from Lebrikizumab_LightChain1
  source 1..654: mol_type = other RNA
gacatcgtgatgacccagagccccgactccctgagcgtctccctcggcgagcgcgccaccatcaactgccgggccagcaagtccgtggacagctacgggaactccttcatgcactggtaccagcagaagccgggccagccgcccaagctgctgatctacctcgcgagcaacctggagtccggggtgcccgaccgcttcagcggctccgggagcggcacggacttcaccctgaccatctccagcctccaggccgaggacgtcgccgtgtactactgccagcagaacaacgaggacccccggaccttcggcgggggcacgaaggtggagatcaagcgcaccgtcgccgccccctccgtgttcatcttcccgcccagcgacgagcagctgaagtccgggaccgcgagcgtggtctgcctgctcaacaacttctacccccgggaggccaaggtgcagtggaaggtggacaacgccctgcagtccggcaacagccaggagagcgtcaccgagcaggactccaaggacagcacgtactccctgagctccaccctcaccctgagcaaggccgactacgagaagcacaaggtgtacgcgtgcgaggtgacccaccaggggctgtccagccccgtcacgaagtccttcaaccgcggcgagtgc

SEQ ID NO: 8152 - RNA, 1227 nt, synthetic construct
  misc_feature 1..1227: note = derived and/or modified sequence opt1 from Lenercept_chain1
  source 1..1227: mol_type = other RNA
ctggtgccccacctcggcgaccgcgagaagcgggacagcgtctgcccgcaggggaagtacatccacccccagaacaactccatctgctgcaccaagtgccacaagggcacctacctgtacaacgactgccccgggcccggccaggacacggactgccgcgagtgcgagagcgggtccttcaccgccagcgagaaccacctccggcactgcctctcctgcagcaagtgccgcaaggagatgggccaggtggagatctccagctgcaccgtggaccgggacaccgtctgcggctgccgcaagaaccagtaccggcactactggtccgagaacctgttccagtgcttcaactgcagcctgtgcctcaacgggacggtgcacctgtcctgccaggagaagcagaacaccgtgtgcacgtgccacgccggcttcttcctgcgcgagaacgagtgcgtcagctgctccaactgcaagaagtccctcgagtgcaccaagctgtgcctgccgcagatcgagaacgtgaaggggaccgaggacagcggcaccaccgacaagacccacacgtgcccgccctgccccgcgcccgagctcctcgggggccccagcgtgttcctgttcccgcccaagcccaaggacaccctgatgatctcccggacccccgaggtgacctgcgtcgtggtcgacgtgagccacgaggaccccgaggtgaagttcaactggtacgtcgacggcgtggaggtgcacaacgccaagacgaagccccgcgaggagcagtacaactccacctaccgggtcgtgagcgtgctgaccgtcctgcaccaggactggctcaacgggaaggagtacaagtgcaaggtgagcaacaaggccctgccggcccccatcgagaagaccatctccaaggccaagggccagccccgcgagccccaggtgtacacgctgccgcccagccgggaggagatgaccaagaaccaggtctccctgacctgcctggtgaaggggttctaccccagcgacatcgcggtcgagtgggagtccaacggccagcccgagaacaactacaagaccacgccgcccgtgctggacagcgacggctccttcttcctctacagcaagctgaccgtggacaagtcccgctggcagcaggggaacgtcttcagctgctccgtgatgcacgaggccctgcacaaccactacacccagaagtccctcagcctgagccccggcaag

SEQ ID NO: 8153 - RNA, 1347 nt, synthetic construct
  misc_feature 1..1347: note = derived and/or modified sequence opt1 from Lenzilumab_HeavyChain1
  source 1..1347: mol_type = other RNA
caggtgcagctggtccagagcggcgccgaggtgaagaagcccggggcctccgtgaaggtcagctgcaaggcgtccggctacagcttcaccaactactacatccactgggtgcgccaggccccggggcagcggctcgagtggatgggctggatcaacgccgggaacggcaacaccaagtactcccagaagttccagggccgcgtgacgatcacccgggacaccagcgcctccaccgcctacatggagctgagctccctgcgcagcgaggacacggcggtctactactgcgtgcggcgccagcggttcccctactacttcgactactgggggcagggcaccctcgtgaccgtctccagcgcctccaccaaggggcccagcgtgttccccctggccccgtccagcaagtccacgagcggcgggaccgccgcgctgggctgcctcgtgaaggactacttccccgagcccgtcaccgtgtcctggaacagcggcgccctgaccagcggggtgcacacgttccccgccgtcctgcagtccagcggcctctactccctgagctccgtggtgaccgtcccgagctccagcctggggacccagacctacatctgcaacgtgaaccacaagccctccaacacgaaggtggacaagcgcgtcgagcccaagagctgcgacaagacccacacgtgcccgccctgccccgcccccgagctcctgggcggcccctccgtgttcctgttcccgcccaagcccaaggacaccctcatgatcagccggacccccgaggtgacctgcgtcgtggtcgacgtgtcccacgaggacccggaggtgaagttcaactggtacgtcgacggggtggaggtgcacaacgccaagaccaagccccgcgaggagcagtacaacagcacctaccgggtcgtgtccgtgctgacggtcctgcaccaggactggctcaacggcaaggagtacaagtgcaaggtgagcaacaaggcgctgcccgcccccatcgagaagaccatctccaaggccaaggggcagccgcgcgagccccaggtgtacaccctgccgcccagccgggaggagatgaccaagaaccaggtctccctcacgtgcctggtgaagggcttctaccccagcgacatcgccgtggagtgggagagcaacgggcagcccgagaacaactacaagaccacgcccccggtcctggactccgacggcagcttcttcctctactccaagctgaccgtggacaagagccgctggcagcagggcaacgtgttctcctgcagcgtcatgcacgaggccctgcacaaccactacacccagaagtccctcagcctgtcccccgggaag

SEQ ID NO: 8154 - RNA, 642 nt, synthetic construct
  misc_feature 1..642: note = derived and/or modified sequence opt1 from Lenzilumab_LightChain1
  source 1..642: mol_type = other RNA
gagatcgtgctgacccagagccccgccaccctctccgtcagcccgggcgagcgcgccacgctgtcctgccgggcgagccagtccgtggggaccaacgtggcctggtaccagcagaagcccggccaggcgccccgcgtcctgatctacagcacctccagccgggccaccgggatcacggaccgcttctccggcagcgggtccggcaccgacttcaccctcaccatcagccggctggagcccgaggacttcgccgtgtactactgccagcagttcaacaagtccccgctgacgttcggcgggggcaccaaggtggagatcaagcgcaccgtcgccgcccccagcgtgttcatcttcccgccctccgacgagcagctcaagagcgggaccgcctccgtggtctgcctgctgaacaacttctacccccgggaggccaaggtgcagtggaaggtggacaacgcgctccagagcggcaactcccaggagagcgtcacggagcaggacagcaaggactccacctacagcctgtccagcaccctgaccctctccaaggccgactacgagaagcacaaggtgtacgcctgcgaggtgacgcaccaggggctgagctcccccgtcaccaagagcttcaaccgcggcgagtgc

SEQ ID NO: 8155 - RNA, 1326 nt, synthetic construct
  misc_feature 1..1326: note = derived and/or modified sequence opt1 from Lerdelimumab_HeavyChain1
  source 1..1326: mol_type = other RNA
gaggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgtgatctggtacgacgggagcaacaagtactacgccgactccgtcaagggccggttcaccatcagccgcgacaactccaagaacacgctctacctgcagatggacagcctgcgggccgaggacaccgccgtgtactactgcgggcgcaccctcgagtccagcctgtggggccaggggaccctggtgacggtctccagcgcgtccaccaagggccccagcgtgttccccctcgccccctgctcccggagcacctccgagagcaccgccgccctgggctgcctggtgaaggactacttcccggagcccgtcacggtgagctggaactccggggcgctcaccagcggcgtgcacaccttccccgccgtcctgcagtccagcgggctgtactccctcagctccgtggtgaccgtccccagctccagcctgggcacgaagacctacacgtgcaacgtggaccacaagccgtccaacaccaaggtggacaagcgcgtcgagagcaagtacggcccgccctgcccctcctgccccgcccccgagttcctcgggggccccagcgtgttcctgttcccgcccaagcccaaggacaccctgatgatctcccggacccccgaggtgacctgcgtcgtggtcgacgtgagccaggaggaccccgaggtgcagttcaactggtacgtcgacggggtggaggtgcacaacgccaagaccaagccgcgcgaggagcagttcaactccacgtaccgggtcgtgagcgtgctgaccgtcctccaccaggactggctgaacggcaaggagtacaagtgcaaggtgtccaacaaggggctgcccagcagcatcgagaagaccatctccaaggccaagggccagccccgcgagccccaggtgtacaccctcccgcccagccaggaggagatgacgaagaaccaggtctccctgacctgcctggtgaagggcttctaccccagcgacatcgcggtggagtgggagtccaacgggcagcccgagaacaactacaagaccaccccgcccgtcctcgacagcgacggctccttcttcctgtacagccggctgacggtggacaagtcccgctggcaggaggggaacgtgttcagctgctccgtcatgcacgaggccctccacaaccactacacccagaagtccctgagcctgagcctcggcaag

SEQ ID NO: 8156 - RNA, 645 nt, synthetic construct
  misc_feature 1..645: note = derived and/or modified sequence opt1 from Lerdelimumab_LightChain1
  source 1..645: mol_type = other RNA
agctccgagctgacccaggaccccgccgtgagcgtcgccctcggccagaccgtgcgcatcacgtgccagggggactccctgcggagctactacgcgtcctggtaccagcagaagccgggccaggcccccgtgctggtcatctacgggaagaacaaccgccccagcggcatccccgaccggttctccgggagctccagcggcaacaccgcctccctcaccatcaccggcgcccaggccgaggacgaggcggactactactgcaacagccgcgactccagctccacgcaccgcggggtgttcggcgggggcaccaagctgaccgtgctggggcagccgaaggccgcccccagcgtcaccctcttcccgccctccagcgaggagctgcaggccaacaaggcgacgctggtgtgcctcatctccgacttctaccccggcgccgtgaccgtcgcctggaaggccgacagcagccccgtgaaggccggcgtggagaccaccacgccctccaagcagagcaacaacaagtacgcggcctccagctacctgtccctgacccccgagcagtggaagtcccaccggagctacagctgccaggtcacccacgaggggtccaccgtggagaagacggtggccccgaccgagtgcagc

SEQ ID NO: 8157 - RNA, 1353 nt, synthetic construct
  misc_feature 1..1353: note = derived and/or modified sequence opt1 from Lexatumumab_HeavyChain1
  source 1..1353: mol_type = other RNA
gaggtgcagctggtccagagcggcgggggcgtggagcgccccgggggctccctccggctgagctgcgccgcctccgggttcaccttcgacgactacggcatgagctgggtgcgccaggcgccgggcaaggggctggagtgggtctccggcatcaactggaacgggggcagcaccgggtacgccgactccgtgaagggccgggtgacgatcagccgcgacaacgccaagaactccctctacctgcagatgaacagcctgcgggccgaggacaccgccgtctactactgcgcgaagatcctcggcgccgggcgcggctggtacttcgacctgtgggggaagggcaccaccgtgacggtgtccagcgcctccaccaagggccccagcgtcttccccctggccccctccagcaagtccaccagcgggggcaccgcggccctcgggtgcctggtgaaggactacttcccggagcccgtgacggtctcctggaacagcggcgccctgaccagcggggtgcacaccttccccgccgtgctccagtccagcggcctgtactccctgagctccgtcgtgaccgtgcccagctccagcctcggcacgcagacctacatctgcaacgtcaaccacaagccgtccaacaccaaggtggacaagcgggtggagcccaagagctgcgacaagacccacacgtgcccgccctgcccggcccccgagctgctcgggggcccctccgtcttcctgttcccgcccaagcccaaggacaccctgatgatcagccgcacccccgaggtgacctgcgtggtcgtggacgtctcccacgaggaccccgaggtgaagttcaactggtacgtggacggggtcgaggtgcacaacgcgaagacgaagccgcgggaggagcagtacaacagcacctaccgcgtggtctccgtgctgaccgtgctccaccaggactggctgaacggcaaggagtacaagtgcaaggtcagcaacaaggccctgcccgcccccatcgagaagaccatctccaaggccaaggggcagccccgggagccccaggtgtacacgctcccgcccagccgcgaggagatgaccaagaaccaggtgtccctgacctgcctggtcaagggcttctaccccagcgacatcgccgtggagtgggagagcaacggccagcccgagaacaactacaagaccacgccgcccgtgctcgactccgacgggagcttcttcctgtactccaagctgaccgtcgacaagagccggtggcagcagggcaacgtgttctcctgcagcgtgatgcacgaggcgctccacaaccactacacccagaagtccctgagcctgtcccccgggaag

SEQ ID NO: 8158 - RNA, 1353 nt, synthetic construct; identical to SEQ ID NO: 8157
  misc_feature 1..1353: note = derived and/or modified sequence opt1 from Lexatumumab_HeavyChain
  source 1..1353: mol_type = other RNA

SEQ ID NO: 8159 - RNA, 642 nt, synthetic construct
  misc_feature 1..642: note = derived and/or modified sequence opt1 from Lexatumumab_LightChain1
  source 1..642: mol_type = other RNA
agctccgagctgacccaggaccccgccgtgagcgtcgccctcggccagaccgtgcgcatcacgtgccagggggactccctgcggagctactacgcgtcctggtaccagcagaagccgggccaggcccccgtgctggtcatctacgggaagaacaaccgccccagcggcatccccgaccggttctccgggagctccagcggcaacaccgcctccctcaccatcaccggcgcccaggccgaggacgaggcggactactactgcaacagccgcgactccagcgggaaccacgtggtgttcggcgggggcacgaagctgaccgtcctggggcagccgaaggccgccccctccgtgaccctcttcccgcccagctccgaggagctgcaggccaacaaggcgaccctggtgtgcctcatcagcgacttctaccccggcgccgtcacggtggcctggaaggccgactccagccccgtgaaggccggcgtcgagaccaccacccccagcaagcagtccaacaacaagtacgcggccagctcctacctgagcctgacgcccgagcagtggaagtcccaccggagctactcctgccaggtgacccacgaggggagcaccgtggagaagaccgtcgccccgacggagtgctcc

SEQ ID NO: 8160 - RNA, 642 nt, synthetic construct; identical to SEQ ID NO: 8159
  misc_feature 1..642: note = derived and/or modified sequence opt1 from Lexatumumab_LightChain
  source 1..642: mol_type = other RNA

SEQ ID NO: 8161 - RNA, 1377 nt, synthetic construct
  misc_feature 1..1377: note = derived and/or modified sequence opt1 from Libivirumab_HeavyChain1
  source 1..1377: mol_type = other RNA
caggtgcagctggtcgagagcggcgggggcgtggtgcgccccgggcggtccctccgcctgagctgcgccgcctccggcttcgcgttcagcgactactccatcaactgggtccggcaggccccggggaagggcctggagtgggtggccatcatcagctacgacggccgcatcacctactaccgggactccgtgaaggggcgcttcaccatcagccgggacgactccaagaacacgctctacctgcagatgaacagcctgcgcaccgaggacaccgccgtctactactgcgcccggcagtactacgacttctggtccggcagctccgtggggcgcaactacgacggcatggacgtgtgggggctcggcaccacggtcaccgtgagctccgcgagcaccaagggcccctccgtgttccccctggcccccagctccaagagcaccagcgggggcacggccgccctggggtgcctcgtcaaggactacttcccggagcccgtgaccgtgtcctggaacagcggcgcgctgacctccggcgtccacaccttccccgccgtgctgcagagctccgggctctacagcctgtccagcgtggtcacggtgccctccagctccctgggcacccagacctacatctgcaacgtgaaccacaagccgagcaacaccaaggtcgacaagcgggtggagcccaagtcctgcgacaagacgcacacgtgcccgccctgccccgcccccgagctcctcgggggccccagcgtgttcctgttcccgcccaagcccaaggacaccctcatgatctcccgcacccccgaggtgacctgcgtcgtcgtggacgtgagccacgaggaccccgaggtcaagttcaactggtacgtggacggggtggaggtccacaacgccaagaccaagccgcgggaggagcagtacaactccacctaccgcgtggtgagcgtcctgaccgtgctgcaccaggactggctcaacggcaaggagtacaagtgcaaggtgtccaacaaggccctgcccgcgcccatcgagaagacgatcagcaaggccaagggccagccccgggagccgcaggtctacaccctgccgcccagccgcgaggagatgaccaagaaccaggtgtccctgacctgcctggtgaaggggttctaccccagcgacatcgccgtcgagtgggagtccaacggccagcccgagaacaactacaagacgaccccgcccgtgctggacagcgacgggtccttcttcctctacagcaagctgaccgtggacaagtcccggtggcagcagggcaacgtcttcagctgctccgtgatgcacgaggccctgcacaaccactacacccagaagtccctcagcctgagccccgggaag

SEQ ID NO: 8162 - RNA, 657 nt, synthetic construct
  misc_feature 1..657: note = derived and/or modified sequence opt1 from Libivirumab_LightChain1
  source 1..657: mol_type = other RNA
gacatcgtgatgacccagagccccctgtccctcagcgtcaccccgggcgagcccgcctccatcagctgccgctccagccagtccctgctgcaccggagcgggaacaactacctcgactggtacctgcagaagcccggccacagcccccagctgctcatctacgtggggagcaaccgcgcctccggcgtgccggaccggttcagcgggtccggcagcggcacggagtacaccctgaagatctcccgcgtcgaggcggaggacgtgggggtgtactactgcatgcaggccctgcagacgccccggaccttcggccaggggacgaagctcgagatcaagcgcaccgtcgccgcccccagcgtgttcatcttcccgccctccgacgagcagctgaagtccggcaccgcctccgtggtctgcctgctcaacaacttctacccccgggaggcgaaggtgcagtggaaggtggacaacgccctgcagagcgggaacagccaggagtccgtcaccgagcaggacagcaaggactccacgtacagcctgtccagcaccctcaccctgtccaaggccgactacgagaagcacaaggtgtacgcctgcgaggtgacccaccagggcctgagctcccccgtcaccaagagcttcaaccgcggcgagtgc

SEQ ID NO: 8163 - RNA, 1350 nt, synthetic construct
  misc_feature 1..1350: note = derived and/or modified sequence opt1 from Lifastuzumab_HeavyChain
  source 1..1350: mol_type = other RNA
gaggtgcagctggtcgagagcggcgggggcctcgtgcagcccgggggctccctgcgcctgagctgcgccgcctccgggttcagcttctccgacttcgcgatgagctgggtgcggcaggccccgggcaagggcctcgagtgggtcgccaccatcgggcgcgtggccttccacacctactaccccgactccatgaagggccggttcacgatcagccgcgacaactccaagaacaccctgtacctgcagatgaacagcctccgggccgaggacaccgcggtgtactactgcgcccgccaccgggggttcgacgtcggccacttcgacttctgggggcagggcaccctggtgacggtgtccagcgcctccaccaagggccccagcgtcttccccctggccccgtccagcaagtccaccagcgggggcaccgcggccctcgggtgcctggtgaaggactacttccccgagcccgtgacggtctcctggaacagcggcgccctgaccagcggcgtgcacaccttccccgccgtgctccagtccagcgggctgtactccctgagctccgtcgtgaccgtgccgagctccagcctcggcacgcagacctacatctgcaacgtcaaccacaagccctccaacaccaaggtggacaagaaggtggagcccaagagctgcgacaagacccacacgtgcccgccctgccccgcccccgagctgctcgggggcccctccgtcttcctgttcccgcccaagcccaaggacaccctgatgatcagccgcacccccgaggtgacctgcgtggtcgtggacgtctcccacgaggacccggaggtgaagttcaactggtacgtggacggggtcgaggtgcacaacgcgaagacgaagccccgggaggagcagtacaacagcacctaccgcgtggtctccgtgctgaccgtgctccaccaggactggctgaacggcaaggagtacaagtgcaaggtcagcaacaaggccctgcccgcccccatcgagaagaccatctccaaggccaagggccagccgcgggagccccaggtgtacacgctcccgcccagccgcgaggagatgaccaagaaccaggtgtccctgacctgcctggtcaaggggttctaccccagcgacatcgccgtggagtgggagagcaacggccagcccgagaacaactacaagaccacgcccccggtgctcgactccgacgggagcttcttcctgtactccaagctgaccgtcgacaagagccggtggcagcagggcaacgtgttctcctgcagcgtgatgcacgaggcgctccacaaccactacacccagaagtccctgagcctgtcccccgggaag

SEQ ID NO: 8164 - RNA, 657 nt, synthetic construct
  misc_feature 1..657: note = derived and/or modified sequence opt1 from Lifastuzumab_LightChain
  source 1..657: mol_type = other RNA
gacatccagatgacgcagagcccctccagcctgtccgccagcgtgggcgaccgcgtcaccatcacgtgccggtccagcgagaccctcgtgcactccagcgggaacacctacctggagtggtaccagcagaagccgggcaaggcccccaagctgctcatctaccgcgtgtccaaccggttcagcggggtcccctcccgcttcagcggctccgggagcggcaccgacttcacgctgaccatctccagcctgcagcccgaggacttcgcgacctactactgcttccagggctccttcaacccgctcaccttcgggcagggcacgaaggtggagatcaagcggaccgtggccgcccccagcgtcttcatcttcccgccctccgacgagcagctcaagagcgggaccgccagcgtggtgtgcctgctgaacaacttctacccccgcgaggccaaggtccagtggaaggtggacaacgcgctgcagtccggcaacagccaggagtccgtgaccgagcaggacagcaaggactccacgtacagcctgtccagcaccctcaccctgtccaaggccgactacgagaagcacaaggtctacgcctgcgaggtgacccaccaggggctgagctcccccgtgaccaagagcttcaaccggggcgagtgc

SEQ ID NO: 8165 - RNA, 1347 nt, synthetic construct
  misc_feature 1..1347: note = derived and/or modified sequence opt1 from Lifastuzumab_vedotin_HeavyChain1
  source 1..1347: mol_type = other RNA
gtgcagctggtcgagagcggcgggggcctcgtgcagcccgggggctccctgcgcctgagctgcgccgcctccgggttcagcttctccgacttcgcgatgagctgggtgcggcaggccccgggcaagggcctcgagtgggtcgccaccatcgggcgcgtggccttccacacctactaccccgactccatgaagggccggttcacgatcagccgcgacaactccaagaacaccctgtacctgcagatgaacagcctccgggccgaggacaccgcggtgtactactgcgcccgccaccgggggttcgacgtcggccacttcgacttctgggggcagggcaccctggtgacggtgtccagcgcctccaccaagggccccagcgtcttccccctggccccgtccagcaagtccaccagcgggggcaccgcggccctcgggtgcctggtgaaggactacttccccgagcccgtgacggtctcctggaacagcggcgccctgaccagcggcgtgcacaccttccccgccgtgctccagtccagcgggctgtactccctgagctccgtcgtgaccgtgccgagctccagcctcggcacgcagacctacatctgcaacgtcaaccacaagccctccaacaccaaggtggacaagaaggtggagcccaagagctgcgacaagacccacacgtgcccgccctgccccgcccccgagctgctcgggggcccctccgtcttcctgttcccgcccaagcccaaggacaccctgatgatcagccgcacccccgaggtgacctgcgtggtcgtggacgtctcccacgaggacccggaggtgaagttcaactggtacgtggacggggtcgaggtgcacaacgcgaagacgaagccccgggaggagcagtacaacagcacctaccgcgtggtctccgtgctgaccgtgctccaccaggactggctgaacggcaaggagtacaagtgcaaggtcagcaacaaggccctgcccgcccccatcgagaagaccatctccaaggccaagggccagccgcgggagccccaggtgtacacgctcccgcccagccgcgaggagatgaccaagaaccaggtgtccctgacctgcctggtcaaggggttctaccccagcgacatcgccgtggagtgggagagcaacggccagcccgagaacaactacaagaccacgcccccggtgctcgactccgacgggagcttcttcctgtactccaagctgaccgtcgacaagagccggtggcagcagggcaacgtgttctcctgcagcgtgatgcacgaggcgctccacaaccactacacccagaagtccctgagcctgtcccccgggaag

SEQ ID NO: 8166 - RNA, 657 nt, synthetic construct; identical to SEQ ID NO: 8164
  misc_feature 1..657: note = derived and/or modified sequence opt1 from Lifastuzumab_vedotin_LightChain1
  source 1..657: mol_type = other RNA

SEQ ID NO: 8167 - RNA, 1359 nt, synthetic construct
  misc_feature 1..1359: note = derived and/or modified sequence opt1 from Ligelizumab_HeavyChain1
  source 1..1359: mol_type = other RNA
caggtgcagctggtccagagcggcgccgaggtgatgaagcccgggtccagcgtgaaggtctcctgcaaggccagcggctacaccttctcctggtactggctcgagtgggtgcgccaggcgccggggcacggcctggagtggatgggggagatcgaccccggcaccttcaccaccaactacaacgagaagttcaaggcccgggtgaccttcaccgccgacacgagcacctccaccgcctacatggagctgagctccctccgcagcgaggacaccgccgtctactactgcgcgcggttctcccacttcagcggctccaactacgactacttcgactactgggggcagggcacgctggtgaccgtgagctccgccagcaccaaggggccctccgtcttccccctggccccgagctccaagagcaccagcggcgggacggccgcgctcggctgcctggtgaaggactacttccccgagcccgtgaccgtctcctggaacagcggcgccctgacctccggggtgcacaccttccccgccgtgctccagagctccggcctgtacagcctgtccagcgtcgtgacggtgccgtccagctccctcgggacccagacctacatctgcaacgtcaaccacaagcccagcaacaccaaggtggacaagaaggtggagcccaagtcctgcgacaagacgcacacgtgcccgccctgccccgcccccgagctgctgggcggccccagcgtcttcctcttcccgcccaagcccaaggacaccctgatgatctcccgcacccccgaggtgacctgcgtggtcgtggacgtcagccacgaggacccggaggtgaagttcaactggtacgtggacggggtcgaggtgcacaacgccaagaccaagccccgggaggagcagtacaactccacctaccgcgtggtcagcgtgctgaccgtgctccaccaggactggctgaacggcaaggagtacaagtgcaaggtctccaacaaggcgctgcccgcccccatcgagaagacgatcagcaaggccaaggggcagccgcgggagccccaggtgtacaccctcccgcccagccgcgacgagctgaccaagaaccaggtgtccctgacctgcctcgtcaagggcttctaccccagcgacatcgccgtggagtgggagtccaacgggcagcccgagaacaactacaagacgacgcccccggtgctggacagcgacggctccttcttcctgtacagcaagctcaccgtcgacaagtcccggtggcagcagggcaacgtgttcagctgctccgtgatgcacgaggccctgcacaaccactacacccagaagtccctgagcctcagccccgggaag

SEQ ID NO: 8168 - RNA, 642 nt, synthetic construct
  misc_feature 1..642: note = derived and/or modified sequence opt1 from Ligelizumab_LightChain1
  source 1..642: mol_type = other RNA
gagatcgtgatgacccagagccccgccaccctgtccgtcagcccgggcgagcgcgccacgctctcctgccgggcgagccagtccatcgggaccaacatccactggtaccagcagaagcccggccaggcgccccgcctgctgatctactacgccagcgagtccatcagcgggatccccgcccggttctccggcagcgggtccggcaccgagttcaccctcacgatcagctccctgcagagcgaggacttcgccgtgtactactgccagcagtcctggagctggccgaccaccttcggcgggggcaccaaggtggagatcaagcgcacggtcgccgccccctccgtgttcatcttcccgcccagcgacgagcagctgaagtccgggaccgccagcgtggtctgcctcctgaacaacttctacccccgggaggccaaggtgcagtggaaggtggacaacgcgctgcagagcggcaactcccaggagagcgtcaccgagcaggactccaaggacagcacctactccctcagctccacgctgaccctgagcaaggccgactacgagaagcacaaggtgtacgcctgcgaggtgacccaccaggggctctccagccccgtcaccaagtccttcaaccgcggcgagtgc

SEQ ID NO: 8169 - RNA, 1329 nt, synthetic construct; identical to SEQ ID NO: 7717
  misc_feature 1..1329: note = derived and/or modified sequence opt1 from Lilotomab_HeavyChain1
  source 1..1329: mol_type = other RNA

SEQ ID NO: 8170 - RNA, 642 nt, synthetic construct; identical to SEQ ID NO: 7718
  misc_feature 1..642: note = derived and/or modified sequence opt1 from Lilotomab_LightChain1
  source 1..642: mol_type = other RNA

SEQ ID NO: 8171 - RNA, 1338 nt, synthetic construct
  misc_feature 1..1338: note = derived and/or modified sequence opt1 from Lintuzumab_HeavyChain1
  source 1..1338: mol_type = other RNA
caggtgcagctggtccagagcggcgccgaggtgaagaagcccgggtccagcgtgaaggtctcctgcaaggccagcggctacaccttcaccgactacaacatgcactgggtgcgccaggcgccggggcagggcctcgagtggatcgggtacatctacccctacaacggcggcacggggtacaaccagaagttcaagtccaaggccaccatcaccgccgacgagagcaccaacacggcctacatggagctgtccagcctgcggtccgaggacaccgccgtgtactactgcgcgcgcggccggcccgccatggactactgggggcagggcaccctcgtcaccgtgagctccgccagcacgaaggggccctccgtgttcccgctggcccccagctccaagagcacctccggcggcaccgcggccctggggtgcctcgtcaaggactacttccccgagcccgtgaccgtgagctggaactccggcgccctgacgagcggggtccacaccttcccggccgtgctgcagagctccggcctctacagcctgtccagcgtggtcaccgtgccctccagctccctgggcacccagacgtacatctgcaacgtgaaccacaagcccagcaacaccaaggtcgacaagaaggtggagcccaagtcctgcgacaagacccacacgtgcccgccctgccccgcccccgagctcctcgggggcccgagcgtgttcctgttcccgcccaagcccaaggacaccctgatgatctcccgcacccccgaggtgacctgcgtcgtggtcgacgtgagccacgaggaccccgaggtcaagttcaactggtacgtggacggggtggaggtccacaacgcgaagaccaagccccgggaggagcagtacaactccacgtaccgcgtggtgagcgtcctgaccgtgctgcaccaggactggctcaacggcaaggagtacaagtgcaaggtgtccaacaaggccctgcccgccccgatcgagaagaccatcagcaaggccaaggggcagccccgggagccccaggtctacaccctgcccccgtcccgcgacgagctcacgaagaaccaggtgagcctgacctgcctggtgaagggcttctacccctccgacatcgccgtcgagtgggagagcaacggccagcccgagaacaactacaagaccaccccgcccgtgctcgacagcgacgggtccttcttcctgtacagcaagctgacggtggacaagtcccggtggcagcagggcaacgtcttcagctgctccgtgatgcacgaggcgctccacaaccactacacccagaagtccctgagcctgagccccgggaag

SEQ ID NO: 8172 - RNA, 654 nt, synthetic construct
  misc_feature 1..654: note = derived and/or modified sequence opt1 from Lintuzumab_LightChain1
  source 1..654: mol_type = other RNA
gacatccagatgacccagagcccctccagcctgtccgccagcgtgggcgaccgcgtcaccatcacgtgccgggcctccgagagcgtggacaactacgggatctccttcatgaactggttccagcagaagccgggcaaggcgcccaagctcctgatctacgccgccagcaaccaggggtccggcgtgcccagccgcttctccgggagcggctccggcaccgacttcaccctgaccatcagctccctccagcccgacgacttcgccacgtactactgccagcagagcaaggaggtcccgtggaccttcgggcagggcaccaaggtggagatcaagcggaccgtggccgcgccctccgtcttcatcttcccgcccagcgacgagcagctgaagtccgggacggccagcgtggtgtgcctgctcaacaacttctacccccgcgaggccaaggtccagtggaaggtggacaacgccctgcagagcggcaactcccaggagagcgtgaccgagcaggactccaaggacagcacctactccctgagctccaccctcacgctgagcaaggcggactacgagaagcacaaggtctacgcctgcgaggtgacccaccaggggctgtccagccccgtgaccaagtccttcaaccggggcgagtgc

SEQ ID NO: 8173 - RNA, 1350 nt, synthetic construct
  misc_feature 1..1350: note = derived and/or modified sequence opt1 from Lirilumab_HeavyChain1
  source 1..1350: mol_type = other RNA
caggtgcagctggtccagagcggcgccgaggtgaagaagcccgggtccagcgtgaaggtctcctgcaaggccagcggcgggaccttctccttctacgcgatcagctgggtgcgccaggccccgggccaggggctcgagtggatgggcggcttcatccccatcttcggggccgccaactacgcccagaagttccagggccgggtgaccatcacggcggacgagtccaccagcaccgcctacatggagctgtccagcctgcgctccgacgacaccgccgtctactactgcgcccggatccccagcgggtcctactactacgactacgacatggacgtgtggggccaggggacgaccgtgaccgtcagctccgcgagcaccaagggcccctccgtgttcccgctcgccccctgcagccgctccacgagcgagagcaccgccgccctgggctgcctggtgaaggactacttccccgagcccgtcaccgtgtcctggaacagcggggccctcacctccggcgtgcacacgttcccggcggtcctgcagagctccgggctgtacagcctctccagcgtggtgaccgtcccctccagctccctgggcaccaagacctacacgtgcaacgtggaccacaagcccagcaacaccaaggtggacaagcgggtcgagtccaagtacgggcccccgtgcccgccctgccccgcccccgagttcctcggcggccccagcgtgttcctcttcccgcccaagcccaaggacaccctgatgatctcccgcacccccgaggtgacgtgcgtcgtggtcgacgtgagccaggaggaccccgaggtgcagttcaactggtacgtcgacggggtggaggtgcacaacgccaagaccaagccccgggaggagcagttcaactccacctaccgcgtcgtgagcgtgctgaccgtcctccaccaggactggctgaacggcaaggagtacaagtgcaaggtgtccaacaaggggctgccgagcagcatcgagaagacgatctccaaggccaagggccagccccgggagccccaggtgtacaccctgcccccgagccaggaggagatgaccaagaaccaggtctccctgacctgcctggtgaagggcttctaccccagcgacatcgccgtggagtgggagtccaacgggcagcccgagaacaactacaagacgaccccgcccgtcctcgacagcgacggctccttcttcctgtacagccgcctgaccgtggacaagtcccggtggcaggaggggaacgtgttcagctgctccgtcatgcacgaggcgctccacaaccactacacccagaagtccctgagcctgagcctcggcaag

SEQ ID NO: 8174 - RNA, 642 nt, synthetic construct
  misc_feature 1..642: note = derived and/or modified sequence opt1 from Lirilumab_LightChain1
  source 1..642: mol_type = other RNA
gagatcgtgctgacccagagccccgtcaccctctccctgagcccgggcgagcgcgccacgctgtcctgccgggccagccagtccgtgagctcctacctcgcgtggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggatgtacaccttcggccagggcaccaagctggagatcaagcgcaccgtcgccgccccctccgtgttcatcttcccgcccagcgacgagcagctcaagtccgggacggccagcgtggtctgcctgctgaacaacttctacccccgggaggcgaaggtgcagtggaaggtggacaacgccctccagtccggcaacagccaggagagcgtcaccgagcaggactccaaggacagcacctactccctgagctccaccctgacgctcagcaaggccgactacgagaagcacaaggtgtacgcctgcgaggtgacccaccaggggctgtccagccccgtcaccaagtccttcaaccgcggcgagtgc

SEQ ID NO: 8175 - RNA, 1344 nt, synthetic construct
  misc_feature 1..1344: note = derived and/or modified sequence opt1 from Lodelcizumab_HeavyChain1
  source 1..1344: mol_type = other RNA
caggtgcagctggtccagagcggcgccgaggtgaagaagcccggggcctccgtgaaggtcagctgcaaggcgtccggctacaccttcagcaccatgtacatgtcctgggtgcgccaggccccggggcagggcctcgagtggatggggcggatcgaccccgccaacgagcacacgaactacgcccagaagttccagggccgcgtgaccatgacccgggacaccagcatctccacggcctacatggagctgagccgcctgacctccgacgacaccgcggtctactactgcgcccggagctactactactacaacatggactactggggccaggggaccctcgtgacggtgtccagcgcctccaccaagggccccagcgtcttccccctggccccgtccagcaagtccaccagcgggggcaccgcggccctggggtgcctcgtgaaggactacttccccgagcccgtgacggtctcctggaacagcggcgccctgaccagcggcgtgcacaccttccccgccgtgctgcagtccagcgggctctactccctgagctccgtcgtgaccgtgccgagctccagcctgggcacgcagacctacatctgcaacgtcaaccacaagccctccaacaccaaggtggacaagcgcgtggagcccaagagctgcgacaagacccacacgtgcccgccctgccccgcccccgaggcggccgggggcccctccgtcttcctcttcccgcccaagcccaaggacaccctgatgatcagccggacccccgaggtgacctgcgtggtcgtggacgtctcccacgaggacccggaggtgaagttcaactggtacgtggacggcgtcgaggtgcacaacgccaagacgaagccccgcgaggagcagtacaacagcacctaccgggtggtctccgtgctgaccgtgctccaccaggactggctgaacgggaaggagtacaagtgcaaggtcagcaacaaggccctgcccgcccccatcgagaagaccatctccaaggcgaagggccagccgcgcgagccccaggtgtacacgctcccgcccagccgggaggagatgaccaagaaccaggtgtccctgacctgcctggtcaaggggttctaccccagcgacatcgccgtggagtgggagagcaacggccagcccgagaacaactacaagaccacgcccccggtgctcgactccgacgggagcttcttcctgtactccaagctgaccgtcgacaagagccgctggcagcagggcaacgtgttctcctgcagcgtgatgcacgaggccctccacaaccactacacccagaagtccctgagcctgtcccccggcaag

SEQ ID NO: 8176 - RNA, 639 nt, synthetic construct
  misc_feature 1..639: note = derived and/or modified sequence opt1 from Lodelcizumab_LightChain1
  source 1..639: mol_type = other RNA
cagatcgtgctgacccagagccccgccaccctctccgtcagccccggcgagcgcgccacgctgtcctgccgggcgagccagtccgtgagctacatgcactggtaccagcagaagcccgggcaggcgccccgcctgctcatctacggcgtgttccggcgcgccaccgggatccccgaccggttctccggcagcgggtccggcaccgacttcaccctgacgatcggccgcctggagccggaggacttcgccgtctactactgcctccagtggagctccgacccgcccaccttcgggcagggcaccaagctggagatcaagcggaccgtggccgcccccagcgtgttcatcttcccgccctccgacgagcagctcaagagcgggacggcctccgtcgtgtgcctgctgaacaacttctacccccgcgaggccaaggtgcagtggaaggtcgacaacgccctgcagagcggcaactcccaggagagcgtgaccgagcaggactccaaggacagcacctacagcctctccagcaccctgacgctgtccaaggcggactacgagaagcacaaggtgtacgcctgcgaggtcacccaccaggggctcagctcccccgtgaccaagagcttcaaccggggcgagtgc

SEQ ID NO: 8177 - RNA, 1356 nt, synthetic construct
  misc_feature 1..1356: note = derived and/or modified sequence opt1 from Lokivetmab_HeavyChain1
  source 1..1356: mol_type = other RNA
gaggtgcagctggtcgagagcggcggggacctcgtgaagcccggcgggtccctgcgcctgagctgcgtggcctccggcttcaccttcagcaactacgggatgtcctgggtccggcaggcccccggcaagggcctccagtgggtggcgaccatcagctacgggggctcctacacgtactaccccgacaacatcaaggggcgcttcaccatcagccgggacaacgccaagaacaccctgtacctgcagatgaactccctccgcgccgaggacaccgccatgtactactgcgtgcggggctacgggtacgacacgatggactactggggccagggcaccctggtcaccgtgagctccgccagcaccacggcgccctccgtgttccccctggccccgagctgcgggtccaccagcggctccaccgtcgccctcgcctgcctggtgagcgggtacttccccgagcccgtgaccgtctcctggaacagcggcagcctgacgtccggcgtgcacaccttccccagcgtgctccagtccagcgggctgtactccctgagctccatggtcaccgtgccgagctcccgctggcccagcgagaccttcacgtgcaacgtggcgcaccccgcctccaagaccaaggtcgacaagcccgtgccgaagcgggagaacggccgcgtgccccggccgcccgactgccccaagtgccccgcccccgagatgctcgggggccccagcgtcttcatcttcccgcccaagcccaaggacaccctgctgatcgcccgcacccccgaggtgacgtgcgtggtcgtggacctcgacccggaggaccccgaggtccagatctcctggttcgtggacgggaagcagatgcagaccgccaagacccagccccgggaggagcagttcaacggcacctaccgcgtggtcagcgtgctgcccatcggccaccaggactggctgaaggggaagcagttcacgtgcaaggtgaacaacaaggcgctcccgtcccccatcgagcggaccatcagcaaggcccgcggccaggcccaccagccctccgtctacgtgctgccgcccagccgggaggagctgtccaagaacaccgtgagcctgacctgcctcatcaaggacttcttcccgcccgacatcgacgtcgagtggcagagcaacgggcagcaggagcccgagtccaagtaccgcacgaccccgccccagctggacgaggacggcagctacttcctctactccaagctgagcgtggacaagtcccggtggcagcgcggggacaccttcatctgcgccgtgatgcacgaggccctgcacaaccactacacccaggagagcctctcccacagccccggc

SEQ ID NO: 8178 - RNA, 651 nt, synthetic construct
  misc_feature 1..651: note = derived and/or modified sequence opt1 from Lokivetmab_LightChain1
  source 1..651: mol_type = other RNA
gagatcgtgatgacccagagccccgcctccctgagcctctcccaggaggagaaggtcaccatcacgtgcaaggccagccagtccgtgagcttcgcgggcaccgggctgatgcactggtaccagcagaagccgggccaggcccccaagctgctcatctaccgcgcctccaacctggaggccggggtgcccagccggttctccggcagcgggtccggcaccgacttcagcttcaccatctccagcctggagcccgaggacgtcgccgtgtactactgccagcagtcccgcgagtacccgtggacgttcggccaggggaccaagctcgagatcaagcggaacgacgcgcagcccgccgtgtacctgttccagcccagccccgaccagctgcacaccggctccgccagcgtcgtgtgcctcctgaactccttctacccgaaggacatcaacgtgaagtggaaggtcgacggggtgatccaggacaccggcatccaggagagcgtgacggagcaggacaaggacagcacctactccctgagctccaccctcaccatgagctccacggagtacctgagccacgagctgtactcctgcgagatcacccacaagagcctcccctccaccctgatcaagagcttccagcgctccgagtgc

SEQ ID NO: 8179 - RNA, 1344 nt, synthetic construct
  misc_feature 1..1344: note = derived and/or modified sequence opt1 from Lorvotuzumab_mertansine_HeavyChain1
  source 1..1344: mol_type = other RNA
caggtgcagctggtcgagagcggcgggggcgtggtgcagcccgggcgctccctccggctgagctgcgccgcctccggcttcaccttcagctccttcgggatgcactgggtccgccaggcgccgggcaagggcctggagtgggtggcctacatcagctccgggagcttcaccatctactacgccgactccgtgaagggccggttcacgatcagccgcgacaactccaagaacaccctctacctgcagatgaacagcctgcgggccgaggacaccgccgtctactactgcgcgcgcatgcggaaggggtacgccatggactactggggccaggggaccctcgtgacggtgtccagcgcctccaccaagggccccagcgtcttccccctggccccctccagcaagtccaccagcggcgggaccgcggccctgggctgcctcgtgaaggactacttcccggagcccgtgacggtcagctggaactccggggccctgaccagcggcgtgcacaccttccccgccgtgctgcagtccagcggcctctactccctgagctccgtcgtgaccgtgcccagctccagcctggggacgcagacctacatctgcaacgtcaaccacaagccgtccaacaccaaggtggacaagaaggtggagcccaagagctgcgacaagacccacacgtgcccgccctgcccggcccccgagctcctgggcgggccctccgtcttcctgttcccgcccaagcccaaggacaccctcatgatcagccgcacccccgaggtgacctgcgtggtcgtggacgtctcccacgaggaccccgaggtgaagttcaactggtacgtggacggcgtcgaggtgcacaacgcgaagacgaagccgcgggaggagcagtacaacagcacctaccgcgtggtctccgtgctgaccgtgctgcaccaggactggctcaacgggaaggagtacaagtgcaaggtcagcaacaaggccctgcccgcccccatcgagaagaccatctccaaggccaagggccagccccgggagccccaggtgtacacgctgccgcccagccgcgacgagctcaccaagaaccaggtgagcctgacctgcctggtcaagggcttctacccctccgacatcgccgtggagtgggagagcaacgggcagcccgagaacaactacaagaccacgccgcccgtgctcgactccgacggcagcttcttcctgtactccaagctgaccgtcgacaagagccggtggcagcaggggaacgtgttctcctgcagcgtgatgcacgaggcgctccacaaccactacacccagaagtccctgagcctgtcccccggcaag

SEQ ID NO: 8180 - RNA, 657 nt, synthetic construct
  misc_feature 1..657: note = derived and/or modified sequence opt1 from Lorvotuzumab_mertansine_LightChain1
  source 1..657: mol_type = other RNA
gacgtggtcatgacccagagccccctgtccctcccggtgaccctgggccagcccgccagcatctcctgccgcagctcccagatcatcatccacagcgacgggaacacgtacctggagtggttccagcagcggcccggccagagcccccgccggctcatctacaaggtgtccaaccgcttctccggggtcccggaccggttcagcggctccgggagcggcaccgacttcaccctgaagatctcccgcgtggaggccgaggacgtgggcgtctactactgcttccaggggagccacgtgccccacaccttcggccaggggacgaaggtggagatcaagcggaccgtcgcggccccctccgtgttcatcttcccgcccagcgacgagcagctgaagtccggcaccgccagcgtggtctgcctcctgaacaacttctacccccgcgaggccaaggtgcagtggaaggtggacaacgccctgcagtccgggaacagccaggagagcgtcaccgagcaggactccaaggacagcacgtactccctcagctccaccctgaccctgagcaaggcggactacgagaagcacaaggtgtacgcctgcgaggtgacccaccagggcctctccagccccgtcacgaagtccttcaaccggggcgagtgc

SEQ ID NO: 8181 - RNA, 336 nt, synthetic construct
  misc_feature 1..336: note = derived and/or modified sequence opt1 from Lpathomab_VL
  source 1..336: mol_type = other RNA
gacgtggtcatgacccagacgcccctgagcctcccggtgtccctgggcgaccaggccagcatctcctgcaccagcgggcagtccctggtgcacatcaacggcaacacctacctccactggtacctgcagaagcccgggcagagccccaagctgctcatctacaaggtctccaacctgttcagcggcgtgcccgaccgcttctccgggagcggctccggcaccgacttcaccctgaagatcagccgggtggaggccgaggacctcggggtctacttctgctcccagagcacgcacttcccgttcaccttcggcaccgggaccaagctggagatcaag

SEQ ID NO: 8182 - RNA, 366 nt, synthetic construct
  misc_feature 1..366: note = derived and/or modified sequence opt1 from Lpathomab_gamma1-Chain_VDJ-Region
  source 1..366: mol_type = other RNA
caggtgcagctgcagcagagcggcgccgagctcgtccgccccgggacctccgtgaaggtgagctgcaaggcctccggctacgggttcatcaactacctgatcgagtggatcaagcagcggccgggccaggggctggagtggatcggcctcatcaaccccggcagcgactacaccaactacaacgagaacttcaaggggaaggcgacgctgaccgccgacaagtccagctccaccgcctacatgcacctgagctccctcaccagcgaggactccgccgtctacttctgcgcccgccggttcggctactacgggagcggcaactacttcgactactgggggcagggcacgaccctgaccgtgtccagc

SEQ ID NO: 8183 - RNA, 1350 nt, synthetic construct
  misc_feature 1..1350: note = derived and/or modified sequence opt1 from Lucatumumab_HeavyChain1
  source 1..1350: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgtgatcagctacgaggagtccaaccggtaccacgccgacagcgtcaaggggcgcttcaccatctcccgggacaacagcaagatcacgctctacctgcagatgaactccctgcgcaccgaggacaccgccgtgtactactgcgcccgggacggcgggatcgcggcccccggccccgactactgggggcagggcaccctcgtgacggtcagctccgccagcaccaagggcccctccgtgttcccgctggcccccgcgagcaagtccaccagcgggggcaccgccgccctggggtgcctcgtgaaggactacttccccgagcccgtcacggtgtcctggaacagcggcgccctgaccagcggcgtgcacaccttcccggccgtcctgcagtccagcgggctctactccctgagctccgtggtgaccgtccccagctccagcctgggcacgcagacctacatctgcaacgtgaaccacaagccctccaacaccaaggtggacaagcgcgtcgagcccaagagctgcgacaagacccacacgtgcccgccctgccccgcgcccgagctcctcgggggcccgtccgtgttcctgttcccgcccaagcccaaggacaccctcatgatcagccggacccccgaggtgacctgcgtcgtggtcgacgtgtcccacgaggaccccgaggtgaagttcaactggtacgtcgacggggtggaggtgcacaacgccaagacgaagccccgcgaggagcagtacaacagcacctaccgggtcgtgtccgtgctgaccgtcctgcaccaggactggctcaacggcaaggagtacaagtgcaaggtgagcaacaaggccctgcccgccccgatcgagaagaccatctccaaggccaagggccagccccgcgagccccaggtgtacacgctgcccccgagccgggaggagatgaccaagaaccaggtctccctgacctgcctggtgaaggggttctaccccagcgacatcgcggtggagtgggagagcaacggccagcccgagaacaactacaagaccacgccgcccgtcctggactccgacgggagcttcttcctctactccaagctgaccgtggacaagagccgctggcagcagggcaacgtgttctcctgcagcgtcatgcacgaggccctgcacaaccactacacccagaagtccctcagcctgtcccccgggaag

SEQ ID NO: 8184 - RNA, 657 nt, synthetic construct
  misc_feature 1..657: note = derived and/or modified sequence opt1 from Lucatumumab_LightChain1
  source 1..657: mol_type = other RNA
gacatcgtgatgacccagagccccctgtccctcaccgtcacgccgggcgagcccgccagcatctcctgccgcagctcccagagcctgctgtactccaacgggtacaactacctcgactggtacctgcagaagcccggccagagcccccaggtgctgatctccctcgggagcaaccgggcctccggcgtgccggaccgcttcagcgggtccggcagcggcaccgacttcaccctgaagatctcccgggtcgaggcggaggacgtgggggtgtactactgcatgcaggcccgccagacccccttcacgttcggccccgggaccaaggtcgacatccggcgcaccgtggccgcccccagcgtgttcatcttcccgccctccgacgagcagctcaagagcggcaccgcctccgtcgtgtgcctgctgaacaacttctacccccgggaggcgaaggtgcagtggaaggtcgacaacgccctgcagagcgggaacagccaggagtccgtgacggagcaggacagcaaggactccacctacagcctctccagcaccctgaccctgtccaaggccgactacgagaagcacaaggtgtacgcctgcgaggtcacgcaccagggcctcagctcccccgtgaccaagagcttcaaccgcggcgagtgc

SEQ ID NO: 8185 - RNA, 324 nt, synthetic construct
  misc_feature 1..324: note = derived and/or modified sequence opt1 from Lulizumab_pegol_LightChain1
  source 1..324: mol_type = other RNA
gacatccagatgacccagagcccctccagcctgtccgccagcgtgggcgaccgcgtcaccatcacgtgccgggcctcccgcccgatctggcccttcctcgagtggtaccagcagaagcccgggaaggcgcccaagctgctgatctacttcaccagccggctccgccacggcgtgccgtcccggttcagcgggtccggcagcgggacctgcttcaccctgacgatctccagcctgcagcccgaggacttcgccacctactactgcctccagaacgtggccaaccccgccaccttctcccagggcaccaaggtcgagatcaagcgc

SEQ ID NO: 8186 - RNA, 324 nt, synthetic construct; identical to SEQ ID NO: 8185
  misc_feature 1..324: note = derived and/or modified sequence opt1 from Lulizumab_pegol_LightChain
  source 1..324: mol_type = other RNA

SEQ ID NO: 8187 - RNA, 1194 nt, synthetic construct
  misc_feature 1..1194: note = derived and/or modified sequence opt1 from Lumiliximab_HeavyChain1
  source 1..1194: mol_type = other RNA
gaggtgcagctggtcgagagcggcgggggcctcgccaagcccgggggctccctgcgcctgagctgcgccgcgtccgggttccggttcaccttcaacaactactacatggactgggtgcgccaggccccgggccagggcctcgagtgggtgctgaccacggggagcgactcctggggccagggggtcctggtgaccgtgagctccgccagcaccaagggcccctccgtcttccccctcgcccccagctccaagagcacctccgggggcacggccgcgctgggctgcctggtgaaggactacttcccggagcccgtgaccgtcagctggaactccggggccctcaccagcggcgtgcacaccttccccgccgtgctgcagtccagcgggctgtactccctcagcagcgtcgtgacggtgccctccagctccctgggcacccagacctacatctgcaacgtcaaccacaagccgagcaacaccaaggtggacaagaaggtggagcccaagtcctgcgacaagacgcacacgtgcccgccctgcccggcccccgagctgctcggcgggcccagcgtcttcctgttcccgcccaagcccaaggacaccctgatgatctcccggacccccgaggtgacctgcgtggtcgtggacgtgagccacgaggaccccgaggtcaagttcaactggtacgtggacggcgtcgaggtgcacaacgcgaagaccaagccgcgcgaggagcagtacaactccacctaccgggtggtcagcgtgctcaccgtgctgcaccaggactggctgaacgggaaggagtacaagtgcaaggtctccaacaaggccctccccgcccccatcgagaagacgatcagcaaggccaagggccagccccgcgagccccaggtgtacaccctgccgccctcccgggacgagctgaccaagaaccaggtgagcctgacctgcctcgtcaaggggttctacccctccgacatcgccgtggagtgggagagcaacggccagcccgagaacaactacaagacgaccccgcccgtgctggactccgacggcagcttcttcctctactccaagctgaccgtcgacaagagccgctggcagcaggggaacgtgttcagctgctccgtgatgcacgaggcgctgcacaaccactacacccagaagtccctcagcctgagccccggcaag

SEQ ID NO: 8188 - RNA, 642 nt, synthetic construct
  misc_feature 1..642: note = derived and/or modified sequence opt1 from Lumiliximab_LightChain1
  source 1..642: mol_type = other RNA
gacatccagatgacccagagcccctccagcctgtccgccagcgtgggcgaccgcgtcaccatcacgtgccgggcctcccaggacatccgctactacctcaactggtaccagcagaagccggggaaggcgcccaagctgctgatctacgtggccagctccctccagagcggcgtgccctcccggttcagcgggtccggcagcgggaccgagttcaccctgaccgtctccagcctgcagcccgaggacttcgccacgtactactgcctccaggtgtactccaccccgcgcaccttcggccagggcaccaaggtggagatcaagcggacggtcgccgcccccagcgtgttcatcttcccgccctccgacgagcagctcaagagcgggaccgcgtccgtggtctgcctgctgaacaacttctacccccgcgaggccaaggtgcagtggaaggtggacaacgccctgcagagcggcaacagccaggagtccgtcaccgagcaggacagcaaggactccacctacagcctgtccagcacgctcaccctgtccaaggccgactacgagaagcacaaggtgtacgcgtgcgaggtgacccaccaggggctgagctcccccgtcaccaagagcttcaaccggggcgagtgc

SEQ ID NO: 8189 - RNA, 1347 nt, synthetic construct
  misc_feature 1..1347: note = derived and/or modified sequence opt1 from Lumretuzumab_HeavyChain1
  source 1..1347: mol_type = other RNA
caggtgcagctggtccagagcggcgccgaggtgaagaagcccggggcctccgtgaaggtcagctgcaaggcgtccggctacaccttccgcagctcctacatcagctgggtgcggcaggccccggggcagggcctcgagtggatggggtggatctacgccggcaccggctcccccagctacaaccagaagctgcaggggcgcgtgaccatgaccaccgacacctccacgagcaccgcctacatggagctgcggtccctccgcagcgacgacaccgccgtctactactgcgcgcggcaccgcgactactactccaacagcctgacctactggggccaggggacgctggtgaccgtgtccagcgcctccaccaagggccccagcgtcttccccctcgccccgtccagcaagagcacctccgggggcacggccgcgctgggctgcctggtgaaggactacttccccgagcccgtgaccgtcagctggaactccggggccctcaccagcggcgtgcacaccttccccgccgtgctgcagtccagcgggctgtactccctcagctccgtcgtgacggtgccgagctccagcctgggcacccagacctacatctgcaacgtcaaccacaagccctccaacaccaaggtggacaagaaggtggagcccaagagctgcgacaagacgcacacgtgcccgccctgccccgcccccgagctgctcggcgggccctccgtcttcctgttcccgcccaagcccaaggacaccctgatgatcagccggacccccgaggtgacctgcgtggtcgtggacgtctcccacgaggacccggaggtgaagttcaactggtacgtggacggcgtcgaggtgcacaacgccaagaccaagccccgcgaggagcagtacaacagcacctaccgggtggtctccgtgctcaccgtgctgcaccaggactggctgaacgggaaggagtacaagtgcaaggtcagcaacaaggcgctccccgcccccatcgagaagacgatcagcaaggccaagggccagccgcgcgagccccaggtgtacaccctgccgccctcccgggacgagctgaccaagaaccaggtgagcctgacctgcctcgtcaaggggttctacccctccgacatcgccgtggagtgggagagcaacggccagcccgagaacaactacaagacgacgcccccggtgctggactccgacggcagcttcttcctctactccaagctgaccgtcgacaagagccgctggcagcaggggaacgtgttctcctgcagcgtgatgcacgaggccctgcacaaccactacacccagaagtccctcagcctgtcccccggc

SEQ ID NO: 8190 - RNA, 660 nt, synthetic construct
  misc_feature 1..660: note = derived and/or modified sequence opt1 from Lumretuzumab_LightChain1
  source 1..660: mol_type = other RNA
gacatcgtgatgacccagagccccgactccctggccgtcagcctcggcgagcgggccaccatcaactgcaagtccagccagtccgtgctgaacagcgggaaccagaagaactacctgacgtggtaccagcagaagccgggccagccgcccaagctcctgatctactgggcgtccacccgggagagcggggtgcccgaccgcttctccggcagcgggtccggcaccgacttcaccctgacgatcagctccctccaggccgaggacgtcgccgtgtactactgccagagcgactactcctacccctacaccttcggccaggggaccaagctggagatcaagcggaccgtggccgcccccagcgtcttcatcttcccgccctccgacgagcagctcaagagcggcacggcgtccgtggtgtgcctgctgaacaacttctacccccgcgaggccaaggtccagtggaaggtggacaacgccctgcagagcgggaacagccaggagtccgtgaccgagcaggacagcaaggactccacctacagcctctccagcaccctgacgctgtccaaggccgactacgagaagcacaaggtctacgcgtgcgaggtgacccaccagggcctcagctcccccgtgaccaagagcttcaaccgcggggagtgc

SEQ ID NO: 8191 - RNA, 1329 nt, synthetic construct; identical to SEQ ID NO: 7717
  misc_feature 1..1329: note = derived and/or modified sequence opt1 from Lutetium_(177Lu)_lilotomab_satetraxetan_HeavyChain1
  source 1..1329: mol_type = other RNA

SEQ ID NO: 8192 - RNA, 642 nt, synthetic construct; identical to SEQ ID NO: 7718
  misc_feature 1..642: note = derived and/or modified sequence opt1 from Lutetium_(177Lu)_lilotomab_satetraxetan_LightChain1
  source 1..642: mol_type = other RNA

SEQ ID NO: 8193 - RNA, 1350 nt, synthetic construct
  misc_feature 1..1350: note = derived and/or modified sequence opt1 from Margetuximab_HeavyChain1
  source 1..1350: mol_type = other RNA
caggtgcagctgcagcagagcggccccgagctcgtcaagccgggggcctccctgaagctgagctgcaccgcctccggcttcaacatcaaggacacctacatccactgggtgaagcagcgccccgagcaggggctcgagtggatcggccggatctaccccacgaacgggtacacccgctacgaccccaagttccaggacaaggcgaccatcaccgccgacacgagctccaacaccgcctacctccaggtgagccggctgacctccgaggacaccgccgtctactactgcagccgctggggcggcgacgggttctacgccatggactactggggccagggggcgtccgtgacggtgagctccgccagcaccaagggcccgtccgtcttccccctggcccccagctccaagagcacctccgggggcaccgccgcgctgggctgcctggtgaaggactacttccccgagccggtgacggtcagctggaactccggggccctcaccagcggcgtgcacaccttccccgccgtgctgcagagctccgggctgtacagcctctccagcgtcgtgaccgtgccctccagctccctgggcacgcagacctacatctgcaacgtcaaccacaagcccagcaacaccaaggtggacaagcgggtggagccgaagtcctgcgacaagacccacacgtgcccgccctgccccgccccggagctggtcggcgggcccagcgtgttcctcctgccgcccaagcccaaggacaccctgatgatctcccgcacccccgaggtgacctgcgtcgtggtggacgtcagccacgaggaccccgaggtgaagttcaactggtacgtcgacggcgtggaggtgcacaacgccaagacgaagcccccggaggagcagtacaactccaccctccgggtcgtgagcgtgctgaccgtcctgcaccaggactggctcaacgggaaggagtacaagtgcaaggtgtccaacaaggcgctgcccgcccccatcgagaagaccatcagcaaggccaagggccagccccgcgagccccaggtgtacacgctgccgccctcccgggacgagctcaccaagaaccaggtcagcctgacctgcctggtgaaggggttctacccctccgacatcgccgtggagtgggagagcaacggccagcccgagaacaactacaagaccacgcccctcgtcctggacagcgacggctccttcttcctgtacagcaagctcaccgtggacaagtcccgctggcagcaggggaacgtgttcagctgctccgtcatgcacgaggccctgcacaaccactacacccagaagtccctgagcctcagccccggcaag

SEQ ID NO: 8194 - RNA, 642 nt, synthetic construct
  misc_feature 1..642: note = derived and/or modified sequence opt1 from Margetuximab_LightChain1
  source 1..642: mol_type = other RNA
gacatcgtgatgacccagagccacaagttcatgtccaccagcgtcggcgaccgcgtgtccatcacgtgcaaggccagccaggacgtgaacaccgccgtcgcgtggtaccagcagaagcccgggcactccccgaagctgctcatctacagcgcctccttccggtacaccggcgtgcccgaccgcttcaccgggagccggtccggcacggacttcaccttcaccatcagctccgtgcaggccgaggacctggccgtctactactgccagcagcactacaccacgccgcccaccttcgggggcggcaccaaggtggagatcaagcgcaccgtggccgcgcccagcgtcttcatcttcccgccctccgacgagcagctcaagagcgggacggcctccgtggtgtgcctgctgaacaacttctacccccgggaggccaaggtccagtggaaggtggacaacgccctgcagagcggcaactcccaggagagcgtgaccgagcaggactccaaggacagcacctacagcctctccagcaccctgacgctgtccaaggcggactacgagaagcacaaggtctacgcctgcgaggtgacccaccaggggctcagctcccccgtgaccaagagcttcaaccgcggcgagtgc

SEQ ID NO: 8195 - RNA, 762 nt, synthetic construct
  misc_feature 1..762: note = derived and/or modified sequence opt1 from Marzeptacog_alfa_HeavyChain1
  source 1..762: mol_type = other RNA
atcgtgggcgggaaggtctgccccaagggcgagtgcccgtggcaggtcctgctcctggtgaacggggcccagctgtgcggcgggaccctcatcaacaccatctgggtggtgagcgccgcgcactgcttcgacaagatcaagaactggcgcaacctgatcgccgtgctgggcgagcacgacctctccgagcacgacggcgacgagcagagccggcgcgtcgcccaggtgatcatcccctccacgtacgtgcccgggaccaccaaccacgacatcgccctgctgcggctccaccagcccgtcgtgctgaccgaccacgtggtcccgctgtgcctccccgagcgcacgttcagcgagcggaccctggccttcgtgcgcttctccctggtgagcggctgggggcggctcctggaccgcggcgcgaccgccctggagctccaggtcctgaacgtgccccggctgatgacccaggactgcctccagcagtcccgcaaggtgggggacagccccaacatcacggagtacatgttctgcgccggctactccgacggcagcaaggactcctgcaagggggacagcggcgggccgcacgccacccactaccggggcacctggtacctgaccggcatcgtctcctgggggcagggctgcgcgacggtggggcacttcggcgtgtacacccgcgtcagccagtacatcgagtggctgcagaagctcatgcggtccgagccccgccccggggtgctgctgcgggcccccttcccg

SEQ ID NO: 8196 - RNA, 456 nt, synthetic construct
  misc_feature 1..456: note = derived and/or modified sequence opt1 from Marzeptacog_alfa_LightChain1
  source 1..456: mol_type = other RNA
gccaacgccttcctggaggagctccgccccggcagcctggagcgggagtgcaaggaggagcagtgctccttcgaggaggcgcgcgagatcttcaaggacgccgagcggaccaagctgttctggatcagctactccgacggggaccagtgcgccagctccccgtgccagaacggcgggagctgcaaggaccagctccagtcctacatctgcttctgcctgcccgccttcgagggccgcaactgcgagacccacaaggacgaccagctgatctgcgtgaacgagaacgggggctgcgagcagtactgcagcgaccacacgggcaccaagcggtcctgccgctgccacgaggggtacagcctcctggccgacggcgtctcctgcaacgcgaccgtggagtacccctgcgggaagatccccatcctggagaagcggaacgccagcaagccgcagggccgc

SEQ ID NO: 8197 - RNA, 669 nt, synthetic construct
  misc_feature 1..669: note = derived and/or modified sequence opt1 from Matuzumab_HeavyChain1_variant_3c08_H
  source 1..669: mol_type = other RNA
caggtgcagctggtccagagcggcgccgaggtgaagaagcccggggcctccgtgaaggtcagctgcaaggcgtccggctacaccttcaccagccactggatgcactgggtgcgccaggccccggggcagggcctcgagtggatcggggagttcaacccctccaacggccggacgaactacaacgagaagttcaagagcaaggccaccatgaccgtggacacctccacgaacaccgcctacatggagctgagctccctgcgcagcgaggacaccgccgtctactactgcgcgtcccgggactacgactacgacggccgctacttcgactactgggggcagggcaccctcgtgacggtgagctccgccagcaccaaggggccctccgtcttccccctggccccgagctccaagagcacctccggcgggaccgccgcgctgggctgcctcgtgaaggactacttccccgagcccgtgacggtcagctggaacagcggcgccctgacctccggggtgcacaccttccccgccgtgctgcagagctccggcctctacagcctgtccagcgtcgtgaccgtgccgtccagctccctggggacgcagacctacatctgcaacgtcaaccacaagcccagcaacaccaaggtggacaagaaggtggagcccaagtcc

SEQ ID NO: 8198 - RNA, 669 nt, synthetic construct
  misc_feature 1..669: note = derived and/or modified sequence opt1 from Matuzumab_HeavyChain1_variant_3c09_C
  source 1..669: mol_type = other RNA
caggtgcagctggtccagagcggcgccgaggtgaagaagcccggggcctccgtgaaggtcagctgcaaggcgtccggctacaccttcaccagccactggatgcactgggtgcgccaggccccggggcagggcctcgagtggatcggggagttcaacccctccaacggccggacgaactacaacgagaagttcaagagcaaggccaccatgaccgtggacacctccacgaacaccgcctacatggagctgagctccctgcgcagcgaggacaccgccgtctactactgcgcgtcccgggactacgactacgccggccgctacttcgactactgggggcagggcaccctcgtgacggtgagctccgccagcaccaaggggccctccgtcttccccctggccccgagctccaagagcacctccggcgggaccgcggccctgggctgcctcgtgaaggactacttccccgagcccgtgacggtcagctggaacagcggcgccctgacctccggggtgcacaccttccccgccgtgctgcagagctccggcctctacagcctgtccagcgtcgtgaccgtgccgtccagctccctggggacgcagacctacatctgcaacgtcaaccacaagcccagcaacaccaaggtggacaagaaggtggagcccaagtcc

SEQ ID NO: 8199 - RNA, 636 nt, synthetic construct
  misc_feature 1..636: note = derived and/or modified sequence opt1 from Matuzumab_LightChain1_variant_3c08_L
  source 1..636: mol_type = other RNA
gacatccagatgacccagagcccctccagcctgtccgccagcgtgggcgaccgcgtcaccatcacgtgctccgccagctccagcgtgacctacatgtactggtaccagcagaagccggggaaggcgcccaagctcctgatctacgacacctccaacctggccagcggcgtgccctcccggttcagcgggtccggcagcgggaccgactacacgttcaccatctccagcctccagcccgaggacatcgccacctactactgccagcagtggtccagccacatcttcaccttcggccagggcacgaaggtcgagatcaagcgcaccgtggccgccccgtccgtgttcatcttcccgcccagcgacgagcagctcaagagcgggaccgcgtccgtcgtgtgcctgctgaacaacttctacccccgggaggccaaggtgcagtggaaggtcgacaacgccctgcagagcggcaactcccaggagagcgtgaccgagcaggactccaaggacagcacgtactccctgagctccaccctcaccctgagcaaggccgactacgagaagcacaaggtgtacgcgtgcgaggtcacccaccaggggctgtccagccccgtgacgaagtccttcaaccgcggcgag

SEQ ID NO: 8200 - RNA, 636 nt, synthetic construct; identical to SEQ ID NO: 8199
  misc_feature 1..636: note = derived and/or modified sequence opt1 from Matuzumab_LightChain1_variant_3c09_B
  source 1..636: mol_type = other RNA

SEQ ID NO: 8201 - RNA, 1341 nt, synthetic construct
  misc_feature 1..1341: note = derived and/or modified sequence opt1 from Mavrilimumab_HeavyChain1
  source 1..1341: mol_type = other RNA
caggtgcagctggtccagagcggcgccgaggtgaagaagcccggggcctccgtgaaggtcagctgcaaggtgtccggctacaccctcaccgagctgagcatccactgggtgcgccaggcgccggggaagggcctggagtggatgggcggcttcgaccccgaggagaacgagatcgtctacgcccagcggttccagggccgcgtgacgatgaccgaggacacctccaccgacacggcctacatggagctcagctccctgcggagcgaggacaccgccgtgtactactgcgccatcgtcgggtccttcagccccctgaccctcggcctgtgggggcagggcaccatggtgacggtgtccagcgcgtccaccaaggggcccagcgtcttcccgctggccccctgctcccgcagcacctccgagagcaccgccgccctcggctgcctggtgaaggactacttccccgagcccgtgacggtctcctggaacagcggcgcgctgaccagcggggtgcacaccttcccggccgtgctccagtccagcggcctgtactccctgagctccgtcgtgaccgtgcccagctccagcctcgggacgaagacctacacgtgcaacgtcgaccacaagccctccaacaccaaggtggacaagcgggtggagagcaagtacgggcccccgtgcccctcctgccccgcccccgagttcctgggcgggccgagcgtcttcctgttcccgcccaagcccaaggacaccctcatgatctcccgcacccccgaggtgacctgcgtcgtggtggacgtcagccaggaggaccccgaggtgcagttcaactggtacgtggacggcgtcgaggtgcacaacgccaagaccaagccccgggaggagcagttcaactccacgtaccgcgtggtcagcgtgctgaccgtgctgcaccaggactggctcaacgggaaggagtacaagtgcaaggtctccaacaagggcctgcccagctccatcgagaagaccatcagcaaggccaaggggcagccgcgggagccccaggtgtacaccctgccgcccagccaggaggagatgacgaagaaccaggtgtccctgacctgcctcgtcaagggcttctaccccagcgacatcgcggtggagtgggagtccaacggccagcccgagaacaactacaagaccacgcccccggtgctggacagcgacgggtccttcttcctctacagccgcctgaccgtcgacaagtcccggtggcaggagggcaacgtgttcagctgctccgtgatgcacgaggccctgcacaaccactacacccagaagtccctcagcctgagcctggggaag

SEQ ID NO: 8202 - RNA, 651 nt, synthetic construct
  misc_feature 1..651: note = derived and/or modified sequence opt1 from Mavrilimumab_LightChain1
  source 1..651: mol_type = other RNA
cagagcgtgctgacccagcccccgtccgtcagcggcgcccccgggcagcgcgtgaccatctcctgcacgggcagcgggtccaacatcggcgccccctacgacgtgagctggtaccagcagctccccgggaccgcgccgaagctgctgatctaccacaacaacaagcggccctccggcgtccccgaccgcttcagcggctccaagagcgggacctccgccagcctcgccatcaccggcctgcaggccgaggacgaggccgactactactgcgcgacggtggaggccgggctgtccggcagcgtgttcgggggcggcaccaagctcaccgtcctggggcagcccaaggccgccccgtccgtgaccctgttcccgcccagctccgaggagctccaggcgaacaaggccacgctggtgtgcctgatcagcgacttctaccccggcgccgtcaccgtggcctggaaggccgactccagccccgtgaaggcgggggtcgagaccaccacgcccagcaagcagtccaacaacaagtacgccgccagctcctacctcagcctgacccccgagcagtggaagtcccaccggagctactcctgccaggtgacccacgagggcagcaccgtggagaagacggtcgcccccaccgagtgctcc

SEQ ID NO: 8203 - RNA, 1359 nt, synthetic construct
  misc_feature 1..1359: note = derived and/or modified sequence opt1 from MDX-1303_HeavyChain1
  source 1..1359: mol_type = other RNA
caggtgcagctggtcgagagcggcgggggcgtggtgcagcccgggcgctccctccggctgagctgcgccgcctccggcttcaccttcagctactacgggatgcactgggtccgccaggcgccgggcaagggcctggagtgggtggccgtgatctggcacgacgagtccatcgtctactacgccgacagcgtgaaggggcggttcaccatctcccgcgacaacagcaagaacacgctctacctgcagatgaactccctgcgggccgaggacaccgccgtgtactactgcacccgcgaccccggcgacccctactactactactacgggctcgacgtctggggccaggggaccacggtgaccgtgagctccgcgagcaccaagggcccctccgtcttcccgctggcccccagctccaagagcacctccggcgggacggccgccctgggctgcctcgtgaaggactacttccccgagcccgtgaccgtcagctggaactccggggcgctgaccagcggcgtgcacaccttcccggccgtgctgcagagctccggcctctacagcctgtccagcgtcgtgacggtgccctccagctccctggggacccagacctacatctgcaacgtcaaccacaagcccagcaacaccaaggtggacaagcgggtggagcccaagtcctgcgacaagacgcacacgtgcccgccctgccccgcccccgagctcctgggcgggccgagcgtcttcctgttcccgcccaagcccaaggacaccctcatgatctcccgcacccccgaggtgacctgcgtcgtggtggacgtcagccacgaggaccccgaggtgaagttcaactggtacgtggacggcgtcgaggtgcacaacgccaagaccaagccccgggaggagcagtacaactccacctaccgcgtggtcagcgtgctgaccgtgctgcaccaggactggctcaacgggaaggagtacaagtgcaaggtctccaacaaggccctgcccgcgccgatcgagaagacgatcagcaaggccaagggccagccccgggagccccaggtgtacaccctgcccccgtcccgcgaggagatgaccaagaaccaggtgagcctgacctgcctcgtcaagggcttctacccctccgacatcgccgtggagtgggagagcaacgggcagcccgagaacaactacaagacgaccccgcccgtgctggacagcgacggctccttcttcctctacagcaagctgaccgtcgacaagtcccggtggcagcaggggaacgtgttcagctgctccgtgatgcacgaggccctgcacaaccactacacccagaagtccctcagcctgagccccggcaag

SEQ ID NO: 8204 - RNA, 645 nt, synthetic construct
  misc_feature 1..645: note = derived and/or modified sequence opt1 from MDX-1303_LightChain1
  source 1..645: mol_type = other RNA
gagatcgtgctgacccagagccccggcaccctctccctgagcccgggggagcgcgccacgctgtcctgccgggccagccagtccgtcagctccagctacctcgcgtggtaccagcagaagcccggccaggcgccccgcctgctgatctacggggcctccagccgggccaccggcatccccgaccgcttctccgggagcggctccggcaccgacttcaccctcacgatcagccggctggagccggaggacttcgccgtgtactactgccagcagtacgggtccagcatgtacaccttcggccaggggaccaagctggagatcaagcgcaccgtggccgccccctccgtcttcatcttcccgcccagcgacgagcagctcaagtccggcacggccagcgtggtgtgcctgctgaacaacttctacccccgggaggccaaggtccagtggaaggtggacaacgcgctccagagcgggaactcccaggagagcgtgaccgagcaggactccaaggacagcacctactccctgagctccaccctgacgctcagcaaggccgactacgagaagcacaaggtctacgcctgcgaggtgacccaccagggcctgtccagccccgtgaccaagtccttcaaccgcggcgagtgc

SEQ ID NO: 8205 - RNA, 1347 nt, synthetic construct
  misc_feature 1..1347: note = derived and/or modified sequence opt1 from Mepolizumab_HeavyChain1
  source 1..1347: mol_type = other RNA
caggtgaccctgcgcgagagcggccccgccctcgtcaagccgacccagacgctgaccctgacctgcaccgtgtccgggttcagcctcacgtcctacagcgtgcactgggtccggcagccgcccggcaaggggctggagtggctgggcgtgatctgggcctccgggggcaccgactacaacagcgcgctcatgtcccgcctgagcatctccaaggacaccagccggaaccaggtggtcctgaccatgacgaacatggaccccgtggacaccgccacctactactgcgcccgcgacccgccctccagcctcctgcggctggactactggggccgcgggacccccgtgacggtctccagcgcctccaccaagggccccagcgtgttcccgctcgccccctccagcaagtccaccagcgggggcaccgcggccctggggtgcctggtgaaggactacttccccgagcccgtcacggtgagctggaactccggcgccctcaccagcggcgtgcacaccttccccgccgtcctgcagtccagcgggctgtactccctcagctccgtggtgaccgtccccagctccagcctgggcacgcagacctacatctgcaacgtgaaccacaagccctccaacaccaaggtggacaagcgggtcgagcccaagagctgcgacaagacccacacgtgcccgccctgccccgcgcccgagctgctcgggggcccgtccgtgttcctgttcccgcccaagcccaaggacaccctgatgatcagccgcacccccgaggtgacctgcgtcgtggtcgacgtgtcccacgaggaccccgaggtgaagttcaactggtacgtcgacggcgtggaggtgcacaacgccaagacgaagccccgggaggagcagtacaacagcacctaccgcgtcgtgtccgtgctcaccgtcctgcaccaggactggctgaacgggaaggagtacaagtgcaaggtgagcaacaaggccctccccgccccgatcgagaagaccatctccaaggccaagggccagccccgggagccccaggtgtacacgctgccgcccagccgcgaggagatgaccaagaaccaggtcagcctgacctgcctcgtgaaggggttctacccctccgacatcgcggtggagtgggagagcaacggccagcccgagaacaactacaagaccacgccgcccgtcctggactccgacgggagcttcttcctgtactccaagctcaccgtggacaagagccggtggcagcagggcaacgtgttctcctgcagcgtcatgcacgaggccctgcacaaccactacacccagaagtccctgagcctctcccccggcaag

SEQ ID NO: 8206 - RNA, 660 nt, synthetic construct
  misc_feature 1..660: note = derived and/or modified sequence opt1 from Mepolizumab_LightChain1
  source 1..660: mol_type = other RNA
gacatcgtgatgacccagagccccgactccctggccgtcagcctcggcgagcgcgccaccatcaactgcaagtccagccagtccctgctgaacagcgggaaccagaagaactacctcgcgtggtaccagcagaagccgggccagccgcccaagctgctgatctacggggcctccacgcgggagagcggcgtgcccgaccgcttctccgggagcggctccggcaccgacttcaccctcaccatcagctccctgcaggccgaggacgtggccgtctactactgccagaacgtgcacagcttccccttcacgttcgggggcgggaccaagctggagatcaagcggaccgtggccgcgccctccgtcttcatcttcccgcccagcgacgagcagctcaagtccggcaccgccagcgtggtgtgcctgctgaacaacttctacccccgcgaggccaaggtccagtggaaggtggacaacgccctccagtccgggaacagccaggagagcgtgacggagcaggactccaaggacagcacctactccctgagctccaccctgaccctcagcaaggcggactacgagaagcacaaggtctacgcctgcgaggtgacgcaccagggcctgtccagccccgtgaccaagtccttcaaccggggcgagtgc

SEQ ID NO: 8207 - RNA, 1350 nt, synthetic construct
  misc_feature 1..1350: note = derived and/or modified sequence opt1 from Metelimumab_HeavyChain1
  source 1..1350: mol_type = other RNA
gaggtgcagctggtcgagagcggcgggggcgtggtgcagcccgggcgctccctccggctgagctgcgccgcctccggcttcaccttcagctcctacgggatgcactgggtccgccaggcgccgggcaaggagctggagtgggtggccgtgatcagctacgacggctccatcaagtactacgccgacagcgtcaaggggcggttcaccatctcccgcgacaacagcaagaacaccctctacctgcagatgaactccctgcgggccgaggacaccgccgtgtactactgcgcgcgcaccggcgagtacagcgggtacgacaccgacccccagtactcctggggccaggggacgaccgtgaccgtcagctccgccagcaccaagggcccctccgtgttccccctcgccccgtgcagccggtccacgagcgagagcaccgccgcgctgggctgcctggtgaaggactacttccccgagcccgtcaccgtgtcctggaacagcggggccctcacctccggcgtgcacacgttccccgccgtcctgcagagctccgggctgtacagcctctccagcgtggtgaccgtcccgtccagctccctgggcaccaagacctacacgtgcaacgtggaccacaagcccagcaacaccaaggtggacaagcgcgtcgagtccaagtacggcccgccctgccccagctgccccgcccccgagttcctcgggggcccctccgtgttcctgttcccgcccaagcccaagcccaccctgatgatcagccggaccccggaggtgacgtgcgtcgtggtcgacgtgtcccaggaggaccccgaggtgcagttcaactggtacgtcgacggggtggaggtgcacaacgccaagaccaagccccgcgaggagcagttcaacagcacctaccgggtcgtgtccgtgctgaccgtcctccaccaggactggctgaacggcaaggagtacaagtgcaaggtgagcaacaaggggctgcccagctccatcgagaagacgatcagcaaggcgaagggccagccgcgcgagccccaggtgtacaccctcccgccctcccaggaggagatgaccaagaaccaggtcagcctgacctgcctggtgaagggcttctacccctccgacatcgccgtggagtgggagagcaacgggcagcccgagaacaactacaagacgacgcccccggtcctcgactccgacggcagcttcttcctgtactcccggctgaccgtggacaagagccgctggcaggaggggaacgtgttctcctgcagcgtcatgcacgaggccctccacaaccactacacccagaagtccctgagcctgtccctcggcaag

SEQ ID NO: 8208 - RNA, 639 nt, synthetic construct
  misc_feature 1..639: note = derived and/or modified sequence opt1 from Metelimumab_LightChain1
  source 1..639: mol_type = other RNA
gagatcgtgctgacccagagcccctccagcctctccgccagcgtcggcgaccgcgtgaccatcacgtgccgggcctcccaggggatcggcgacgacctggggtggtaccagcagaagccgggcaaggcgcccatcctgctcatctacgggaccagcaccctgcagtccggcgtgcccagccgcttctccggcagcgggtccggcaccgacttcacgctgaccatcaacagcctccagcccgaggacttcgccacctactactgcctgcaggactccaactacccgctgaccttcgggggcgggacgcggctcgagatcaagcgcaccgtcgccgcccccagcgtgttcatcttcccgccctccgacgagcagctcaagagcggcaccgcctccgtggtctgcctgctgaacaacttctacccccgggaggcgaaggtgcagtggaaggtggacaacgccctgcagagcggcaactcccaggagagcgtcaccgagcaggacagcaaggactccacgtacagcctgtccagcaccctcaccctgtccaaggccgactacgagaagcacaaggtgtacgcctgcgaggtgacccaccaggggctgagccccgtcacgaagtccttcaaccgcggcgagtgc

SEQ ID NO: 8209 - RNA, 1350 nt, synthetic construct
  misc_feature 1..1350: note = derived and/or modified sequence opt1 from Milatuzumab_HeavyChain1
  source 1..1350: mol_type = other RNA
caggtgcagctgcagcagagcggctccgagctcaagaagcccggggccagcgtcaaggtgtcctgcaaggccagcggctacaccttcaccaactacggggtgaactggatcaagcaggcgccgggccaggggctgcagtggatgggctggatcaaccccaacacgggcgagcccaccttcgacgacgacttcaaggggcgcttcgccttctccctggacaccagcgtctccaccgcctacctccagatcagctccctgaaggccgacgacacggccgtgtacttctgcagccggtcccgcggcaagaacgaggcgtggttcgcctactgggggcagggcaccctggtgaccgtcagctccgccagcaccaaggggccctccgtgttcccgctcgcccccagctccaagagcacgtccggcggcaccgcggccctggggtgcctggtgaaggactacttccccgagcccgtcaccgtgagctggaacagcggcgccctcacctccggggtgcacacgttcccggccgtcctgcagagctccggcctgtacagcctctccagcgtggtgaccgtcccctccagctccctgggcacccagacctacatctgcaacgtgaaccacaagcccagcaacacgaaggtggacaagcgggtcgagcccaagtcctgcgacaagacccacacgtgcccgccctgccccgcccccgagctgctcgggggcccgagcgtgttcctgttcccgcccaagcccaaggacaccctgatgatctcccgcacccccgaggtgacctgcgtcgtggtggacgtcagccacgaggaccccgaggtgaagttcaactggtacgtcgacggggtggaggtgcacaacgcgaagaccaagccccgggaggagcagtacaactccacctaccgcgtcgtgagcgtgctcacggtcctgcaccaggactggctgaacggcaaggagtacaagtgcaaggtgtccaacaaggccctccccgccccgatcgagaagaccatcagcaaggccaaggggcagccccgggagccccaggtgtacaccctgcccccgtcccgcgaggagatgaccaagaaccaggtcagcctgacgtgcctcgtgaagggcttctaccccagcgacatcgccgtggagtgggagtccaacggccagcccgagaacaactacaagaccaccccgcccgtcctggacagcgacgggtccttcttcctgtacagcaagctcaccgtggacaagtcccggtggcagcagggcaacgtgttcagctgctccgtcatgcacgaggcgctgcacaaccactacacgcagaagtccctgagcctcagccccgggaag

SEQ ID NO: 8210 - RNA, 657 nt, synthetic construct
  misc_feature 1..657: note = derived and/or modified sequence opt1 from Milatuzumab_LightChain1
  source 1..657: mol_type = other RNA
gacatccagctgacccagagccccctctccctgcccgtgaccctgggccagcccgccagcatctcctgccgcagctcccagagcctcgtccaccggaacgggaacacgtacctgcactggttccagcagcgccccggccagagcccccggctgctcatctacaccgtgtccaaccgcttctccggggtgccggaccggttcagcggctccgggagcggcaccgacttcaccctgaagatctcccgcgtcgaggccgaggacgtgggcgtgtacttctgcagccagtccagccacgtcccgcccacgttcggggcgggcacccggctggagatcaagcgcaccgtggccgccccctccgtgttcatcttcccgcccagcgacgagcagctcaagtccgggaccgccagcgtcgtgtgcctgctgaacaacttctacccccgggaggccaaggtgcagtggaaggtcgacaacgcgctccagagcggcaactcccaggagagcgtgacggagcaggactccaaggacagcacctactccctgagctccaccctgaccctcagcaaggccgactacgagaagcacaaggtgtacgcctgcgaggtcacgcaccaggggctgtccagccccgtgaccaagtccttcaaccgcggcgagtgc

SEQ ID NO: 8211 - RNA, 1341 nt, synthetic construct
  misc_feature 1..1341: note = derived and/or modified sequence opt1 from Mirvetuximab_HeavyChain1
  source 1..1341: mol_type = other RNA
caggtgcagctggtccagagcggcgccgaggtggtgaagcccggggcctccgtcaagatcagctgcaaggcgtccggctacaccttcaccgggtacttcatgaactgggtgaagcagagcccgggccagtccctcgagtggatcgggcgcatccacccctacgacggcgacacgttctacaaccagaagttccagggcaaggccaccctgaccgtggacaagagctccaacaccgcccacatggagctgctcagcctgacgtccgaggacttcgccgtctactactgcacccggtacgacgggagccgcgccatggactactggggccaggggaccaccgtgacggtgtccagcgcgtccaccaagggccccagcgtcttccccctggccccgtccagcaagtccaccagcgggggcaccgccgccctcggctgcctggtgaaggactacttccccgagcccgtgacggtctcctggaacagcggggcgctgaccagcggcgtgcacaccttccccgccgtgctccagtccagcgggctgtactccctgagctccgtcgtgaccgtgccgagctccagcctcggcacgcagacctacatctgcaacgtcaaccacaagccctccaacaccaaggtggacaagaaggtggagcccaagagctgcgacaagacccacacgtgcccgccctgccccgcccccgagctgctgggcgggccctccgtcttcctcttcccgcccaagcccaaggacaccctgatgatcagccggacccccgaggtgacctgcgtggtcgtggacgtctcccacgaggacccggaggtgaagttcaactggtacgtggacggcgtcgaggtgcacaacgccaagacgaagccccgcgaggagcagtacaacagcacctaccgggtggtctccgtgctgaccgtgctccaccaggactggctgaacgggaaggagtacaagtgcaaggtcagcaacaaggccctgcccgcgcccatcgagaagaccatctccaaggccaagggccagccgcgcgagccccaggtgtacacgctcccgcccagccgggacgagctgaccaagaaccaggtgtccctgacctgcctcgtcaaggggttctaccccagcgacatcgccgtggagtgggagagcaacggccagcccgagaacaactacaagaccacgcccccggtgctggactccgacggcagcttcttcctgtactccaagctcaccgtcgacaagagccgctggcagcaggggaacgtgttctcctgcagcgtgatgcacgaggccctgcacaaccactacacccagaagtccctgagcctctcccccggc

SEQ ID NO: 8212 - RNA, 654 nt, synthetic construct
  misc_feature 1..654: note = derived and/or modified sequence opt1 from Mirvetuximab_LightChain1
  source 1..654: mol_type = other RNA
gacatcgtgctgacccagagccccctctccctggccgtcagcctgggccagccggccatcatctcctgcaaggcgagccagtccgtgagcttcgccgggacctccctcatgcactggtaccaccagaagcccggccagcagccccgcctgctgatctaccgggccagcaacctcgaggccggggtgcccgaccgcttctccggcagcgggtccaagacggacttcaccctgaccatcagcccggtcgaggccgaggacgcggccacctactactgccagcagtcccgggagtacccctacacgttcggcggcgggaccaagctggagatcaagcgcaccgtggccgcccccagcgtgttcatcttcccgccctccgacgagcagctcaagagcggcaccgcgtccgtcgtgtgcctgctgaacaacttctacccccgggaggccaaggtgcagtggaaggtcgacaacgccctccagagcgggaactcccaggagagcgtgacggagcaggacagcaaggactccacctacagcctgtccagcaccctgaccctctccaaggccgactacgagaagcacaaggtgtacgcctgcgaggtcacgcaccagggcctgagctcccccgtgaccaagagcttcaaccgcggggagtgc

SEQ ID NO: 8213 - RNA, 1344 nt, synthetic construct
  misc_feature 1..1344: note = derived and/or modified sequence opt1 from Modotuximab_HeavyChain1
  source 1..1344: mol_type = other RNA
caggtgcagctgcagcagcccggcgccgagctcgtcgagcccgggggcagcgtgaagctgtcctgcaaggccagcgggtacaccttcacctcccactggatgcactgggtgaagcagcgccccggccaggggctggagtggatcggcgagatcaaccccagctccggccggaacaactacaacgagaagttcaagagcaaggcgacgctcaccgtcgacaagtccagctccaccgcctacatgcagttcagctccctgaccagcgaggactccgccgtgtactactgcgtgcgctactacgggtacgacgaggccatggactactggggccaggggacgagcgtcaccgtgtccagcgcctccaccaagggccccagcgtgttcccgctggcgccctccagcaagagcacctccgggggcacggccgccctcggctgcctggtcaaggactacttccccgagcccgtgaccgtgagctggaactccggggccctgaccagcggcgtccacaccttcccggcggtgctccagtccagcgggctgtactccctgagctccgtggtcacggtgcccagctccagcctcggcacccagacctacatctgcaacgtgaaccacaagccctccaacaccaaggtcgacaagcgggtggagcccaagagctgcgacaagacgcacacgtgcccgccctgccccgcccccgagctgctgggcgggccgtccgtgttcctcttcccgcccaagcccaaggacaccctgatgatcagccgcaccccggaggtgacctgcgtcgtggtcgacgtgtcccacgaggaccccgaggtcaagttcaactggtacgtggacggcgtggaggtccacaacgccaagaccaagccccgggaggagcagtacaacagcacctaccgcgtggtgtccgtcctgaccgtgctccaccaggactggctgaacgggaaggagtacaagtgcaaggtgagcaacaaggccctgcccgccccgatcgagaagacgatcagcaaggcgaagggccagccccgggagccccaggtctacaccctcccgccctcccgcgaggagatgaccaagaaccaggtgagcctgacctgcctggtgaaggggttctacccctccgacatcgccgtcgagtgggagagcaacggccagcccgagaacaactacaagacgaccccgcccgtgctcgactccgacggcagcttcttcctgtactccaagctgaccgtggacaagagccggtggcagcaggggaacgtcttctcctgcagcgtgatgcacgaggccctccacaaccactacacccagaagtccctgagcctgtcccccggc

SEQ ID NO: 8214 - RNA, 657 nt, synthetic construct
  misc_feature 1..657: note = derived and/or modified sequence opt1 from Modotuximab_LightChain1
  source 1..657: mol_type = other RNA
gacatcgtgatgacccaggccgccttcagcaaccccgtcaccctgggcacgtccgcgagcatctcctgccgcagctccaagagcctcctgcactccaacgggatcacctacctgtactggtacctccagaagccgggccagagcccccagctgctgatctaccagatgtccaacctcgccagcggggtgcccgaccggttctccagctccggcagcgggaccgacttcaccctgcgcatctcccgggtggaggccgaggacgtcggcgtgtactactgcgcccagaacctggagctcccctacacgttcggcgggggcaccaagctggagatcaagcgcaccgtggccgcgccgagcgtcttcatcttcccgccctccgacgagcagctcaagagcgggaccgcctccgtggtgtgcctgctgaacaacttctacccccgggaggccaaggtccagtggaaggtggacaacgccctgcagagcggcaacagccaggagtccgtgacggagcaggacagcaaggactccacctacagcctctccagcaccctgaccctgtccaaggcggactacgagaagcacaaggtctacgcctgcgaggtgacgcaccaggggctcagctcccccgtgaccaagagcttcaaccgcggcgagtgc

SEQ ID NO: 8215 - RNA, 1347 nt, synthetic construct
  misc_feature 1..1347: note = derived and/or modified sequence opt1 from Mogamulizumab_HeavyChain1
  source 1..1347: mol_type = other RNA
gaggtgcagctggtcgagagcggcggggacctcgtgcagcccggccgctccctgcggctgagctgcgccgcctccgggttcatcttcagcaactacggcatgtcctgggtgcgccaggcgccggggaagggcctcgagtgggtcgccaccatcagctccgccagcacctactcctactaccccgacagcgtgaagggccggttcacgatctcccgcgacaacgccaagaacagcctgtacctgcagatgaactccctccgggtggaggacaccgccctgtactactgcgggcgccacagcgacggcaacttcgcgttcgggtactggggccaggggaccctggtcaccgtgtccagcgcctccacgaagggccccagcgtgttccccctcgccccgtccagcaagagcacctccggcgggaccgccgcgctgggctgcctggtcaaggactacttccccgagcccgtgaccgtgagctggaactccggggccctcacgagcggcgtccacaccttccccgccgtgctgcagtccagcggcctgtactccctcagctccgtggtcaccgtgccgagctccagcctggggacccagacgtacatctgcaacgtgaaccacaagccctccaacaccaaggtcgacaagaaggtggagcccaagagctgcgacaagacccacacgtgcccgccctgccccgcccccgagctgctcggcgggccctccgtgttcctgttcccgcccaagcccaaggacaccctgatgatcagccggacccccgaggtgacctgcgtcgtggtcgacgtgtcccacgaggacccggaggtcaagttcaactggtacgtggacggcgtggaggtccacaacgccaagaccaagccccgcgaggagcagtacaacagcacgtaccgggtggtgtccgtcctcaccgtgctgcaccaggactggctgaacgggaaggagtacaagtgcaaggtgagcaacaaggcgctccccgcccccatcgagaagaccatcagcaaggccaagggccagccgcgcgagccccaggtctacaccctgccgccctcccgggacgagctgacgaagaaccaggtgagcctgacctgcctcgtgaagggcttctacccctccgacatcgccgtcgagtgggagagcaacgggcagcccgagaacaactacaagaccacgcccccggtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtcccccggcaag

SEQ ID NO: 8216 - RNA, 657 nt, synthetic construct
  misc_feature 1..657: note = derived and/or modified sequence opt1 from Mogamulizumab_LightChain1
  source 1..657: mol_type = other RNA
gacgtgctgatgacgcagagccccctctccctgccggtcacccccggcgagcccgccagcatctcctgccgcagctcccggaacatcgtgcacatcaacggggacacgtacctggagtggtacctccagaagcccggccagagcccgcagctgctgatctacaaggtgtccaaccgcttcagcggggtccccgaccggttctccggcagcgggtccggcaccgacttcaccctcaagatcagccgcgtggaggccgaggacgtgggcgtctactactgcttccaggggtccctgctgccctggaccttcggccaggggacgaaggtggagatcaagcggaccgtggcggcccccagcgtcttcatcttcccgccctccgacgagcagctcaagagcggcaccgcctccgtggtgtgcctgctgaacaacttctacccccgcgaggccaaggtccagtggaaggtggacaacgccctccagagcgggaactcccaggagagcgtgaccgagcaggacagcaaggactccacgtacagcctgtccagcaccctgaccctctccaaggcggactacgagaagcacaaggtctacgcctgcgaggtgacccaccagggcctgagctcccccgtgaccaagagcttcaaccggggcgagtgc

SEQ ID NO: 8217 - RNA, 1356 nt, synthetic construct
  misc_feature 1..1356: note = derived and/or modified sequence opt1 from Monalizumab_HeavyChain1
  source 1..1356: mol_type = other RNA
caggtgcagctggtccagagcggcgccgaggtgaagaagcccggggcctccgtgaaggtcagctgcaaggcgtccggctacaccttcaccagctactggatgaactgggtgcgccaggcccccgggcagggcctcgagtggatggggcggatcgacccctacgactccgagacgcactacgcccagaagctgcagggccgcgtgaccatgaccaccgacacgagcacctccaccgcctacatggagctgcggagcctccgctccgacgacaccgccgtctactactgcgcgcggggcgggtacgacttcgacgtgggcacgctgtactggttcttcgacgtgtgggggcagggcaccaccgtcaccgtgagctccgccagcacgaaggggccctccgtgttccccctggccccgtgcagccgctccaccagcgagtccaccgccgcgctcggctgcctggtcaaggactacttccccgagcccgtgaccgtgagctggaactccggcgccctgacgagcggggtccacaccttccccgccgtgctccagagctccggcctgtacagcctgtccagcgtggtcaccgtgccgtccagctccctcgggaccaagacgtacacgtgcaacgtggaccacaagcccagcaacaccaaggtcgacaagcgggtggagtccaagtacggcccgccctgcccgccctgccccgcccccgagttcctgggcgggccgagcgtgttcctgttcccgcccaagcccaaggacaccctcatgatctcccgcacccccgaggtgacctgcgtcgtcgtggacgtgagccaggaggaccccgaggtccagttcaactggtacgtggacggcgtggaggtccacaacgccaagaccaagccccgggaggagcagttcaactccacctaccgcgtggtgagcgtcctgacggtgctgcaccaggactggctcaacgggaaggagtacaagtgcaaggtgtccaacaagggcctgcccagctccatcgagaagaccatcagcaaggcgaaggggcagccgcgggagccccaggtctacaccctgccgccctcccaggaggagatgaccaagaaccaggtgagcctcacgtgcctggtgaagggcttctaccccagcgacatcgccgtcgagtgggagtccaacggccagcccgagaacaactacaagaccaccccgcccgtgctggacagcgacgggtccttcttcctctacagccgcctgaccgtggacaagtcccggtggcaggagggcaacgtcttcagctgctccgtgatgcacgaggccctgcacaaccactacacgcagaagtccctcagcctgagcctggggaag

SEQ ID NO: 8218 - RNA, 642 nt, synthetic construct
  misc_feature 1..642: note = derived and/or modified sequence opt1 from Monalizumab_LightChain1
  source 1..642: mol_type = other RNA
gacatccagatgacccagagcccctccagcctgtccgccagcgtgggcgaccgcgtcaccatcacgtgccgggcctccgagaacatctacagctacctcgcgtggtaccagcagaagccggggaaggcccccaagctgctgatctacaacgccaagaccctcgccgagggcgtgccctcccgcttcagcgggtccggcagcgggaccgacttcaccctgacgatctccagcctgcagcccgaggacttcgccacctactactgccagcaccactacggcaccccgcggaccttcggcgggggcacgaaggtggagatcaagcgcaccgtcgcggccccctccgtgttcatcttcccgcccagcgacgagcagctcaagtccgggaccgccagcgtggtctgcctgctgaacaacttctacccccgggaggccaaggtgcagtggaaggtggacaacgcgctccagtccggcaacagccaggagtccgtcaccgagcaggacagcaaggacagcacgtactccctgagctccaccctgaccctcagcaaggccgactacgagaagcacaaggtgtacgcctgcgaggtgacccaccaggggctgtccagccccgtcacgaagtccttcaaccgcggcgagtgc

SEQ ID NO: 8219 - RNA, 1350 nt, synthetic construct
  misc_feature 1..1350: note = derived and/or modified sequence opt1 from Motavizumab_HeavyChain
  source 1..1350: mol_type = other RNA
caggtgaccctgcgcgagagcggccccgccctcgtcaagccgacccagacgctgaccctgacctgcaccttctccgggttcagcctctccacggccggcatgagcgtggggtggatccggcagccgcccggcaaggcgctggagtggctggccgacatctggtgggacgacaagaagcactacaacccctccctcaaggaccgcctgaccatcagcaaggacacctccaagaaccaggtggtcctgaaggtgaccaacatggaccccgccgacacggccacctactactgcgcccgggacatgatcttcaacttctacttcgacgtgtgggggcagggcaccaccgtcacggtgagctccgcgagcaccaagggcccctccgtgttccccctcgcccccagctccaagagcacctccgggggcaccgccgccctggggtgcctggtcaaggactacttcccggagcccgtgacggtgagctggaactccggcgcgctcaccagcggggtccacaccttccccgccgtgctgcagtccagcggcctgtacagcctctccagcgtggtcaccgtgccctccagctccctgggcacgcagacctacatctgcaacgtgaaccacaagccgagcaacaccaaggtcgacaagcgcgtggagcccaagtcctgcgacaagacccacacgtgcccgccctgccccgcccccgagctgctcgggggccccagcgtgttcctgttcccgcccaagcccaaggacaccctgatgatctcccggacccccgaggtgacctgcgtcgtggtcgacgtgagccacgaggaccccgaggtcaagttcaactggtacgtggacggggtggaggtccacaacgccaagacgaagccgcgcgaggagcagtacaactccacctaccgggtggtgagcgtcctcaccgtgctgcaccaggactggctgaacggcaaggagtacaagtgcaaggtgtccaacaaggccctccccgcgcccatcgagaagaccatcagcaaggccaagggccagccccgcgagccgcaggtctacacgctgccgccctcccgggaggagatgaccaagaaccaggtgagcctgacctgcctcgtgaaggggttctacccctccgacatcgccgtcgagtgggagagcaacggccagcccgagaacaactacaagaccacgccgcccgtgctggactccgacgggagcttcttcctgtacagcaagctcaccgtggacaagtcccgctggcagcagggcaacgtcttcagctgctccgtgatgcacgaggccctgcacaaccactacacccagaagtccctgagcctcagccccgggaag

SEQ ID NO: 8220 - RNA, 1350 nt, synthetic construct; identical to SEQ ID NO: 8219
  misc_feature 1..1350: note = derived and/or modified sequence opt1 from Motavizumab_HeavyChain_variant
  source 1..1350: mol_type = other RNA

SEQ ID NO: 8221 - RNA, 639 nt, synthetic construct
  misc_feature 1..639: note = derived and/or modified sequence opt1 from Motavizumab_LightChain
  source 1..639: mol_type = other RNA
gacatccagatgacccagagcccctccaccctgagcgcctccgtgggcgaccgggtcacgatcacgtgcagcgcctccagccgggtggggtacatgcactggtaccagcagaagccgggcaaggcgcccaagctcctgatctacgacacctccaagctggccagcggggtgccctcccgcttcagcggctccgggagcggcaccgagttcacgctcaccatctccagcctgcagcccgacgacttcgccacctactactgcttccagggctccgggtacccgttcaccttcggcgggggcacgaaggtcgagatcaagcggaccgtggccgcccccagcgtgttcatcttcccgccctccgacgagcagctcaagagcgggaccgcgtccgtcgtgtgcctgctgaacaacttctacccccgcgaggccaaggtgcagtggaaggtcgacaacgccctgcagagcggcaacagccaggagtccgtgaccgagcaggacagcaaggactccacgtacagcctctccagcaccctgaccctgtccaaggccgactacgagaagcacaaggtgtacgcgtgcgaggtcacccaccagggcctcagctcccccgtgaccaagagcttcaaccgcggggagtgc

SEQ ID NO: 8222 - RNA, 639 nt, synthetic construct; identical to SEQ ID NO: 8221
  misc_feature 1..639: note = derived and/or modified sequence opt1 from Motavizumab_LightChain_variant
  source 1..639: mol_type = other RNA

SEQ ID NO: 8223 - RNA, 1428 nt, synthetic construct
  misc_feature 1..1428: note = derived and/or modified sequence opt1 from Moxetumomab_pasudotox_HeavyChain1
  source 1..1428: mol_type = other RNA
atggaggtgcagctggtcgagagcggcgggggcctcgtgaagcccgggggctccctgaagctgagctgcgccgcctccgggttcgcgttcagcatctacgacatgtcctgggtgcgccagacccccgagaagtgcctcgagtgggtcgcctacatcagctccggcggcgggaccacgtactaccccgacaccgtgaagggccggttcaccatcagccgcgacaacgccaagaacaccctgtacctgcagatgtccagcctcaagtccgaggacacggccatgtactactgcgcccggcacagcgggtacggcacccactggggcgtgctgttcgcgtactgggggcagggcaccctggtcaccgtgtccgccaaggccagcgggggccccgagggcgggtccctcgccgcgctgacggcccaccaggcctgccacctccccctggagaccttcacccgccaccggcagccgcgcggctgggagcagctggagcagtgcgggtaccccgtgcagcggctggtcgccctctacctggccgcgcgcctgagctggaaccaggtggaccaggtgatccggaacgccctcgcctcccccggcagcgggggcgacctgggggaggccatccgcgagcagcccgagcaggcccggctggcgctcaccctggccgccgccgagtccgagcgcttcgtccggcagggcacgggcaacgacgaggccggggcggccaacggcccggccgacagcggggacgccctgctcgagcgcaactaccccaccggcgccgagttcctgggggacggcggcgacgtgagcttctccacccgggggacccagaactggacggtggagcgcctgctccaggcgcaccggcagctggaggagcgcggctacgtcttcgtggggtaccacggcaccttcctggaggccgcccagagcatcgtgttcgggggcgtccgggcccgctcccaggacctcgacgcgatctggcggggcttctacatcgccggggaccccgccctggcctacggctacgcccaggaccaggagcccgacgcgcgcgggcgcatccggaacggcgccctgctccgcgtgtacgtgccgcggagctccctgcccggcttctaccgcaccagcctgaccctcgccgcccccgaggccgcgggggaggtcgagcggctgatcggccaccccctgccgctccgcctggacgccatcacggggcccgaggaggagggcgggcggctggagaccatcctcggctggcccctggccgagcgcaccgtggtgatcccctccgccatcccgaccgacccccggaacgtcggcggggacctggaccccagctccatccccgacaaggagcaggccatcagcgcgctcccggactacgcctcccagcccggcaagccgccccgcgaggacctgaag

SEQ ID NO: 8224 - RNA, 324 nt, synthetic construct
  misc_feature 1..324: note = derived and/or modified sequence opt1 from Moxetumomab_pasudotox_LightChain1
  source 1..324: mol_type = other RNA
atggacatccagatgacccagaccacgagctccctgagcgcctccctcggcgaccgcgtgaccatcagctgccgggcctcccaggacatcagcaactacctgaactggtaccagcagaagcccgacgggaccgtcaagctgctcatctactacacctccatcctgcacagcggcgtgccgtcccgcttcagcgggtccggcagcgggacggactactccctgaccatcagcaacctcgagcaggaggacttcgcgacctacttctgccagcagggcaacaccctgccctggacgttcggctgcgggaccaagctggagatcaag

SEQ ID NO: 8225 - RNA, 1350 nt, synthetic construct
  misc_feature 1..1350: note = derived and/or modified sequence opt1 from Muromonab-CD3_HeavyChain
  source 1..1350: mol_type = other RNA
caggtgcagctgcagcagagcggcgccgagctcgcccgccccggggcgtccgtcaagatgagctgcaaggcctccggctacaccttcacccggtacacgatgcactgggtgaagcagcgcccggggcagggcctggagtggatcgggtacatcaaccccagccggggctacaccaactacaaccagaagttcaaggacaaggccaccctgaccacggacaagtccagctccaccgcctacatgcagctcagctccctgaccagcgaggactccgccgtgtactactgcgcgcgctactacgacgaccactactgcctggactactggggccaggggaccacgctcaccgtcagctccgccaagaccaccgcccccagcgtgtaccccctggccccggtgtgcggcgggacgaccggctccagcgtcaccctggggtgcctcgtgaagggctacttccccgagcccgtgaccctgacgtggaactccggcagcctgtccagcggggtccacaccttccccgcggtgctccagagcgacctgtacaccctgtccagctccgtgaccgtcacgagctccacctggccgagccagtccatcacgtgcaacgtggcccaccccgccagctccaccaaggtggacaagaagatcgagccccggcccaagagctgcgacaagacccacacgtgcccgccctgccccgcccccgagctcctgggcgggccgtccgtcttcctgttcccgcccaagcccaaggacaccctcatgatcagccgcacccccgaggtgacctgcgtggtcgtggacgtgtcccacgaggaccccgaggtcaagttcaactggtacgtggacggcgtggaggtccacaacgccaagaccaagccccgggaggagcagtacaacagcacctaccgcgtggtctccgtgctgaccgtgctgcaccaggactggctcaacggcaaggagtacaagtgcaaggtcagcaacaaggcgctgcccgccccgatcgagaagacgatctccaaggccaaggggcagccccgggagccccaggtgtacaccctgcccccgagccgcgacgagctcaccaagaaccaggtgtccctgacctgcctggtcaagggcttctaccccagcgacatcgccgtggagtgggagagcaacgggcagcccgagaacaactacaagacgaccccgcccgtgctcgactccgacggcagcttcttcctgtactccaagctgaccgtcgacaagagccggtggcagcaggggaacgtgttctcctgcagcgtgatgcacgaggccctccacaaccactacacccagaagtccctgagcctgtcccccggcaag

SEQ ID NO: 8226 - RNA, 639 nt, synthetic construct
  misc_feature 1..639: note = derived and/or modified sequence opt1 from Muromonab-CD3_LightChain
  source 1..639: mol_type = other RNA
cagatcgtgctgacccagagccccgccatcatgtccgccagcccgggcgagaaggtgaccatgacgtgctccgcgagctccagcgtgtcctacatgaactggtaccagcagaagtccgggaccagccccaagcgctggatctacgacaccagcaagctcgcctccggcgtgcccgcccacttccgggggagcggctccgggaccagctactccctgacgatcagcggcatggaggccgaggacgccgcgacctactactgccagcagtggtccagcaaccccttcaccttcggctccgggaccaagctggagatcaaccgcgccgacacggccccgaccgtcagcatcttcccgcccagctccgagcagctcaccagcggcggggcctccgtggtgtgcttcctgaacaacttctaccccaaggacatcaacgtcaagtggaagatcgacggcagcgagcggcagaacggggtgctgaactcctggaccgaccaggacagcaaggactccacgtacagcatgtccagcaccctcaccctgaccaaggacgagtacgagcgccacaactcctacacgtgcgaggcgacccacaagaccagcacctcccccatcgtcaagagcttcaaccggaacgagtgc

SEQ ID NO: 8227 - RNA, 1347 nt, synthetic construct
  misc_feature 1..1347: note = derived and/or modified sequence opt1 from Namilumab_HeavyChain1
  source 1..1347: mol_type = other RNA
caggtgcagctggtccagagcggcgccgaggtgaagaagcccggggcctccgtgaaggtcagctgcaaggcgttcggctacccgttcaccgactacctcctgcactgggtgcgccaggcccccgggcagggcctggagtgggtggggtggctcaacccctactccggcgacaccaactacgcccagaagttccagggccgggtcacgatgacccgcgacaccagcatctccaccgcctacatggagctgagccggctgcgctccgacgacacggccgtgtactactgcacccggaccaccctcatcagcgtgtacttcgactactgggggcagggcacgatggtcaccgtgtccagcgcgtccaccaaggggcccagcgtgttcccgctggccccctccagcaagtccaccagcggcgggacggccgccctgggctgcctcgtcaaggactacttccccgagcccgtgaccgtgtcctggaacagcggcgcgctgacctccggggtccacaccttcccggccgtgctgcagagcagcggcctctactccctgagctccgtggtcacggtgcccagctccagcctggggacccagacctacatctgcaacgtgaaccacaagccctccaacaccaaggtcgacaagaaggtggagcccaagagctgcgacaagacgcacacgtgcccgccctgccccgcccccgagctcctgggcggcccgtccgtgttcctgttcccgcccaagcccaaggacaccctcatgatcagccgcacccccgaggtgacctgcgtcgtcgtggacgtgtcccacgaggaccccgaggtcaagttcaactggtacgtggacggggtggaggtccacaacgccaagaccaagccccgggaggagcagtacaacagcacctaccgcgtggtgtccgtcctgaccgtgctgcaccaggactggctcaacggcaaggagtacaagtgcaaggtgagcaacaaggccctgcccgcgccgatcgagaagacgatctccaaggccaaggggcagccccgggagccccaggtctacaccctgcccccgagccgcgacgagctcaccaagaaccaggtgtccctgacctgcctggtgaagggcttctaccccagcgacatcgccgtcgagtgggagtccaacgggcagcccgagaacaactacaagacgaccccgcccgtgctcgacagcgacggcagcttcttcctgtactccaagctgaccgtggacaagagccggtggcagcagggcaacgtcttctcctgcagcgtgatgcacgaggccctccacaaccactacacccagaagtccctgagcctgtcccccgggaag

SEQ ID NO: 8228 - RNA, 642 nt, synthetic construct
  misc_feature 1..642: note = derived and/or modified sequence opt1 from Namilumab_LightChain1
  source 1..642: mol_type = other RNA
gacatccagatgacccagagcccctccagcgtgtccgccagcgtcggcgaccgcgtgaccatcgcctgccgggcgtcccagaacatccgcaacatcctgaactggtaccagcagcggccggggaaggcgccccagctcctgatctacgccgccagcaacctgcagtccggcgtgcccagccgcttctccgggagcggctccgggacggacttcaccctcaccatcaacagcctgcagcccgaggacttcgccacctactactgccagcagtcctacagcatgccgcggacgttcggcggcgggaccaagctggagatcaagcgcaccgtcgccgccccctccgtgttcatcttcccgcccagcgacgagcagctcaagtccggcaccgccagcgtggtctgcctgctgaacaacttctacccccgggaggccaaggtgcagtggaaggtggacaacgcgctccagtccgggaacagccaggagagcgtcacggagcaggactccaaggacagcacctactccctgagctccaccctgaccctcagcaaggccgactacgagaagcacaaggtgtacgcctgcgaggtgacgcaccagggcctgtccagccccgtcaccaagtccttcaaccgcggggagtgc

SEQ ID NO: 8229 - RNA, 1374 nt, synthetic construct
  misc_feature 1..1374: note = derived and/or modified sequence opt1 from Naptumomab_estafenatox_HeavyChain
  source 1..1374: mol_type = other RNA
gaggtgcagctgcagcagagcggccccgacctcgtcaagccgggggcctccgtgaagatcagctgcaaggcctccggctacagcttcaccgggtactacatgcactgggtgaagcagtcccccggcaaggggctggagtggatcggccgcatcaaccccaacaacggcgtcaccctgtacaaccagaagttcaaggacaaggcgacgctcaccgtggacaagagctccaccaccgcctacatggagctgcggagcctgacgtccgaggacagcgccgtgtactactgcgcccgctccaccatgatcaccaactacgtcatggactactgggggcagggcaccagcgtgacggtgtccagcgccaagaccacgcccccgtccgtctaccccctcgcgcccgggagcgccgcccagaccaactccatggtgaccctgggctgcctggtgaaggggtacttccccgagccggtcaccgtgacctggaacagcggctccctcagcagcggcgtgcacaccttccccgccgtcctgcagtccgacctgtacacgctcagctccagcgtgaccgtgccctccagcacctggccctccgagaccgtcacgtgcaacgtggcgcacccggccagctccaccaaggtggacaagaagatcgtcccccgggacagcgggggcccctccgagaagtccgaggagatcaacgagaaggacctgcgcaagaagtccgagctgcaggggaccgccctcggcaacctgaagcagatctactactacaacagcaaggccatcaccagcagcgagaagtccgccgaccagttcctgacgaacaccctcctgttcaagggcttcttcaccgggcacccctggtacaacgacctgctcgtggacctgggcagcaccgcggccacgtccgagtacgaggggagcagcgtggacctgtacggcgcctactacgggtaccagtgcgccggcggcaccccgaacaagaccgcctgcatgtacgggggcgtcaccctccacgacaacaaccggctgacggaggagaagaaggtgcccatcaacctgtggatcgacgggaagcagaccaccgtccccatcgacaaggtgaagacctccaagaaggaggtgacggtccaggagctcgacctgcaggcgcgccactacctgcacggcaagttcgggctctacaacagcgactccttcggcggcaaggtgcagcgggggctgatcgtgttccacagctccgagggcagcaccgtctcctacgacctgttcgacgcccaggggcagtaccccgacaccctcctgcgcatctaccgggacaacaccaccatcagctccacgagcctgtccatcagcctctacctgtacaccacc

SEQ ID NO: 8230 - RNA, 642 nt, synthetic construct
  misc_feature 1..642: note = derived and/or modified sequence opt1 from Naptumomab_estafenatox_LightChain
  source 1..642: mol_type = other RNA
agcatcgtgatgacccagacccccacgtccctgctcgtcagcgccggcgaccgcgtgaccatcacgtgcaaggcctcccagagcgtgtccaacgacgtcgcgtggtaccagcagaagccggggcagagccccaagctgctgatctcctacaccagctcccggtacgccggcgtgcccgaccgcttcagcgggtccggctacgggaccgacttcaccctcaccatcagctccgtgcaggccgaggacgccgccgtctacttctgccagcaggactacaacagcccgcccaccttcggcggcgggacgaagctggagatcaagcgggcggacgccgcccccaccgtgtccatcttcccgcccagctccgagcagctgaccagcggcggggcctccgtggtctgcttcctcaacaacttctaccccaaggacatcaacgtgaagtggaagatcgacggcagcgagcgccagaacggggtgctgaacagctggaccgaccaggactccaaggacagcacgtactccatgagctccaccctgaccctcaccaaggacgagtacgagcggcacaacagctacacgtgcgaggcgacccacaagacctccaccagccccatcgtcaagtccttcaaccgcaacgagagc

SEQ ID NO: 8231 - RNA, 1356 nt, synthetic construct
  misc_feature 1..1356: note = derived and/or modified sequence opt1 from Narnatumab_HeavyChain1
  source 1..1356: mol_type = other RNA
gaggtgcagctggtcgagagcggcgggggcctcgtgcagcccgggggctccctgcgcctgagctgcgccgcctccgggttcaccttcagctcctacctcatgacctgggtgcggcaggcgccgggcaagggcctggagtgggtcgccaacatcaagcaggacgggagcgagaagtactacgtggactccgtgaagggccgcttcacgatcagccgggacaacgccaagaactccctgaacctccagatgaacagcctgcgcgccgaggacaccgccgtctactactgcacccgggacgggtactccagcggccgccactacgggatggacgtgtggggccagggcaccacggtgatcgtctccagcgcgtccaccaaggggcccagcgtgttccccctggccccctccagcaagtccaccagcggcgggaccgccgccctcggctgcctggtgaaggactacttcccggagcccgtcacggtgagctggaactccggcgcgctgaccagcggggtgcacaccttccccgccgtcctccagtccagcggcctgtactccctgagctccgtggtgaccgtccccagctccagcctcgggacgcagacctacatctgcaacgtgaaccacaagccgtccaacaccaaggtggacaagcgggtcgagcccaagagctgcgacaagacccacacgtgcccgccctgcccggcccccgagctgctgggcgggccctccgtgttcctcttcccgcccaagcccaaggacaccctgatgatcagccgcacccccgaggtgacctgcgtcgtggtcgacgtgtcccacgaggaccccgaggtgaagttcaactggtacgtcgacggcgtggaggtgcacaacgccaagacgaagccgcgggaggagcagtacaacagcacctaccgcgtcgtgtccgtgctgaccgtcctccaccaggactggctgaacggcaaggagtacaagtgcaaggtgagcaacaaggccctgcccgcgcccatcgagaagaccatctccaaggccaaggggcagccccgggagccccaggtgtacacgctcccgcccagccgcgaggagatgaccaagaaccaggtcagcctgacctgcctggtgaagggcttctacccctccgacatcgccgtggagtgggagagcaacgggcagcccgagaacaactacaagaccacgccgcccgtcctcgactccgacggcagcttcttcctgtactccaagctgaccgtggacaagagccggtggcagcaggggaacgtgttctcctgcagcgtcatgcacgaggccctccacaaccactacacccagaagtccctgagcctgtcccccggcaag

SEQ ID NO: 8232 - RNA, 642 nt, synthetic construct
  misc_feature 1..642: note = derived and/or modified sequence opt1 from Narnatumab_LightChain1
  source 1..642: mol_type = other RNA
gagatcgtgctgacccagagccccgccaccctctccctgagcccgggcgagcgcgccacgctgtcctgccgggcgagccagtccgtcagccgctacctcgcctggtaccagcagaagcccgggcaggcgccccggctgctgatctacgacgcctccaaccgcgccaccggcatccccgcccggttcagcgggtccggcagcgggaccgacttcaccctcacgatctccagcctggagccggaggacttcgccgtgtactactgccagcagcgctccaactggccccggaccttcggccagggcaccaaggtggagatcaagcgcaccgtcgccgcccccagcgtgttcatcttcccgccctccgacgagcagctcaagagcgggacggcgtccgtggtctgcctgctgaacaacttctacccccgggaggccaaggtgcagtggaaggtggacaacgccctgcagagcggcaactcccaggagagcgtcaccgagcaggacagcaaggactccacctacagcctctccagcaccctgacgctgtccaaggccgactacgagaagcacaaggtgtacgcctgcgaggtgacccaccaggggctcagctcccccgtcaccaagagcttcaaccgcggcgagtgc

SEQ ID NO: 8233 - RNA, 1350 nt, synthetic construct
  misc_feature 1..1350: note = derived and/or modified sequence opt1 from Natalizumab_HeavyChain1
  source 1..1350: mol_type = other RNA
caggtgcagctggtccagagcggcgccgaggtgaagaagcccggggcctccgtgaaggtcagctgcaaggcgtccggcttcaacatcaaggacacctacatccactgggtgcgccaggccccggggcagcggctcgagtggatgggccgcatcgaccccgccaacgggtacaccaagtacgaccccaagttccagggccgggtgaccatcaccgccgacaccagcgcctccaccgcgtacatggagctgagctccctgcgcagcgaggacacggccgtctactactgcgcccgggagggctactacgggaactacggcgtgtacgccatggactactgggggcagggcaccctcgtgaccgtctccagcgcgtccaccaaggggcccagcgtgttcccgctggccccctgctcccgcagcacgtccgagagcaccgccgccctgggctgcctcgtgaaggactacttccccgagcccgtcaccgtgtcctggaacagcggcgccctgacctccggggtgcacacgttcccggcggtcctgcagagcagcggcctctactccctgagctccgtggtgaccgtccccagctccagcctggggaccaagacctacacgtgcaacgtggaccacaagccctccaacaccaaggtggacaagcgggtcgagagcaagtacgggcccccgtgcccctcctgccccgcccccgagttcctcggcggcccgagcgtgttcctgttcccgcccaagcccaaggacaccctgatgatctcccgcacccccgaggtgacgtgcgtcgtggtcgacgtgagccaggaggaccccgaggtgcagttcaactggtacgtcgacggcgtggaggtgcacaacgccaagaccaagccccgggaggagcagttcaactccacctaccgcgtcgtgagcgtgctcaccgtcctgcaccaggactggctgaacgggaaggagtacaagtgcaaggtgtccaacaagggcctccccagctccatcgagaagacgatcagcaaggccaaggggcagccgcgggagccccaggtgtacaccctgccgccctcccaggaggagatgaccaagaaccaggtcagcctgacctgcctcgtgaagggcttctaccccagcgacatcgccgtggagtgggagtccaacggccagcccgagaacaactacaagacgacgcccccggtcctggacagcgacgggtccttcttcctgtacagccgcctcaccgtggacaagtcccggtggcaggagggcaacgtgttcagctgctccgtcatgcacgaggcgctgcacaaccactacacccagaagtccctgagcctcagcctggggaag

SEQ ID NO: 8234 - RNA, 639 nt, synthetic construct
  misc_feature 1..639: note = derived and/or modified sequence opt1 from Natalizumab_LightChain1
  source 1..639: mol_type = other RNA
gacatccagatgacccagagcccctccagcctgtccgccagcgtgggcgaccgcgtcaccatcacgtgcaagacctcccaggacatcaacaagtacatggcctggtaccagcagaccccggggaaggcgccccggctcctgatccactacaccagcgccctgcagcccggcatcccctcccgcttcagcgggtccggcagcgggcgggactacacgttcaccatctccagcctccagccggaggacatcgccacctactactgcctgcagtacgacaacctgtggaccttcggccagggcacgaaggtggagatcaagcgcaccgtggccgccccctccgtcttcatcttcccgcccagcgacgagcagctcaagtccgggaccgcgagcgtggtgtgcctgctgaacaacttctacccccgggaggccaaggtccagtggaaggtggacaacgccctccagtccggcaacagccaggagtccgtgaccgagcaggacagcaaggacagcacgtactccctgagctccaccctgaccctcagcaaggccgactacgagaagcacaaggtctacgcgtgcgaggtgacccaccaggggctgtccagccccgtgacgaagtccttcaaccgcggcgagtgc

SEQ ID NO: 8235 - RNA, 1335 nt, synthetic construct
  misc_feature 1..1335: note = derived and/or modified sequence opt1 from Navicixizumab_HeavyChain1
  source 1..1335: mol_type = other RNA
caggtgcagctggtccagagcggcgccgaggtgaagaagcccggggcctccgtgaagatcagctgcaaggcgtccggctacagcttcaccgcctactacatccactgggtcaagcaggccccggggcagggcctcgagtggatcgggtacatctccaactacaaccgcgccaccaactacaaccagaagttcaagggccgggtgacgttcaccaccgacaccagcacgtccaccgcctacatggagctgcgcagcctgcggtccgacgacaccgcggtgtactactgcgcccgcgactacgactacgacgtcggcatggactactgggggcagggcaccctcgtgacggtgagctccgccagcaccaaggggccctccgtcttccccctggccccctgcagccggtccaccagcgagtccaccgcggccctgggctgcctcgtgaaggactacttcccggagcccgtgacggtcagctggaactccggggccctgaccagcggcgtgcacaccttccccgccgtgctgcagagctccggcctctacagcctgtccagcgtcgtgaccgtgccctccagcaacttcgggacgcagacctacacgtgcaacgtcgaccacaagccgtccaacaccaaggtggacaagaccgtggagcgcaagtgctgcgtcgagtgcccgccctgccccgccccgcccgtggcgggccccagcgtgttcctgttcccgcccaagcccaaggacaccctcatgatctcccggacccccgaggtgacctgcgtcgtcgtggacgtgagccacgaggaccccgaggtccagttcaactggtacgtggacggggtggaggtccacaacgccaagacgaagccgcgcgaggagcagttcaactccaccttccgggtggtgagcgtcctgaccgtggtgcaccaggactggctgaacggcaaggagtacaagtgcaaggtctccaacaagggcctccccgcccccatcgagaagaccatcagcaagacgaaggggcagccccgcgagccccaggtgtacaccctgccgccctcccgggaggagatgaccaagaaccaggtgagcctgacctgcctcgtcgagggcttctacccctccgacatcgccgtggagtgggagagcaacgggcagcccgagaacaactacaagacgaccccgcccatgctggactccgacggcagcttcttcctgtacagcgagctcaccgtggacaagtcccgctggcagcaggggaacgtcttcagctgctccgtgatgcacgaggccctgcacaaccactacacccagaagtccctgagcctcagccccggcaag

SEQ ID NO: 8236 - RNA, 1341 nt, synthetic construct
  misc_feature 1..1341: note = derived and/or modified sequence opt1 from Navicixizumab_HeavyChain2
  source 1..1341: mol_type = other RNA
caggtgcagctggtccagagcggcgccgaggtgaagaagcccggggcctccgtgaaggtcagctgcaaggcgtccggctacaccttcaccaactactggatgcactgggtgcgccaggccccggggcagggcctcgagtggatgggggacatcaaccccagcaacggccggacgtcctacaaggagaagttcaagcgccgggtgaccctgagcgtcgacaagtccagctccaccgcctacatggagctgagctccctccgcagcgaggacaccgccgtgtacttctgcacgatccactacgacgacaagtactaccccctgatggactactggggccaggggaccctggtgaccgtctccagcgcctccaccaagggccccagcgtgttcccgctcgcgccctgctcccggagcacgtccgagagcaccgccgccctggggtgcctggtgaaggactacttccccgagcccgtcaccgtgagctggaactccggcgccctcaccagcggggtgcacacgttcccggcggtcctgcagtccagcggcctgtactccctcagctccgtggtgaccgtccccagctccaacttcggcacccagacctacacgtgcaacgtggaccacaagcccagcaacaccaaggtggacaagaccgtcgagcgcaagtgctgcgtggagtgcccgccctgccccgccccgcccgtggccgggccctccgtcttcctgttcccgcccaagcccaaggacaccctgatgatcagccggacgcccgaggtgacctgcgtcgtggtggacgtctcccacgaggaccccgaggtgcagttcaactggtacgtggacggcgtcgaggtgcacaacgccaagaccaagccccgcgaggagcagttcaacagcaccttccgggtggtctccgtgctcacggtggtccaccaggactggctgaacgggaaggagtacaagtgcaaggtgagcaacaagggcctgcccgccccgatcgagaagaccatctccaagaccaagggccagccccgcgagccccaggtgtacaccctcccgcccagccgggagaagatgacgaagaaccaggtctccctgacctgcctggtgaaggggttctaccccagcgacatcgcggtggagtgggagagcaacggccagcccgagaacaactacaagaccaccccgcccatgctcaagtccgacgggagcttcttcctgtactccaagctgacggtcgacaagagccgctggcagcagggcaacgtgttctcctgcagcgtgatgcacgaggccctccacaaccactacacccagaagtccctgagcctgtcccccgggaag

SEQ ID NO: 8237 - RNA, 654 nt, synthetic construct; identical to SEQ ID NO: 7841
  misc_feature 1..654: note = derived and/or modified sequence opt1 from Navicixizumab_LightChain1
  source 1..654: mol_type = other RNA

SEQ ID NO: 8238 - RNA, 1368 nt, synthetic construct
  misc_feature 1..1368: note = derived and/or modified sequence opt1 from Navivumab_HeavyChain1
  source 1..1368: mol_type = other RNA
caggtgcagctggtccagagcggcgccgaggtgaagaagcccggggcctccgtgaaggtcagctgcaagacctccggctacagcttctccacctacggggtgagctgggtgcgccaggcgccgggccaggggcccgagtgggtcggctggatctccgcctacacgggcatcaccgactacgcccagaagttccaggggcgggtgaccctcaccacggacgccaccaccgccaccgcgttcctggacctgcgcagcctccggcccgacgacacggccacctacttctgcgcccgcgacaaggtgcagggccgggtcgaggtggggtccggcgggcgccacgactactggggccagggcaccctggtgatcgtcagctccgccagcaccaaggggccctccgtgttcccgctggcgcccagctccaagagcacgtccggcgggaccgccgccctcggctgcctggtgaaggactacttccccgagcccgtcaccgtgagctggaactccggcgccctgaccagcggggtgcacacgttcccggccgtcctccagagctccggcctgtacagcctgtccagcgtggtgaccgtcccctccagctccctcgggacccagacctacatctgcaacgtgaaccacaagcccagcaacacgaaggtggacaagaaggtcgagcccaagtcctgcgacaagacccacacgtgcccgccctgccccgcgcccgagctgctgggcgggccgagcgtgttcctcttcccgcccaagcccaaggacaccctgatgatctcccggacccccgaggtgacctgcgtcgtggtcgacgtgagccacgaggaccccgaggtgaagttcaactggtacgtcgacggcgtggaggtgcacaacgccaagaccaagccccgcgaggagcagtacaactccacctaccgggtcgtgagcgtgctgacggtcctccaccaggactggctgaacggcaaggagtacaagtgcaaggtgtccaacaaggccctgcccgccccgatcgagaagaccatcagcaaggccaaggggcagccccgcgagccccaggtgtacaccctgcccccgtcccgggacgagctcaccaagaaccaggtcagcctgacgtgcctcgtgaagggcttctacccctccgacatcgcggtggagtgggagagcaacgggcagcccgagaacaactacaagaccaccccgcccgtcctggacagcgacggctccttcttcctgtacagcaagctcaccgtggacaagtcccgctggcagcaggggaacgtgttcagctgctccgtcatgcacgagggcctgcacaaccactacacgcagaagtccctgagcctcagccccggcaag

SEQ ID NO: 8239 - RNA, 645 nt, synthetic construct
  misc_feature 1..645: note = derived and/or modified sequence opt1 from Navivumab_LightChain1
  source 1..645: mol_type = other RNA
gaggtggtcctgacccagagccccggcaccctcgccctgccgcccggggagcgcgccacgctgtcctgccgggcgagccaccgcgtgggctccacctacatcgcctggtaccagcagaagtccgggcaggcgccccggcgcctcatctacggcgccagcaaccgggccaccgacatccccgaccgcttcagcgggtccggcagcggcaccgacttcacgctgaccatccggcgcctggagccggaggactccgccgtgtactactgccagcagttcagcgtctccccctggaccttcgggcagggcacccgggtggagatcaagcgcacggtggccgcccccagcgtcttcatcttcccgccctccgacgagcagctcaagagcgggaccgcctccgtggtgtgcctgctgaacaacttctacccccgggaggcgaaggtccagtggaaggtggacaacgccctccagagcggcaactcccaggagagcgtgaccgagcaggactccaaggacagcacctacagcctgtccagcacgctgaccctctccaaggccgactacgagaagcacaaggtctacgcctgcgaggtgacccaccaggggctgagctcccccgtgaccaagagcttcaaccgcggcgagtgc

SEQ ID NO: 8240 - RNA, 2172 nt, synthetic construct
  misc_feature 1..2172: note = derived and/or modified sequence opt1 from Ndimab-varB_HeavyChain
  source 1..2172: mol_type = other RNA
caggtgcagctggtcgagagcggcgggggcgtggtgcagcccgggcgctccctccggctgagctgcgccgcctccggcttcatcttcagctcctacgcgatgcactgggtccgccaggccccggggaacggcctggagtgggtggccttcatgagctacgacggctccaacaagaagtacgccgacagcgtgaaggggcggttcaccatctcccgcgacaacagcaagaacaccctctacctgcagatgaactccctgcgggccgaggacacggcggtctactactgcgcccgcgaccggggcatcagcgccgggggcaactactactactacgggatggacgtgtggggccagggcaccaccgtgaccgtctccagcgcctccacgaaggggcccagcgtgttccccctcgcgccctccagcaagtccaccagcggcgggaccgccgccctgggctgcctggtgaaggactacttcccggagcccgtcaccgtgagctggaactccggcgccctcacgagcggggtgcacaccttccccgccgtcctgcagtccagcggcctgtactccctcagctccgtggtgaccgtccccagctccagcctggggacccagacgtacatctgcaacgtgaaccacaagccgtccaacaccaaggtggacaagcgcgtcgagcccaagagctgcgacaagacccacacgtgcccgccctgcccggcgcccgagctgctcggcgggccctccgtgttcctgttcccgcccaagcccaaggacaccctgatgatcagccggacccccgaggtgacctgcgtcgtggtcgacgtgtcccacgaggaccccgaggtgaagttcaactggtacgtcgacggcgtggaggtgcacaacgccaagaccaagccgcgcgaggagcagtacaacagcacgtaccgggtcgtgtccgtgctcaccgtcctgcaccaggactggctgaacggcaaggagtacaagtgcaaggtgagcaacaaggccctccccgcccccatcgagaagaccatctccaaggccaaggggcagccccgcgagccccaggtgtacaccctgccgcccagccgggaggagatgacgaagaaccaggtcagcctgacctgcctcgtgaagggcttctacccctccgacatcgcggtggagtgggagagcaacgggcagcccgagaacaactacaagaccaccccgcccgtcctggactccgacggcagcttcttcctgtactccaagctcacggtggacaagagccgctggcagcaggggaacgtgttctcctgcagcgtcatgcacgaggccctgcacaaccactacacccagaagtccctgagcctctcccccggcaagggcgggggcgggagcggcgggggcggctcccaggtgcagctggtgcagagcggggccgaggtcaagaagcccggctccagcgtgaaggtgtcctgcaaggccagcgggggcaccttcagcacctacggcatctcctgggtccggcaggcccccgggcagtgcctggagtggatgggcgggatcatccccatcttcgacacgggcaacagcgcgcagtccttccaggggcgcgtgaccatcaccgccgacgagagcacctccacggcctacatggagctcagctccctgcggagcgaggacaccgccgtgtactactgcgcccgctccagccggatctacgacctgaacccgtccctcaccgcgtactacgacatggacgtctggggccagggcaccatggtgaccgtgagctccgggggcgggggcagcgggggcggcgggtccggcgggggcgggagcggcggcgggggctcccagagcgtcctgacgcagccgccctccgtgagcgccgcccccgggcagaaggtgaccatcagctgctccggcagctccagcaacatcgggaacaactacgtctcctggtaccagcagctgcccggcaccgcccccaagctcctgatctacgacaacaacaagcgccccagcggcatccccgaccggttctccgggagcaagtccggcaccagcgcgacgctggggatcaccggcctccagaccggcgacgaggccgactactactgcgggacctgggactccagcctgtccgcctgggtgttcggctgcgggacgaagctgaccgtgctc

SEQ ID NO: 8241 - RNA, 645 nt, synthetic construct
  misc_feature 1..645: note = derived and/or modified sequence opt1 from Ndimab-varB_LightChain
  source 1..645: mol_type = other RNA
gagatcgtgctgacccagagccccgccaccctctccctgagcccgggcgagcgcgccacgctgtcctgccgggcgagccagtccgtctacagctacctcgcctggtaccagcagaagcccgggcaggcgccccgcctgctgatctacgacgcctccaaccgggccatcggcatccccgcccgcttcagcgggtccggcagcgggaccgacttcaccctcaccatctccagcctggagccggaggacttcgccgtgtactactgccagcagcggtccaactggccgcccttcacgttcggccccggcaccaaggtggacatcaagcgcaccgtcgccgcccccagcgtgttcatcttcccgccctccgacgagcagctcaagagcgggaccgcgtccgtggtctgcctgctgaacaacttctacccccgggaggccaaggtgcagtggaaggtggacaacgccctgcagagcggcaactcccaggagagcgtcacggagcaggacagcaaggactccacctacagcctctccagcaccctgaccctgtccaaggccgactacgagaagcacaaggtgtacgcctgcgaggtgacgcaccaggggctcagctcccccgtcaccaagagcttcaaccgcggcgagtgc

SEQ ID NO: 8242 - RNA, 1353 nt, synthetic construct
  misc_feature 1..1353: note = derived and/or modified sequence opt1 from Necitumumab_HeavyChain1
  source 1..1353: mol_type = other RNA
caggtgcagctgcaggagagcggccccgggctcgtcaagccctcccagaccctgagcctgacctgcacggtgtccggcgggagcatctccagcggcgactactactggtcctggatccgccagccgcccgggaagggcctcgagtggatcggctacatctactacagcgggtccaccgactacaaccccagcctgaagtcccgggtgaccatgagcgtcgacacctccaagaaccagttcagcctgaaggtgaactccgtgacggccgccgacaccgcggtctactactgcgcccgcgtgagcatcttcggcgtggggaccttcgactactggggccaggggaccctcgtcacggtgtccagcgcctccaccaagggcccgagcgtgctgcccctggcccccagctccaagagcacctccggcgggaccgccgcgctcggctgcctggtcaaggactacttccccgagccggtgacggtgagctggaactccggggccctgaccagcggcgtccacaccttccccgccgtgctccagtccagcggcctgtactccctgagctccgtggtcaccgtgcccagctccagcctcgggacgcagacctacatctgcaacgtgaaccacaagccctccaacaccaaggtcgacaagcgggtggagcccaagagctgcgacaagacccacacgtgcccgccctgccccgcccccgagctgctgggcgggccctccgtgttcctcttcccgcccaagcccaaggacaccctgatgatcagccgcacccccgaggtgacctgcgtcgtcgtggacgtgtcccacgaggaccccgaggtcaagttcaactggtacgtggacggcgtggaggtccacaacgcgaagacgaagccccgggaggagcagtacaacagcacctaccgcgtggtgagcgtcctgaccgtgctccaccaggactggctgaacgggaaggagtacaagtgcaaggtgtccaacaaggccctgccggcccccatcgagaagaccatcagcaaggccaagggccagccccgggagccccaggtctacacgctcccgccctcccgcgaggagatgaccaagaaccaggtgagcctgacctgcctggtgaagggcttctacccctccgacatcgccgtcgagtgggagagcaacgggcagccggagaacaactacaagaccacgccgcccgtgctcgactccgacggcagcttcttcctgtactccaagctgaccgtggacaagagccggtggcagcaggggaacgtcttctcctgcagcgtgatgcacgaggcgctccacaaccactacacccagaagtccctgagcctgtcccccggcaag

SEQ ID NO: 8243 - RNA, 642 nt, synthetic construct
  misc_feature 1..642: note = derived and/or modified sequence opt1 from Necitumumab_LightChain1
  source 1..642: mol_type = other RNA
gagatcgtgatgacccagagccccgccaccctgtccctcagcccgggcgagcgcgccacgctgtcctgccgggcgagccagtccgtcagctcctacctggcctggtaccagcagaagcccgggcaggcgccccgcctcctgatctacgacgccagcaaccgggccaccggcatccccgcccgcttctccgggagcggctccgggaccgacttcaccctgacgatcagctccctcgagccggaggacttcgccgtgtactactgccaccagtacggcagcacgcccctgaccttcggcgggggcaccaaggccgagatcaagcggaccgtggccgcgccctccgtcttcatcttcccgcccagcgacgagcagctgaagtccgggaccgccagcgtggtgtgcctcctgaacaacttctacccccgcgaggccaaggtccagtggaaggtggacaacgccctgcagtccggcaacagccaggagagcgtgaccgagcaggactccaaggacagcacctactccctcagctccacgctgaccctgagcaaggccgactacgagaagcacaaggtctacgcgtgcgaggtgacccaccaggggctctccagccccgtgaccaagtccttcaaccggggcgagtgc

SEQ ID NO: 8244 - RNA, 396 nt, synthetic construct
  misc_feature 1..396: note = derived and/or modified sequence opt1 from Neliximab_HeavyChain_VH-Region
  source 1..396: mol_type = other RNA
gaggtgcagctgcagcagagcggccccgagctcgtcaagccgggggcctccgtgaagatgagctgcaaggcctccggctacaccttcaccacctacgtgatgcactgggtcaagcagaagcccgggcagggcctggagtggatcgggtacatcaacccctacaacgacggcaccaactacaacgagaagttcaagggcaaggcgaccctgaccagcgacaagtccagctccacggcctacatggagctcagcaccctgacctccgaggacagcgccgtgtactactgcgccgagttcatcaccaagacggtcgggggctccaactggtacctggacgtgtggggcgccgggaccaccgtgaccgtgagctccgcgaagacgacgcccccgaagctc

SEQ ID NO: 8245 - RNA, 372 nt, synthetic construct
  misc_feature 1..372: note = derived and/or modified sequence opt1 from Neliximab_HeavyChain_VH-Region_variant1
  source 1..372: mol_type = other RNA
caggtgcagctgaagcagagcggccccgagctcgtcaagccgggggcctccgtgaagatgagctgcaaggcctccggctacaccttcaccacgtacgtgatgcactgggtcaagcagaagcccgggcagggcctggagtggatcgggtacatcaacccctacaacgacggcaccaactacaacgagaagttcaagggcaaggcgaccctgaccagcgacaagtccagctccacggcctacatggagctcagcaccctgacctccgaggacagcgccgtgtactactgcgccgagttcatcaccaagacggtcgggggctccaactggtacctggacgtgtggggcgccgggaccaccgtgaccgtgagctcc

SEQ ID NO: 8246 - RNA, 318 nt, synthetic construct
  misc_feature 1..318: note = derived and/or modified sequence opt1 from Neliximab_LightChain_VL-Region
  source 1..318: mol_type = other RNA
gacatcgtgctgacccagagccccgccatcatgtccgccagcccgggcgagaaggtcaccatgacgtgctccgcgagctccagcatctcctacatccactggttccagcagaagcccgggaccagccccaagcgctggatctacgacacctccaagctccccagcggcgtgccggcccggttctccgggagcggctccgggaccagctactccctgacgatcagctccatggaggccgaggacgccgccacctactactgccaccagcgcagctcctacacctggaccttcggcggcgggacgaagctggagatcaag

SEQ ID NO: 8247 - RNA, 354 nt, synthetic construct
  misc_feature 1..354: note = derived and/or modified sequence opt1 from Neliximab_LightChain_VL-Region_variant1
  source 1..354: mol_type = other RNA
cagatcgtgctgacccagagccccgccatcatgtccgccagcccgggcgagaaggtcaccatgacgtgctccgcgagctccagcatctcctacatccactggttccagcagaagcccgggaccagccccaagcgctggatctacgacacctccaagctccccagcggcgtgccggcccggttctccgggagcggctccgggaccagctactccctgacgatcagctccatggaggccgaggacgccgccacctactactgccaccagcgcagctcctacacctggaccttcggcggcgggacgaagctggagatcaagcgggcggacgccgcccccaccgtgagcgccgcggcc

SEQ ID NO: 8248 - RNA, 1335 nt, synthetic construct
  misc_feature 1..1335: note = derived and/or modified sequence opt1 from Nemolizumab_HeavyChain1
  source 1..1335: mol_type = other RNA
caggtgcagctggtccagagcggcgccgaggtgaagaagcccggggcctccgtgaaggtcagctgcaaggcgtccggctacaccttcaccgggtacatcatgaactgggtgcgccaggcccccggccaggggctcgagtggatgggcctgatcaacccctacaacggcgggacggactacaacccccagttccaggaccgggtgaccatcaccgccgacaagagcacctccacggcctacatggagctgagctccctccgcagcgaggacaccgccgtctactactgcgcgcgggacggctacgacgacgggccctacaccctggagacctggggccaggggacgctggtgaccgtgtccagcgcctccaccaagggcccgagcgtcttccccctcgccccctccagcaagtccaccagcggcgggacggccgcgctgggctgcctggtgaaggactacttccccgagccggtgaccgtctcctggaacagcggggccctcacctccggcgtgcacaccttccccgccgtgctgcagagcagcggcctgtactccctcagctccgtcgtgacggtgcccagctccaacttcgggacccagacctacacgtgcaacgtcgaccacaagcccagcaacaccaaggtggacaagaccgtggagcgcaagtcctgcgtcgagtgcccgccctgccccgcgcccccggtggccggccccagcgtgttcctgttcccgcccaagcccaaggacaccctgatgatctcccggacccccgaggtcacgtgcgtggtcgtggacgtgagccaggaggaccccgaggtccagttcaactggtacgtggacggggtggaggtccacaacgccaagaccaagccccgcgaggagcagttcaactccaccttccgggtggtgagcgtcctcaccgtggtgcaccaggactggctgaacggcaaggagtacaagtgcaaggtctccaacaaggggctgccggcccccatcgagaagacgatcagcaagaccaagggccagccccgcgagccccaggtgtacaccctcccgccctcccaggaggagatgaccaagaaccaggtgagcctgacgtgcctggtcaagggcttctacccctccgacatcgccgtggagtgggagagcaacgggcagccggagaacaactacaagaccaccccgcccatgctcgactccgacggcagcttcttcctgtacagcaagctgaccgtggacaagtcccggtggcaggaggggaacgtcttcagctgctccgtgatgcacgaggccctccacaaccactacacgcagaagtccctgagcctgagcccc

SEQ ID NO: 8249 - RNA, 642 nt, synthetic construct
  misc_feature 1..642: note = derived and/or modified sequence opt1 from Nemolizumab_LightChain1
  source 1..642: mol_type = other RNA
gacatccagatgacccagagcccctccagcctgtccgccagcgtgggcgaccgcgtcaccatcacgtgccaggcctccgaggacatctacagcttcgtggcgtggtaccagcagaagccggggaaggcccccaagctcctgatctacaacgcccagaccgaggcccagggcgtgccctcccggttcagcgggtccggcagcgggaccgacttcaccctgacgatctccagcctccagcccgaggacttcgccacctactactgccagcaccactacgactccccgctgaccttcggcggcgggaccaaggtcgagatcaagcgcacggtggcggcccccagcgtgttcatcttcccgccctccgacgagcagctcaagagcggcaccgcctccgtcgtgtgcctgctgaacaacttctacccccgggaggccaaggtgcagtggaaggtcgacaacgcgctgcagagcgggaactcccaggagagcgtgaccgagcaggacagcaaggactccacctacagcctctccagcacgctgaccctgtccaaggccgactacgagaagcacaaggtgtacgcctgcgaggtcacccaccagggcctcagctcccccgtgaccaagagcttcaaccgcggggagtgc

SEQ ID NO: 8250 - RNA, 1356 nt, synthetic construct
  misc_feature 1..1356: note = derived and/or modified sequence opt1 from Nesvacumab_HeavyChain1
  source 1..1356: mol_type = other RNA
gaggtgcagctggtcgagagcggcgggggcctcgtgcagcccgggggctccctgcgcctgagctgcgccgcctccgggttcaccttcagctcctacgacatccactgggtgcggcaggcgaccggcaagggcctcgagtgggtcagcgccatcgggccggccggcgacacgtactaccccgggtccgtgaagggccgcttcaccatcagccgggagaacgccaagaactccctgtacctgcagatgaacagcctccgcgccggggacaccgcggtgtactactgcgcccggggcctgatcaccttcggcgggctgatcgcccccttcgactactggggccaggggacgctcgtcaccgtgtccagcgcctccaccaagggccccagcgtgttcccgctggcgccctccagcaagtccaccagcggcgggacggccgccctgggctgcctcgtcaaggactacttccccgagcccgtgaccgtgtcctggaacagcggggccctgaccagcggcgtccacaccttcccggccgtgctgcagtccagcgggctctactccctgagctccgtggtcacggtgcccagctccagcctgggcacccagacctacatctgcaacgtgaaccacaagccctccaacaccaaggtcgacaagaaggtggagcccaagagctgcgacaagacgcacacgtgcccgccctgccccgcgcccgagctcctgggcgggccgtccgtgttcctgttcccgcccaagcccaaggacaccctcatgatcagccgcacccccgaggtgacctgcgtcgtggtcgacgtgtcccacgaggaccccgaggtcaagttcaactggtacgtggacggcgtggaggtccacaacgccaagaccaagccccgggaggagcagtacaacagcacctaccgcgtggtgtccgtcctgaccgtgctgcaccaggactggctcaacgggaaggagtacaagtgcaaggtgagcaacaaggccctgcccgccccgatcgagaagacgatctccaaggccaagggccagccccgggagccccaggtctacaccctgcccccgagccgcgacgagctcaccaagaaccaggtgtccctgacctgcctggtgaaggggttctaccccagcgacatcgcggtcgagtgggagagcaacggccagcccgagaacaactacaagacgaccccgcccgtgctcgactccgacggcagcttcttcctgtactccaagctgaccgtggacaagagccggtggcagcaggggaacgtcttctcctgcagcgtgatgcacgaggccctccacaaccactacacccagaagtccctgagcctgtcccccggcaag

SEQ ID NO: 8251 - RNA, 642 nt, synthetic construct
  misc_feature 1..642: note = derived and/or modified sequence opt1 from Nesvacumab_LightChain1
  source 1..642: mol_type = other RNA
gagatcgtgctgacccagagccccggcaccctctccctgagcccgggggagcgcgccacgctgtcctgccgggccagccagtccgtcagctccacctacctcgcgtggtaccagcagaagcccggccaggcgccccgcctgctgatctacggggccagctcccgggccaccggcatccccgaccgcttcagcgggtccggcagcggcaccgacttcacgctcaccatctcccggctggagccggaggacttcgccgtgtactactgccagcactacgacaacagccagaccttcgggcagggcaccaaggtggagatcaagcgcacggtcgccgccccctccgtgttcatcttcccgcccagcgacgagcagctgaagtccgggaccgccagcgtggtctgcctcctgaacaacttctacccccgggaggccaaggtgcagtggaaggtggacaacgcgctgcagtccggcaacagccaggagagcgtcaccgagcaggactccaaggacagcacctactccctcagctccacgctgaccctgagcaaggccgactacgagaagcacaaggtgtacgcctgcgaggtgacccaccaggggctctccagccccgtcaccaagtccttcaaccgcggcgagtgc

SEQ ID NO: 8252 - RNA, 1362 nt, synthetic construct
  misc_feature 1..1362: note = derived and/or modified sequence opt1 from Neuradiab_HeavyChain1
  source 1..1362: mol_type = other RNA
gaggtgcagctgcagcagagcggccccgagctcgtcaagccgggggcctccgtgaagatgagctgcaaggcctccggctacaccttcaccagctacgtggtccactgggtgaagcagaaccccgggcagggcctggagtggatcgggtacatcaaccccttcaacgacggcacgaagtacaacgagaacttcaagtgcaaggcgaccctgacctccgaccgcagctccagcaccgcctacatggagctctccagcctgacgtccgaggagagcgccgtgtacttctgcgcccgggacatgggccgcgaggggttcgcctactggggccaggggaccctggtcaccgtgtccgcggccaagaccacgcccccgagcgtgtaccccctcgcccccggctgcggggacaccaccggctccagcgtcaccctgggctgcctggtgaaggggtacttccccgagtccgtgacggtcacctggaacagcggctccctcagcagctccgtgcacaccttcccggccctgctgcagagcgggctctacaccatgtccagctccgtgacggtccccagctccacctggcccagccagatcgtgatctgctccgtggcgcaccccgccagctccaccaccgtcgacaagaagctggagccgagcggccccatctccacgatcaacccctgcccgccctgcaaggagtgccacaagtgccccgcccccaacctggagggcgggcccagcgtgttcatcttcccgcccaacatcaaggacgtgctcatgatctccctgacccccaaggtgacctgcgtcgtggtcgacgtgagcgaggacgaccccgacgtccagatctcctggttcgtgaacaacgtggaggtccacaccgcccagacgcagacccaccgggaggactacaacagcaccatccgcgtggtgtccaccctgccgatccagcaccaggactggatgagcggcaaggagttcaagtgcaaggtcaacaacaaggacctccccagccccatcgagcggacgatctccaagatcaaggggctggtgcgcgcgccccaggtgtacatcctgccgccgcccgccgagcagctcagccggaaggacgtctccctgacctgcctggtggtgggcttcaaccccggggacatcagcgtcgagtggacctccaacggccacaccgaggagaactacaaggacacggcccccgtgctcgacagcgacggctcctacttcatctacagcaagctgaacatgaagacctccaagtgggagaagaccgacagcttctcctgcaacgtgcgccacgaggggctgaagaactactacctcaagaagaccatcagccggtcccccggcaag

SEQ ID NO: 8253 - RNA, 657 nt, synthetic construct
  misc_feature 1..657: note = derived and/or modified sequence opt1 from Neuradiab_LightChain1
  source 1..657: mol_type = other RNA
gacatcgtgatgacccaggccgccttcagcaaccccgtgaccctgggcacgtccgcgagcatctcctgccgcagctccaagagcctcctgcactccaacgggatcacctacctgtactggtacctccagaagccgggccagagcccccagctgctgatctaccagatgtccaacctcgccagcggggtgcccgaccggttctccagctccggcagcgggaccgacttcaccctgcgcatctcccgggtggaggccgaggacgtcggcgtgtactactgcgcccagaacctggagctcccccgcacgttcggcgggggcaccaagctggagatcaagcgggccgacgcggccccgaccgtgagcatcttcccgccctccagcgagcagctgacctccgggggcgccagcgtcgtgtgcttcctcaacaacttctaccccaaggacatcaacgtgaagtggaagatcgacgggagcgagcgccagaacggcgtcctgaactcctggacggaccaggacagcaaggactccacctacagcatgtccagcaccctgaccctcacgaaggacgagtacgagcggcacaactcctacacgtgcgaggccacccacaagaccagcacctcccccatcgtcaagagcttcaaccgcaacgagtgc

SEQ ID NO: 8254 - RNA, 369 nt, synthetic construct
  misc_feature 1..369: note = derived and/or modified sequence opt1 from Nimotuzumab_HeavyChain1
  source 1..369: mol_type = other RNA
caggtgcagctgcagcagagcggcgccgaggtcaagaagcccgggtccagcgtgaaggtgtcctgcaaggccagcggctacaccttcaccaactactacatctactgggtccgccaggcgccggggcagggcctcgagtggatcgggggcatcaaccccacgtccggcgggagcaacttcaacgagaagttcaagacccgggtgaccatcaccgtggacgagtccacgaacaccgcctacatggagctgagctccctgcgcagcgaggacaccgccttctacttctgcgcccggcagggcctctggttcgactccgacgggcgcggcttcgacttctgggggcagggcagcaccgtcacggtgtccagc

SEQ ID NO: 8255 - RNA, 342 nt, synthetic construct
  misc_feature 1..342: note = derived and/or modified sequence opt1 from Nimotuzumab_LightChain1
  source 1..342: mol_type = other RNA
gacatccagatgacccagagcccctccagcctgtccgccagcgtgggcgaccgcgtcaccatcacgtgccggtccagccagaacatcgtgcactccaacgggaacacctacctcgactggtaccagcagaccccgggcaaggcccccaagctgctgatctacaaggtgagcaaccgcttctccggggtccccagccggttctccggcagcgggtccggcaccgacttcacgttcaccatcagctccctccagcccgaggacatcgcgacctactactgcttccagtacagccacgtgccgtggaccttcggccaggggacgaagctgcagatcacccgcgag

SEQ ID NO: 8256 - RNA, 1320 nt, synthetic construct
  misc_feature 1..1320: note = derived and/or modified sequence opt1 from Nivolumab_HeavyChain1
  source 1..1320: mol_type = other RNA
caggtgcagctggtcgagagcggcgggggcgtggtgcagcccgggcgctccctccggctggactgcaaggccagcggcatcaccttctccaacagcgggatgcactgggtccgccaggcccccggcaagggcctggagtgggtggcggtgatctggtacgacgggtccaagcggtactacgccgacagcgtcaagggccgcttcaccatctcccgggacaacagcaagaacaccctcttcctgcagatgaactccctgcgcgccgaggacaccgccgtgtactactgcgccaccaacgacgactactgggggcagggcaccctcgtgacggtcagctccgcgagcaccaaggggccctccgtgttccccctggccccctgcagccggtccaccagcgagtccaccgccgccctgggctgcctcgtgaaggactacttcccggagcccgtcacggtgagctggaactccggcgcgctgaccagcggggtgcacaccttccccgccgtcctgcagagctccggcctctacagcctgtccagcgtggtgaccgtcccctccagctccctggggacgaagacctacacgtgcaacgtggaccacaagccgagcaacaccaaggtggacaagcgcgtcgagtccaagtacggcccgccctgcccgccctgccccgcccccgagttcctcggcgggcccagcgtgttcctgttcccgcccaagcccaaggacacgctgatgatctcccggacccccgaggtgacctgcgtcgtggtcgacgtgagccaggaggacccggaggtgcagttcaactggtacgtcgacggcgtggaggtgcacaacgccaagaccaagccccgcgaggagcagttcaactccacgtaccgggtcgtgagcgtgctcaccgtcctgcaccaggactggctgaacgggaaggagtacaagtgcaaggtgtccaacaagggcctccccagctccatcgagaagaccatcagcaaggccaaggggcagccccgcgagccccaggtgtacaccctgccgccctcccaggaggagatgacgaagaaccaggtcagcctgacctgcctcgtgaagggcttctaccccagcgacatcgcggtggagtgggagtccaacggccagcccgagaacaactacaagaccaccccgcccgtcctggacagcgacgggtccttcttcctgtacagccggctcacggtggacaagtcccgctggcaggagggcaacgtgttcagctgctccgtcatgcacgaggccctgcacaaccactacacccagaagtccctgagcctcagcctggggaag

SEQ ID NO: 8257 - RNA, 642 nt, synthetic construct
  misc_feature 1..642: note = derived and/or modified sequence opt1 from Nivolumab_LightChain1
  source 1..642: mol_type = other RNA
gagatcgtgctgacccagagccccgccaccctctccctgagcccgggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagagctccaactggccccggaccttcggccagggcaccaaggtggagatcaagcgcaccgtcgccgcccccagcgtgttcatcttcccgccctccgacgagcagctcaagagcgggacggcgtccgtggtctgcctgctgaacaacttctacccccgggaggccaaggtgcagtggaaggtggacaacgccctgcagagcggcaacagccaggagtccgtcaccgagcaggacagcaaggactccacctacagcctctccagcaccctgacgctgtccaaggccgactacgagaagcacaaggtgtacgcctgcgaggtgacccaccaggggctcagctcccccgtcaccaagagcttcaaccgcggcgagtgc

SEQ ID NO: 8258 - RNA, 1347 nt, synthetic construct
  misc_feature 1..1347: note = derived and/or modified sequence opt1 from Obiltoxaximab_HeavyChain1
  source 1..1347: mol_type = other RNA
caggtgcagctgcagcagagcggccccgagctcaagaagccgggggcctccgtcaaggtgagctgcaaggactccggctacgccttcagctccagctggatgaactgggtgcgccaggcgcccgggcagggcctggagtggatcgggcggatctaccccggcgacggcgacaccaactacaacgggaagttccagggccgcgtcaccatcacggccgacaagtccagctccaccgcctacatggagctgagctccctccggagcgaggacaccgccgtgtacttctgcgcccgctccgggctgctgcggtacgcgatggactactggggccaggggaccctcgtgacggtcagctccgccagcaccaagggcccctccgtgttcccgctggcccccagctccaagagcaccagcggcgggaccgccgcgctgggctgcctcgtgaaggactacttccccgagcccgtcacggtgtcctggaacagcggggccctgacctccggcgtgcacaccttcccggccgtcctgcagagctccggcctctacagcctgtccagcgtggtgaccgtcccctccagctccctggggacgcagacctacatctgcaacgtgaaccacaagcccagcaacaccaaggtggacaagaaggtcgagcccaagtcctgcgacaagacccacacgtgcccgccctgccccgcccccgagctcctgggcgggccgagcgtgttcctgttcccgcccaagcccaaggacaccctcatgatctcccgcacccccgaggtgacctgcgtcgtggtggacgtcagccacgaggaccccgaggtgaagttcaactggtacgtcgacggcgtggaggtgcacaacgccaagacgaagccccgggaggagcagtacaactccacctaccgcgtcgtgagcgtgctgaccgtcctgcaccaggactggctcaacgggaaggagtacaagtgcaaggtgtccaacaaggcgctgcccgccccgatcgagaagaccatcagcaaggccaagggccagccccgggagccccaggtgtacacgctgcccccgagccgcgacgagctcaccaagaaccaggtctccctgacctgcctggtgaagggcttctaccccagcgacatcgccgtggagtgggagtccaacgggcagcccgagaacaactacaagaccacgccgcccgtcctcgacagcgacggctccttcttcctgtacagcaagctgaccgtggacaagtcccggtggcagcaggggaacgtgttcagctgctccgtcatgcacgaggccctccacaaccactacacccagaagtccctgagcctgagccccggcaag

SEQ ID NO: 8259 - RNA, 642 nt, synthetic construct
  misc_feature 1..642: note = derived and/or modified sequence opt1 from Obiltoxaximab_LightChain1
  source 1..642: mol_type = other RNA
gacatccagatgacccagagcccctccagcctgtccgccagcgtgggcgaccgcgtcaccatcacgtgccgggcctcccaggacatccgcaactacctcaactggtaccagcagaagccggggaaggcggtgaagctgctgatctactacaccagccggctcctgcccggcgtgccctcccgcttcagcgggtccggcagcgggaccgactactccctgaccatcagctcccaggagcaggaggacatcggcacgtacttctgccagcagggcaacaccctcccctggaccttcgggcagggcaccaaggtcgagatccggcgcacggtggccgccccgagcgtgttcatcttcccgccctccgacgagcagctcaagagcgggaccgcctccgtcgtgtgcctgctgaacaacttctacccccgggaggccaaggtgcagtggaaggtcgacaacgcgctgcagagcggcaactcccaggagagcgtgaccgagcaggacagcaaggactccacctacagcctgtccagcacgctcaccctgtccaaggccgactacgagaagcacaaggtgtacgcctgcgaggtcacccaccaggggctgagctcccccgtgaccaagagcttcaaccgcggcgagtgc

SEQ ID NO: 8260 - RNA, 1347 nt, synthetic construct; identical to SEQ ID NO: 7664
  misc_feature 1..1347: note = derived and/or modified sequence opt1 from Obinutuzumab_HeavyChain1
  source 1..1347: mol_type = other RNA

SEQ ID NO: 8261 - RNA, 657 nt, synthetic construct; identical to SEQ ID NO: 7665
  misc_feature 1..657: note = derived and/or modified sequence opt1 from Obinutuzumab_LightChain1
  source 1..657: mol_type = other RNA

SEQ ID NO: 8262 - RNA, 1350 nt, synthetic construct
  misc_feature 1..1350: note = derived and/or modified sequence opt1 from Ocaratuzumab_HeavyChain1
  source 1..1350: mol_type = other RNA
gaggtgcagctggtccagagcggcgccgaggtgaagaagcccggggagtccctcaagatcagctgcaagggctccgggcgcaccttcaccagctacaacatgcactgggtgcggcagatgccgggcaaggggctggagtggatgggcgccatctaccccctgacgggcgacacctcctacaaccagaagtccaagctccaggtcaccatcagcgcggacaagagcatctccaccgcctacctgcagtggagctccctgaaggccagcgacacggccatgtactactgcgcccgctccacctacgtcgggggcgactggcagttcgacgtgtgggggaagggcaccaccgtcacggtgagctccgcgagcaccaaggggccctccgtgttccccctcgccccgagctccaagagcaccagcggcggcaccgccgccctggggtgcctggtcaaggactacttccccgagcccgtgacggtgtcctggaacagcggcgcgctcacctccggggtccacaccttccccgccgtgctgcagagctccggcctgtacagcctctccagcgtggtcaccgtgccgtccagctccctgggcacgcagacctacatctgcaacgtgaaccacaagcccagcaacaccaaggtcgacaagaaggtggagcccaagtcctgcgacaagacccacacgtgcccgccctgccccgcccccgagctgctcgggggccccagcgtgttcctgttcccgcccaagatcaaggacaccctgatgatctcccggacccccgaggtgacctgcgtggtggtcgacgtgagccacgaggaccccgaggtcaagttcaactggtacgtggacggggtggaggtccacaacgccaagacgaagccgcgcgaggagcagtacaactccacctaccgggtggtgagcgtcctcaccgtgctgcaccaggactggctgaacggcaaggagtacaagtgcaaggtgtccaacaaggccctccccgcgcccatcgagaagaccatcagcaagcagaaggggcagccccgcgagccgcaggtctacacgctgccgcccagccgggacgagctgaccaagaaccaggtgtccctgacctgcctcgtgaagggcttctaccccagcgacatcgccgtcgagtgggagtccaacggccagcccgagaacaactacaagaccacgccgcccgtgctggacagcgacgggtccttcttcctctacagcaagctgaccgtggacaagtcccgctggcagcagggcaacgtcttcagctgctccgtgatgcacgaggccctgcacaaccactacacccagaagtccctcagcctgagccccggg

SEQ ID NO: 8263 - RNA, 639 nt, synthetic construct
  misc_feature 1..639: note = derived and/or modified sequence opt1 from Ocaratuzumab_LightChain1
  source 1..639: mol_type = other RNA
gagatcgtgctgacccagagccccggcaccctctccctgagcccgggggagcgggccacgctgtcctgccgggccagctccagcgtcccctacatccactggtaccagcagaagcccggccaggcgccccgcctcctgatctacgccacctccgccctggccagcgggatcccggaccggttctccggcagcgggtccggcaccgacttcaccctcacgatcagccgcctggagcccgaggacttcgccgtgtactactgccagcagtggctgtccaacccgcccaccttcggccaggggaccaagctcgagatcaagcggaccgtggcggcccccagcgtcttcatcttcccgccctccgacgagcagctcaagagcggcacggcctccgtggtgtgcctgctgaacaacttctacccccgcgaggccaaggtccagtggaaggtggacaacgcgctgcagagcgggaactcccaggagagcgtgaccgagcaggacagcaaggactccacctacagcctgtccagcaccctcacgctgtccaaggccgactacgagaagcacaaggtctacgcctgcgaggtgacccaccagggcctgagctcccccgtgaccaagagcttcaaccgcggggagtgc

SEQ ID NO: 8264 - RNA, 1356 nt, synthetic construct
  misc_feature 1..1356: note = derived and/or modified sequence opt1 from Ocrelizumab_HeavyChain1
  source 1..1356: mol_type = other RNA
gaggtgcagctggtcgagagcggcgggggcctcgtgcagcccgggggctccctgcgcctgagctgcgccgcctccgggtacaccttcaccagctacaacatgcactgggtgcggcaggcgccgggcaagggcctcgagtgggtcggggccatctaccccggcaacggggacacctcctacaaccagaagttcaagggccgcttcaccatcagcgtggacaagtccaagaacaccctgtacctgcagatgaacagcctccgggccgaggacaccgccgtgtactactgcgcccgcgtcgtgtactactccaacagctactggtacttcgacgtgtgggggcagggcacgctggtcaccgtgtccagcgcgtccaccaagggccccagcgtgttccccctggccccgtccagcaagtccaccagcgggggcacggccgccctcgggtgcctggtcaaggactacttccccgagcccgtgaccgtgtcctggaacagcggcgcgctgaccagcggcgtccacaccttccccgccgtgctccagtccagcgggctgtactccctgagctccgtggtcacggtgccgagctccagcctcggcacccagacctacatctgcaacgtgaaccacaagccctccaacaccaaggtcgacaagaaggtggagcccaagagctgcgacaagacgcacacgtgcccgccctgccccgcccccgagctgctcgggggcccctccgtgttcctgttcccgcccaagcccaaggacaccctgatgatcagccggacccccgaggtgacctgcgtcgtcgtggacgtgtcccacgaggacccggaggtcaagttcaactggtacgtggacggggtggaggtccacaacgccaagaccaagccccgcgaggagcagtacaacagcacctaccgggtggtgtccgtcctgaccgtgctccaccaggactggctgaacggcaaggagtacaagtgcaaggtgagcaacaaggccctgcccgcgcccatcgagaagacgatctccaaggccaagggccagccgcgcgagccccaggtctacaccctcccgcccagccgggaggagatgaccaagaaccaggtgtccctgacctgcctggtgaaggggttctaccccagcgacatcgccgtcgagtgggagagcaacggccagcccgagaacaactacaagacgacgcccccggtgctcgactccgacgggagcttcttcctgtactccaagctgaccgtggacaagagccgctggcagcagggcaacgtcttctcctgcagcgtgatgcacgaggccctccacaaccactacacccagaagtccctgagcctgtcccccgggaag

SEQ ID NO: 8265 - RNA, 639 nt, synthetic construct
  misc_feature 1..639: note = derived and/or modified sequence opt1 from Ocrelizumab_LightChain1
  source 1..639: mol_type = other RNA
gacatccagatgacccagagcccctccagcctgtccgccagcgtgggcgaccgcgtcaccatcacgtgccgggcctccagctccgtgagctacatgcactggtaccagcagaagccggggaaggcgcccaagcccctcatctacgccccctccaacctggccagcggcgtgccgtcccgcttcagcgggtccggcagcgggaccgacttcaccctgaccatctccagcctccagcccgaggacttcgccacgtactactgccagcagtggtccttcaacccgcccaccttcggccagggcaccaaggtcgagatcaagcggaccgtggccgcgcccagcgtgttcatcttcccgccctccgacgagcagctcaagagcgggacggccagcgtcgtgtgcctgctgaacaacttctacccccgcgaggccaaggtgcagtggaaggtcgacaacgccctgcagtccggcaacagccaggagtccgtgaccgagcaggacagcaaggactccacctacagcctgtccagcaccctcacgctgtccaaggcggactacgagaagcacaaggtgtacgcctgcgaggtcacccaccaggggctgagctcccccgtgaccaagagcttcaaccggggcgagtgc

SEQ ID NO: 8266 - RNA, 1356 nt, synthetic construct
  misc_feature 1..1356: note = derived and/or modified sequence opt1 from Ofatumumab_HeavyChain1
  source 1..1356: mol_type = other RNA
gaggtgcagctggtcgagagcggcgggggcctcgtgcagcccgggcgctccctgcggctgagctgcgccgcctccggcttcaccttcaacgactacgcgatgcactgggtgcgccaggccccggggaagggcctcgagtgggtcagcaccatctcctggaacagcggctccatcgggtacgccgacagcgtgaagggccggttcacgatctcccgcgacaacgccaagaagtccctgtacctgcagatgaacagcctccgggccgaggacaccgcgctgtactactgcgccaaggacatccagtacgggaactactactacggcatggacgtgtgggggcagggcaccaccgtcacggtgagctccgccagcaccaagggcccctccgtgttccccctggcccccagctccaagagcacctccgggggcaccgcggccctcgggtgcctggtcaaggactacttcccggagcccgtgacggtgagctggaacagcggcgccctgacctccggcgtccacaccttccccgccgtgctccagagctccgggctgtacagcctgtccagcgtggtcaccgtgccctccagctccctcggcacgcagacctacatctgcaacgtgaaccacaagccgagcaacaccaaggtcgacaagcgcgtggagcccaagtcctgcgacaagacccacacgtgcccgccctgccccgcccccgagctgctcgggggccccagcgtgttcctgttcccgcccaagcccaaggacaccctgatgatctcccggacccccgaggtgacctgcgtcgtggtcgacgtgagccacgaggaccccgaggtcaagttcaactggtacgtggacggggtggaggtccacaacgcgaagacgaagccgcgcgaggagcagtacaactccacctaccgggtggtgagcgtcctgaccgtgctccaccaggactggctgaacggcaaggagtacaagtgcaaggtgtccaacaaggccctgcccgcccccatcgagaagaccatcagcaaggccaagggccagccccgcgagccgcaggtctacacgctcccgccctcccgggaggagatgaccaagaaccaggtgagcctgacctgcctggtgaaggggttctaccccagcgacatcgccgtcgagtgggagtccaacggccagcccgagaacaactacaagaccacgccgcccgtgctcgacagcgacgggtccttcttcctgtacagcaagctgaccgtggacaagtcccgctggcagcagggcaacgtcttcagctgctccgtgatgcacgaggcgctccacaaccactacacccagaagtccctgagcctgagccccgggaag

SEQ ID NO: 8267 - RNA, 642 nt, synthetic construct
  misc_feature 1..642: note = derived and/or modified sequence opt1 from Ofatumumab_LightChain1
  source 1..642: mol_type = other RNA
gagatcgtgctgacccagagccccgccaccctctccctgagcccgggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggcccatcaccttcggccagggcacccgcctggagatcaagcggaccgtggccgccccctccgtcttcatcttcccgcccagcgacgagcagctcaagtccgggacggcgagcgtggtgtgcctgctgaacaacttctacccccgcgaggccaaggtccagtggaaggtggacaacgccctccagtccggcaacagccaggagagcgtgaccgagcaggactccaaggacagcacctactccctgagctccaccctgacgctcagcaaggccgactacgagaagcacaaggtctacgcctgcgaggtgacccaccaggggctgtccagccccgtgaccaagtccttcaaccggggcgagtgc

SEQ ID NO: 8268 - RNA, 1371 nt, synthetic construct
  misc_feature 1..1371: note = derived and/or modified sequence opt1 from Olaratumab_HeavyChain1
  source 1..1371: mol_type = other RNA
cagctgcagctccaggagagcggccccgggctggtgaagccgtccgagaccctgagcctgacctgcacggtctccggcgggagcatcaactccagctcctactactggggctggctccgccagagccccgggaagggcctggagtggatcggctccttcttctacaccgggagcacctactacaacccctccctccggagccgcctgaccatctccgtggacacgagcaagaaccagttctccctgatgctcagctccgtgaccgccgccgacaccgcggtctactactgcgcccggcagagcacctactactacggctccgggaactactacggctggttcgaccgctgggaccaggggacgctggtgaccgtgagcagcgcctccaccaagggccccagcgtcttcccgctggccccctccagcaagtccaccagcggcgggacggccgcgctcggctgcctggtgaaggactacttccccgagcccgtgaccgtctcctggaacagcggggccctgacctccggcgtgcacaccttcccggccgtgctccagagctccggcctgtacagcctgtccagcgtcgtgacggtgccctccagctccctcgggacccagacctacatctgcaacgtcaaccacaagcccagcaacaccaaggtggacaagcgggtggagcccaagtcctgcgacaagacgcacacgtgcccgccctgccccgcccccgagctgctgggcgggccgagcgtcttcctcttcccgcccaagcccaaggacaccctgatgatcagccgcacccccgaggtgacctgcgtggtcgtggacgtgtcccacgaggaccccgaggtcaagttcaactggtacgtggacggcgtcgaggtgcacaacgcgaagaccaagccccgggaggagcagtacaacagcacctaccgcgtggtctccgtgctgaccgtgctccaccaggactggctgaacgggaaggagtacaagtgcaaggtcagcaacaaggccctgcccgccccgatcgagaagacgatctccaaggccaagggccagccccgggagccccaggtgtacaccctcccgcccagccgcgaggagatgaccaagaaccaggtgtccctgacctgcctggtcaagggcttctaccccagcgacatcgccgtggagtgggagtccaacgggcagcccgagaacaactacaagacgaccccgcccgtgctcgacagcgacggctccttcttcctgtacagcaagctgaccgtcgacaagtcccggtggcagcaggggaacgtgttcagctgctccgtgatgcacgaggcgctccacaaccactacacccagaagtccctgagcctgagccccggcaag

SEQ ID NO: 8269 - RNA, 642 nt, synthetic construct
  misc_feature 1..642: note = derived and/or modified sequence opt1 from Olaratumab_LightChain1
  source 1..642: mol_type = other RNA
gagatcgtgctgacccagagccccgccaccctctccctgagccccggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggccgcccgccttcggccagggcaccaaggtggagatcaagcgcaccgtcgccgcgccctccgtgttcatcttcccgcccagcgacgagcagctgaagtccgggaccgccagcgtggtctgcctcctgaacaacttctacccccgggaggccaaggtgcagtggaaggtggacaacgccctgcagtccggcaacagccaggagagcgtcacggagcaggactccaaggacagcacctactccctcagctccaccctgaccctgagcaaggccgactacgagaagcacaaggtgtacgcgtgcgaggtgacgcaccaggggctctccagccccgtcaccaagtccttcaaccgcggcgagtgc

SEQ ID NO: 8270 - RNA, 1341 nt, synthetic construct
  misc_feature 1..1341: note = derived and/or modified sequence opt1 from Olizuab_HeavyChain1
  source 1..1341: mol_type = other RNA
gaggtgcagctggtcgagagcggcgggggcctcgtgcagcccgggggctccctgcgcctgagctgcgccgtgtccgggtacagcatcacctccggctacagctggaactggatccggcaggccccgggcaaggggctcgagtgggtcgcgtccatcacctacgacggcagcaccaactacaacccctccgtgaaggggcgcatcaccatcagccgggacgactccaagaacaccttctacctgcagaacagcctgcgcgccgaggacaccgccgtgtactactgcgcccggggctcccactacttcgggcactggcacttcgccgtctggggccagggcacgctcgtgaccgtgagctccgcgagcaccaaggggccctccgtcttccccctggccccgagctccaagagcaccagcggcgggacggccgccctgggctgcctcgtgaaggactacttccccgagcccgtgaccgtctcctggaacagcggcgcgctgacctccggggtgcacaccttccccgccgtgctgcagagctccggcctctacagcctgtccagcgtcgtgacggtgccgtccagctccctggggacccagacctacatctgcaacgtcaaccacaagcccagcaacaccaaggtggacaagaaggtggagcccaagtcctgcgacaagacgcacacgtgcccgccctgccccgcccccgagctcctgggcgggcccagcgtcttcctgttcccgcccaagcccaaggacaccctcatctcccgcacccccgaggtgacctgcgtggtcgtggacgtcagccacgaggacccggaggtgaagttcaactggtacgtggacggcgtcgaggtgcacaacgccaagaccaagccccgggaggagcagtacaactccacctaccgcgtggtcagcgtgctgaccgtgctgcaccaggactggctcaacggcaaggagtacaagtgcaaggtctccaacaaggccctgcccgcgcccatcgagaagacgatcagcaaggccaaggggcagccgcgggagccccaggtgtacaccctgccgcccagccgcgaggagaccaagaaccaggtgtccctgacctgcctcgtcaagggcttctaccccagcgacatcgccgtggagtgggagtccaacgggcagcccgagaacaactacaagacgacgcccccggtgctggacagcgacggctccttcttcctctacagcaagctgaccgtcgacaagtcccggtggcagcaggggaacgtgttcagctgctccgtgcacgaggccctgcacaaccactacacccagaagtccctcagcctgagccccggcaag

SEQ ID NO: 8271 - RNA, 651 nt, synthetic construct
  misc_feature 1..651: note = derived and/or modified sequence opt1 from Olizuab_LightChain1
  source 1..651: mol_type = other RNA
gacatccagctgacccagagcccctccagcctctccgccagcgtgggcgaccgggtcaccatcacgtgccgggcctcccagagcgtggactacgacggggactcctacaactggtaccagcagaagccgggcaaggcgcccaagctgctgatctacgccgccagctacctcgagtccggggtgcccagccgcttctccggcagcgggtccggcaccgacttcaccctgaccatcagctccctgcagcccgaggacttcgccacgtactactgccagcagagccacgaggacccgtacaccttcggccaggggaccaaggtcgagatcaagcggaccgtggccgcgccctccgtgttcatcttcccgcccagcgacgagcagctcaagtccggcacggccagcgtcgtgtgcctgctgaacaacttctacccccgcgaggccaaggtgcagtggaaggtcgacaacgccctccagagcgggaactcccaggagagcgtgaccgagcaggactccaaggacagcacctactccctgagctccaccctgacgctcagcaaggcggactacgagaagcacaaggtgtacgcctgcgaggtcacccaccagggcctgtccagccccgtgaccaagtccttcaaccgcggggagtgc

SEQ ID NO: 8272 - RNA, 1341 nt, synthetic construct
  misc_feature 1..1341: note = derived and/or modified sequence opt1 from Olokizumab_HeavyChain1
  source 1..1341: mol_type = other RNA
gaggtgcagctggtcgagagcggcgggggcctcgtgcagcccgggggctccctgcgcctgagctgcgccgcctccgggttcaacttcaacgactacttcatgaactgggtgcggcaggcgcccggcaagggcctcgagtgggtcgcccagatgcgcaacaagaactaccagtacgggacctactacgccgagagcctggagggccggttcaccatctcccgcgacgacagcaagaactccctgtacctccagatgaacagcctgaagacggaggacaccgccgtgtactactgcgcccgggagtcctactacgggttcaccagctactggggccaggggaccctggtgacggtctccagcgcgtccaccaagggccccagcgtgttccccctcgccccctgctcccgcagcacctccgagagcaccgccgccctgggctgcctggtgaaggactacttcccggagcccgtcacggtgtcctggaacagcggggcgctcaccagcggcgtgcacaccttccccgccgtcctgcagtccagcgggctgtactccctcagctccgtggtgaccgtccccagctccagcctgggcacgaagacctacacgtgcaacgtggaccacaagccgtccaacaccaaggtggacaagcgggtcgagagcaagtacggcccgccctgcccgccctgccccgcccccgagttcctcgggggcccctccgtgttcctgttcccgcccaagcccaaggacaccctgatgatcagccgcacccccgaggtgacctgcgtcgtggtggacgtctcccaggaggacccggaggtgcagttcaactggtacgtcgacggggtggaggtgcacaacgccaagaccaagccccgggaggagcagttcaacagcacgtaccgcgtcgtgtccgtgctgaccgtcctccaccaggactggctgaacggcaaggagtacaagtgcaaggtgagcaacaaggggctgccctccagcatcgagaagaccatctccaaggccaagggccagccccgggagccccaggtgtacaccctcccgcccagccaggaggagatgacgaagaaccaggtcagcctgacctgcctggtgaagggcttctacccctccgacatcgcggtggagtgggagagcaacgggcagcccgagaacaactacaagaccaccccgcccgtcctcgactccgacggcagcttcttcctgtactcccgcctgacggtggacaagagccggtggcaggaggggaacgtgttctcctgcagcgtcatgcacgaggccctccacaaccactacacccagaagtccctgagcctgtccctcggcaag

SEQ ID NO: 8273 - RNA, 642 nt, synthetic construct
  misc_feature 1..642: note = derived and/or modified sequence opt1 from Olokizumab_LightChain1
  source 1..642: mol_type = other RNA
gacatccagatgacccagagcccctccagcctgtccgccagcgtgggcgaccgcgtcaccatcacgtgccaggcctcccaggacatcgggatcagcctctcctggtaccagcagaagccgggcaaggcgcccaagctgctgatctacaacgccaacaacctcgccgacggggtgcccagccggttctccggcagcgggtccggcaccgacttcaccctgaccatcagctccctgcagcccgaggacttcgccacgtactactgcctccagcacaacagcgccccgtacaccttcggccaggggaccaagctggagatcaagcgcaccgtggcggccccctccgtcttcatcttcccgcccagcgacgagcagctgaagtccggcacggccagcgtggtgtgcctcctgaacaacttctacccccgggaggccaaggtccagtggaaggtggacaacgcgctgcagtccgggaacagccaggagagcgtgaccgagcaggactccaaggacagcacctactccctcagctccaccctgacgctgagcaaggccgactacgagaagcacaaggtctacgcctgcgaggtgacccaccagggcctctccagccccgtgaccaagtccttcaaccgcggggagtgc

SEQ ID NO: 8274 - RNA, 1341 nt, synthetic construct
  misc_feature 1..1341: note = derived and/or modified sequence opt1 from Omalizumab_HeavyChain
  source 1..1341: mol_type = other RNA
gaggtgcagctggtcgagagcggcgggggcctcgtgcagcccgggggctccctgcgcctgagctgcgccgtgtccgggtacagcatcacctccggctacagctggaactggatccggcaggccccgggcaaggggctcgagtgggtcgcgtccatcacctacgacggcagcacgaactacgccgactccgtgaaggggcgcttcaccatcagccgggacgactccaagaacaccttctacctgcagatgaacagcctgcgcgccgaggacaccgccgtgtactactgcgcccggggctcccactacttcgggcactggcacttcgcggtctggggccagggcacgctcgtgaccgtgagctccgggcccagcgtcttccccctggccccctccagcaagtccaccagcggcgggaccgccgccctgggctgcctcgtgaaggactacttcccggagcccgtgacggtcagctggaactccggcgcgctgaccagcggggtgcacaccttccccgccgtgctgcagtccagcggcctctactccctgagctccgtcgtgaccgtgcccagctccagcctggggacgcagacctacatctgcaacgtcaaccacaagccgtccaacaccaaggtggacaagaaggccgagcccaagagctgcgacaagacccacacgtgcccgccctgccccgcccccgagctcctgggcgggccctccgtgttcctgttcccgcccaagcccaaggacaccctcatgatcagccgcacccccgaggtgacctgcgtcgtggtcgacgtgtcccacgaggaccccgaggtcaagttcaactggtacgtggacggcgtggaggtccacaacgccaagacgaagccgcgggaggagcagtacaacagcacctaccgcgtggtgtccgtcctgaccgtgctgcaccaggactggctcaacggcaaggagtacaagtgcaaggtgagcaacaaggcgctgcccgcccccatcgagaagaccatctccaaggccaaggggcagccccgggagccgcaggtctacacgctgccgcccagccgcgacgagctcaccaagaaccaggtgagcctgacctgcctggtgaagggcttctacccctccgacatcgccgtcgagtgggagagcaacgggcagcccgagaacaactacaagaccacgccgcccgtgctcgactccgacggcagcttcttcctgtactccaagctgaccgtggacaagagccggtggcagcaggggaacgtcttctcctgcagcgtgatgcacgaggccctccacaaccactacacccagaagtccctgagcctgtcccccggcaag

SEQ ID NO: 8275 - RNA, 645 nt, synthetic construct
  misc_feature 1..645: note = derived and/or modified sequence opt1 from Omalizumab_LightChain
  source 1..645: mol_type = other RNA
gacatccagctgacccagagcccctccagcctctccgccagcgtgggcgaccgcgtcaccatcacgtgccgggcctcccagagcgtggactacgacggggactcctacatgaactggtaccagcagaagccgggcaaggcgcccaagctgctgatctacgccgccagctacctcgagtccggggtgcccagccgcttctccggcagcgggtccggcaccgacttcaccctgaccatcagctccctgcagcccgaggacttcgccacgtactactgccagcagagccacgaggacccgtacaccttcggccaggggaccaaggtcgagatcaagcggaccgtggccgcgccctccgtgttcatcttcccgcccagcgacgagcagctcaagtccggcacggccagcgtcgtgtgcctgctgaacaacttctacccccgcgaggccaaggtgcagtggaaggtcgacaacgccctccagagcgggaactcccaggagagcgtgaccgagcaggactccaaggacagcacctactccctgagctccaccctgacgctcagcaaggcggactacgagaagcacaaggtgtacgcctgcgaggtcacccaccagggcctgtccagccccgtgaccaagtccttcaaccgg

SEQ ID NO: 8276 - RNA, 1347 nt, synthetic construct
  misc_feature 1..1347: note = derived and/or modified sequence opt1 from Onartuzumab_HeavyChain1
  source 1..1347: mol_type = other RNA
gaggtgcagctggtcgagagcggcgggggcctcgtgcagcccgggggctccctgcgcctgagctgcgccgcctccgggtacaccttcaccagctactggctccactgggtgcggcaggcgcccggcaagggcctggagtgggtcgggatgatcgacccctccaacagcgacacgcgcttcaaccccaacttcaaggaccggttcaccatctccgccgacaccagcaagaacaccgcctacctgcagatgaactccctccgcgccgaggacacggccgtgtactactgcgcgacctaccggagctacgtgacgcccctggactactggggccaggggaccctggtcaccgtgtccagcgcctccaccaagggcccgagcgtgttccccctcgccccctccagcaagtccaccagcgggggcaccgccgcgctgggctgcctggtcaaggactacttccccgagccggtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgccccgccccggagctgctcggcgggccctccgtgttcctgttcccgcccaagcccaaggacaccctgatgatcagccgcacccccgaggtgacctgcgtcgtggtcgacgtgtcccacgaggaccccgaggtcaagttcaactggtacgtggacggcgtggaggtccacaacgccaagacgaagccccgggaggagcagtacaacagcacctaccgcgtggtgtccgtcctcaccgtgctgcaccaggactggctgaacgggaaggagtacaagtgcaaggtgagcaacaaggcgctcccggcccccatcgagaagaccatctccaaggccaagggccagccccgggagccccaggtctacacgctgccgcccagccgcgaggagatgaccaagaaccaggtgtccctgagctgcgccgtgaaggggttctaccccagcgacatcgccgtcgagtgggagtccaacggccagccggagaacaactacaagaccaccccgcccgtgctcgacagcgacggctccttcttcctggtgagcaagctgacggtcgacaagtcccggtggcagcaggggaacgtgttcagctgctccgtgatgcacgaggcgctccacaaccactacacccagaagtccctgagcctgagccccggcaag

SEQ ID NO: 8277 - RNA, 681 nt, synthetic construct
  misc_feature 1..681: note = derived and/or modified sequence opt1 from Onartuzumab_HeavyChain2
  source 1..681: mol_type = other RNA
gacaagacccacacgtgcccgccctgccccgcccccgagctgctcggcgggcccagcgtgttcctgttcccgcccaagcccaaggacaccctgatgatctcccgcacccccgaggtgacctgcgtcgtggtcgacgtgagccacgaggacccggaggtgaagttcaactggtacgtcgacggcgtggaggtgcacaacgccaagaccaagccccgggaggagcagtacaactccacgtaccgcgtcgtgagcgtgctcaccgtcctgcaccaggactggctgaacgggaaggagtacaagtgcaaggtgtccaacaaggcgctccccgcccccatcgagaagaccatcagcaaggccaagggccagccgcgggagccccaggtgtacaccctgccgccctcccgcgaggagatgacgaagaaccaggtcagcctgtggtgcctcgtgaaggggttctacccctccgacatcgccgtggagtgggagagcaacggccagcccgagaacaactacaagaccaccccgcccgtcctggactccgacggcagcttcttcctgtactccaagctcaccgtggacaagagccggtggcagcaggggaacgtgttctcctgcagcgtcatgcacgaggccctgcacaaccactacacgcagaagtccctgagcctctcccccggcaag

SEQ ID NO: 8278 - RNA, 660 nt, synthetic construct
  misc_feature 1..660: note = derived and/or modified sequence opt1 from Onartuzumab_LightChain1
  source 1..660: mol_type = other RNA
gacatccagatgacgcagagcccctccagcctgtccgccagcgtgggcgaccgcgtcaccatcacgtgcaagtccagccagtccctcctgtacaccagctcccagaagaactacctggcctggtaccagcagaagccggggaaggcgcccaagctcctgatctactgggccagcacccgggagtccggcgtgcccagccgcttctccgggagcggctccgggaccgacttcacgctgaccatcagctccctccagcccgaggacttcgccacctactactgccagcagtactacgcctacccgtggaccttcggccagggcacgaaggtggagatcaagcggaccgtcgccgcgcccagcgtgttcatcttcccgccctccgacgagcagctcaagagcgggaccgccagcgtggtctgcctgctgaacaacttctacccccgcgaggccaaggtgcagtggaaggtggacaacgccctgcagtccggcaacagccaggagtccgtcaccgagcaggacagcaaggactccacgtacagcctgtccagcaccctcaccctgtccaaggcggactacgagaagcacaaggtgtacgcctgcgaggtgacccaccaggggctgagctcccccgtcaccaagagcttcaaccggggcgagtgc

SEQ ID NO: 8279 - RNA, 1362 nt, synthetic construct
  misc_feature 1..1362: note = derived and/or modified sequence opt1 from Ontuxizumab_HeavyChain1
  source 1..1362: mol_type = other RNA
caggtgcagctgcaggagagcggccccgggctcgtccgcccgtcccagaccctgagcctgacctgcacggcctccggctacaccttcaccgactacgtgatccactgggtgaagcagccgcccgggcggggcctcgagtggatcgggtacatcaacccctacgacgacgacaccacgtacaaccagaagttcaagggccgcgtcaccatgctggtggacaccagctccaacaccgcctacctgcggctcagctccgtgacggcggaggacaccgccgtctactactgcgcccgccggggcaacagctacgacgggtacttcgactactccatggactactggggcagcgggaccccggtgaccgtgtccagcgcctccacgaagggccccagcgtcttccccctggccccctccagcaagtccaccagcgggggcaccgcggccctgggctgcctcgtgaaggactacttcccggagcccgtgaccgtctcctggaacagcggggccctgacgagcggcgtgcacaccttccccgccgtgctgcagtccagcgggctctactccctgagctccgtcgtgaccgtgcccagctccagcctgggcacccagacgtacatctgcaacgtcaaccacaagccgtccaacaccaaggtggacaagaaggtggagcccaagagctgcgacaagacccacacgtgcccgccctgccccgcgcccgagctcctgggcgggccctccgtcttcctgttcccgcccaagcccaaggacaccctcatgatcagccgcacccccgaggtgacctgcgtggtcgtggacgtctcccacgaggaccccgaggtgaagttcaactggtacgtggacggcgtcgaggtgcacaacgccaagaccaagccgcgggaggagcagtacaacagcacgtaccgcgtggtctccgtgctgaccgtgctgcaccaggactggctcaacgggaaggagtacaagtgcaaggtcagcaacaaggccctgcccgcccccatcgagaagaccatctccaaggccaagggccagccccgggagccccaggtgtacaccctgccgcccagccgcgacgagctcacgaagaaccaggtgtccctgacctgcctggtcaaggggttctaccccagcgacatcgcggtggagtgggagagcaacggccagcccgagaacaactacaagaccaccccgcccgtgctcgactccgacggcttcttcttcctgtacagcaagctgacggtcgacaagtcccggtggcagcaggggaacgtgttcagctgctccgtgatgcacgaggccctccacaaccactacacccagaagtccctgagcctgagccccggcaag

SEQ ID NO: 8280 - RNA, 645 nt, synthetic construct
  misc_feature 1..645: note = derived and/or modified sequence opt1 from Ontuxizumab_LightChain1
  source 1..645: mol_type = other RNA
gacatccagatgacccagagcccctccagcctgtccgccagcgtgggcgaccgcgtcaccatcacgtgccgggcctcccagaacgtggggaccgcggtggcctggctccagcagaccccgggcaaggcccccaagctgctgatctacagcgcctccaaccgctacaccggggtccccagccggttctccggcagcgggtccggcacggactacaccttcaccatcagctccctccagcccgaggacatcgccacctactactgccagcagtacacgaactacccgatgtacaccttcggccaggggaccaaggtgcagatcaagcgcaccgtggcggcccccagcgtcttcatcttcccgccctccgacgagcagctcaagagcggcacggcctccgtggtgtgcctgctgaacaacttctacccccgggaggccaaggtccagtggaaggtggacaacgcgctgcagagcgggaactcccaggagagcgtgaccgagcaggacagcaaggactccacctacagcctgtccagcaccctcacgctgtccaaggccgactacgagaagcacaaggtctacgcctgcgaggtgacccaccagggcctgagctcccccgtgaccaagagcttcaaccgcggggagtgc

SEQ ID NO: 8281 - RNA, 1341 nt, synthetic construct
  misc_feature 1..1341: note = derived and/or modified sequence opt1 from Opicinumab_HeavyChain1
  source 1..1341: mol_type = other RNA
gaggtgcagctgctcgagagcggcgggggcctggtccagcccgggggctccctgcgcctcagctgcgccgcctccgggttcaccttcagcgcgtacgagatgaagtgggtgcggcaggccccgggcaagggcctggagtgggtgtccgtcatcgggcccagcggcgggttcaccttctacgccgactccgtgaagggccgcttcaccatcagccgggacaactccaagaacaccctgtacctccagatgaacagcctgcgcgccgaggacaccgccgtgtactactgcgcgaccgagggggacaacgacgccttcgacatctggggccagggcacgaccgtcaccgtgtccagcgcctccaccaaggggcccagcgtgttccccctggccccgtccagcaagtccacgagcggcgggaccgcggccctcggctgcctggtcaaggactacttccccgagcccgtgaccgtgtcctggaacagcggcgccctgaccagcggggtccacacgttccccgccgtgctccagtccagcggcctgtactccctgagctccgtggtcaccgtgccgagctccagcctcgggacccagacctacatctgcaacgtgaaccacaagccctccaacacgaaggtcgacaagaaggtggagcccaagagctgcgacaagacccacacgtgcccgccctgccccgcccccgagctgctgggcgggccctccgtgttcctcttcccgcccaagcccaaggacaccctgatgatcagccggacccccgaggtgacctgcgtcgtggtcgacgtgtcccacgaggacccggaggtcaagttcaactggtacgtggacggcgtggaggtccacaacgcgaagaccaagccccgcgaggagcagtacaacagcgcctaccgggtggtgtccgtcctgaccgtgctccaccaggactggctgaacggcaaggagtacaagtgcaaggtgagcaacaaggccctgcccgcccccatcgagaagacgatctccaaggccaaggggcagccgcgcgagccccaggtctacaccctcccgcccagccgggacgagctgaccaagaaccaggtgtccctgacctgcctcgtgaagggcttctaccccagcgacatcgcggtcgagtgggagagcaacgggcagcccgagaacaactacaagacgacgcccccggtgctggactccgacggcagcttcttcctgtactccaagctcaccgtggacaagagccgctggcagcaggggaacgtcttctcctgcagcgtgatgcacgaggccctgcacaaccactacacccagaagtccctgagcctctcccccggc

SEQ ID NO: 8282 - RNA, 645 nt, synthetic construct
  misc_feature 1..645: note = derived and/or modified sequence opt1 from Opicinumab_LightChain1
  source 1..645: mol_type = other RNA
gacatccagatgacccagagccccgccaccctgtccctcagcccgggcgagcgcgccacgctgtcctgccgggcgagccagtccgtgagctcctacctggcctggtaccagcagaagcccgggcaggcgccccgcctcctgatctacgacgccagcaaccgggccaccggcatccccgcccgcttctccgggagcggctccgggaccgacttcaccctgacgatcagctccctcgagccggaggacttcgccgtctactactgccagcagcggagcaactggcccatgtacaccttcggccagggcaccaagctggagatcaagcgcaccgtggccgccccctccgtgttcatcttcccgcccagcgacgagcagctgaagtccgggacggcgagcgtcgtgtgcctcctgaacaacttctacccccgggaggccaaggtgcagtggaaggtcgacaacgccctgcagtccggcaacagccaggagagcgtgaccgagcaggactccaaggacagcacctactccctcagctccaccctgacgctgagcaaggccgactacgagaagcacaaggtgtacgcctgcgaggtcacccaccaggggctctccagccccgtgaccaagtccttcaaccgcggcgagtgc

SEQ ID NO: 8283 - RNA, 1941 nt, synthetic construct
  misc_feature 1..1941: note = derived and/or modified sequence opt1 from Oportuzumab_monatox_HeavyChain1
  source 1..1941: mol_type = other RNA
caccaccaccaccaccacgacatccagatgacccagagcccctccagcctgtccgccagcgtgggcgaccgcgtgaccatcacgtgccggtccaccaagagcctcctgcactccaacgggatcacctacctgtactggtaccagcagaagcccggcaaggcccccaagctcctgatctaccagatgagcaacctggcgtccggggtgcccagccgcttctccagctccggcagcgggaccgacttcacgctcaccatctccagcctgcagcccgaggacttcgccacctactactgcgcccagaacctggagatcccgcggaccttcggccagggcacgaaggtggagctcaagcgcgccaccccctcccacaacagccaccaggtcccctccgccgggggccccaccgcgaacagcgggaccagcggctccgaggtgcagctggtgcagagcgggccgggcctggtccagcccggcgggtccgtgcggatcagctgcgccgcctccggctacacgttcaccaactacgggatgaactgggtgaagcaggcccccggcaagggcctcgagtggatggggtggatcaacacctacaccggcgagagcacgtacgcggactccttcaaggggcgcttcaccttcagcctggacacctccgccagcgccgcctacctgcagatcaactccctccgggccgaggacaccgcggtctactactgcgcccgcttcgccatcaagggcgactactgggggcagggcacgctgctgaccgtgagctccgagttcggcggggcccccgagttcccgaagcccagcaccccgcccggctccagcgggctcgagggcgggtccctggccgcgctgaccgcccaccaggcctgccacctccccctggagacgttcacccggcaccgccagccccggggctgggagcagctggagcagtgcggctaccccgtgcagcgcctcgtcgccctgtacctggccgcgcggctcagctggaaccaggtggaccaggtgatccgcaacgccctggcctcccccgggagcggcggggacctgggcgaggccatccgggagcagccggagcaggcccgcctcgcgctgaccctggccgccgccgagagcgagcggttcgtccgccaggggaccggcaacgacgaggcgggcgccgcctccgccgacgtggtgagcctcacgtgccccgtcgccgcgggggagtgcgccggccccgccgactccggggacgccctgctggagcggaactaccccaccggcgccgagttcctcggcgacgggggcgacgtgagcttctccacccgcgggacccagaactggacggtggagcggctgctgcaggcgcaccgccagctcgaggagcgcggctacgtcttcgtggggtaccacggcaccttcctggaggccgcccagagcatcgtgttcggcggggtccgggcccgctcccaggacctggacgccatctggcggggcttctacatcgcgggggacccggccctcgcctacggctacgcccaggaccaggagcccgacgcgcgcgggcggatccgcaacggcgccctgctgcgggtgtacgtcccccgcagctccctccccggcttctaccggaccgggctgaccctggccgccccggaggccgcgggcgaggtggagcgcctcatcgggcaccccctgcccctgcggctggacgccatcacgggcccggaggaggagggcgggcgcctcgagaccatcctgggctggcccctggccgagcggaccgtggtcatccccagcgccatccccaccgacccgcgcaacgtcgggggcgacctcgacccctccagcatccccgacaaggagcaggccatctccgcgctgcccgactacgccagccagccggggaagccgccccaccaccaccaccaccacaaggacgagctg

SEQ ID NO: 8284 - RNA, 1941 nt, synthetic construct; identical to SEQ ID NO: 8283
  misc_feature 1..1941: note = derived and/or modified sequence opt1 from Oportuzumab_monatox_SingleChain_variable_fragment
  source 1..1941: mol_type = other RNA

SEQ ID NO: 8285 - RNA, 762 nt, synthetic construct
  misc_feature 1..762: note = derived and/or modified sequence opt1 from Oreptacog_alfa_HeavyChain1
  source 1..762: mol_type = other RNA
atcgtgggcgggaaggtctgccccaagggcgagtgcccgtggcaggtcctgctcctggtgaacggggcccagctgtgcggcgggaccctcatcaacaccatctgggtggtgagcgccgcgcactgcttcgacaagatcaagaactggcgcaacctgatcgccgtgctgggcgagcacgacctctccgagcacgacggcgacgagcagagccggcgcgtcgcccaggtgatcatcccctccacgtacgtgcccgggaccaccaaccacgacatcgccctgctgcggctccaccagcccgtcaacctgaccgaccacgtggtgccgctgtgcctccccgagcgcacgttcagcgagcggaccctggccttcgtccgcttctccctggtgagcggctgggggcagctcctggaccggggcgcgaccgccctggagctcatggtgctgaacgtcccccgcctgatgacccaggactgcctccagcagtcccggaaggtgggggacagccccaacatcacggagtacatgttctgcgccggctactccgacggcagcaaggactcctgcaagggggacagcggcgggccgcacgccacccactaccgcggcacctggtacctgaccggcatcgtgtcctgggggcagggctgcgcgacggtcgggcacttcggcgtgtacacccgggtgagccagtacatcgagtggctgcagaagctcatgcgctccgagccccggcccggggtcctgctgcgcgcccccttcccg

SEQ ID NO: 8286 - RNA, 456 nt, synthetic construct
  misc_feature 1..456: note = derived and/or modified sequence opt1 from Oreptacog_alfa_LightChain1
  source 1..456: mol_type = other RNA
gccaacgccttcctggaggagctccgccagggcagcctggagcgggagtgcaaggaggagcagtgctccttcgaggaggcgcgcgagatcttcgaggacgaggaggagaccaagctgttctggatcagctactccgacggggaccagtgcgccagctccccctgccagaacggcgggagctgcaaggaccagctccagtcctacatctgcttctgcctgccggccttcgagggccggaactgcgagacccacaaggacgaccagctgatctgcgtgaacgagaacgggggctgcgagcagtactgcagcgaccacaacggcacgaagcgctcctgccggtgccacgaggggtacagcctcctggccgacggcgtctcctgcacccccaccgtggagtacccctgcgggaagatccccatcctggagaagcgcaacgccagcaagccgcagggccgg

SEQ ID NO: 8287 - RNA, 1353 nt, synthetic construct
  misc_feature 1..1353: note = derived and/or modified sequence opt1 from Orticumab_HeavyChain1
  source 1..1353: mol_type = other RNA
gaggtgcagctgctcgagagcggcgggggcctggtccagcccgggggctccctgcgcctcagctgcgccgcctccgggttcaccttcagcaacgcgtggatgtcctgggtgcggcaggccccgggcaagggcctggagtgggtgagctccatcagcgtcgggggccaccgcacctactacgccgactccgtgaaggggcggagcacgatctcccgcgacaacagcaagaacaccctgtacctccagatgaactccctgcgggccgaggacaccgccgtgtactactgcgcgcgcatccgggtcggccccagcgggggcgccttcgactactggggccaggggaccctggtgacggtgtccagcgcctccaccaagggccccagcgtcttccccctcgccccgtccagcaagagcacctccgggggcaccgcggccctgggctgcctggtgaaggactacttccccgagcccgtgacggtcagctggaactccggggccctcaccagcggcgtgcacaccttccccgccgtgctgcagtccagcgggctgtactccctcagctccgtcgtgaccgtgccgagctccagcctgggcacgcagacctacatctgcaacgtcaaccacaagccctccaacaccaaggtggacaagaaggtggagcccaagagctgcgacaagacccacacgtgcccgccctgccccgcccccgagctgctcgggggcccctccgtcttcctgttcccgcccaagcccaaggacaccctgatgatcagccgcacccccgaggtgacctgcgtggtcgtggacgtctcccacgaggacccggaggtgaagttcaactggtacgtggacggcgtcgaggtgcacaacgcgaagacgaagccccgggaggagcagtacaacagcacctaccgcgtggtctccgtgctcaccgtgctgcaccaggactggctgaacgggaaggagtacaagtgcaaggtcagcaacaaggccctccccgcccccatcgagaagaccatcagcaaggccaagggccagccgcgggagccccaggtgtacacgctgccgccctcccgcgacgagctgaccaagaaccaggtgagcctgacctgcctcgtcaaggggttctacccctccgacatcgccgtggagtgggagagcaacggccagcccgagaacaactacaagaccacgcccccggtgctggactccgacgggagcttcttcctctactccaagctgaccgtcgacaagagccggtggcagcagggcaacgtgttctcctgcagcgtgatgcacgaggcgctgcacaaccactacacccagaagtccctcagcctgtcccccggcaag

SEQ ID NO: 8288 - RNA, 648 nt, synthetic construct
  misc_feature 1..648: note = derived and/or modified sequence opt1 from Orticumab_LightChain1
  source 1..648: mol_type = other RNA
cagagcgtgctgacccagcccccgtccgccagcggcacccccgggcagcgcgtcacgatctcctgcagcggctccaacaccaacatcgggaagaactacgtgagctggtaccagcagctccccggcaccgcccccaagctgctgatctacgcgaactccaaccggccgagcggggtgcccgaccgcttctccggcagcaagtccggcaccagcgcctccctcgccatcagcgggctgcggtccgaggacgaggccgactactactgcgccagctgggacgcgtccctgaacggctgggtcttcgggggcgggacgaagctcaccgtgctgggccagcccaaggccgcccccagcgtgaccctgttcccgccctccagcgaggagctccaggccaacaaggcgaccctggtctgcctgatcagcgacttctaccccggcgccgtgacggtggcctggaaggccgactccagccccgtcaaggccggggtggagaccaccaccccgtccaagcagagcaacaacaagtacgcggcctccagctacctctccctgacgcccgagcagtggaagtcccaccgcagctacagctgccaggtgacccacgagggctccaccgtcgagaagaccgtggcccccacggagtgcagc

SEQ ID NO: 8289 - RNA, 1347 nt, synthetic construct
  misc_feature 1..1347: note = derived and/or modified sequence opt1 from Otelixizumab_HeavyChain1
  source 1..1347: mol_type = other RNA
gaggtgcagctgctcgagagcggcgggggcctggtccagcccgggggctccctgcgcctcagctgcgccgcctccgggttcaccttcagctccttcccgatggcgtgggtgcggcaggcccccggcaagggcctggagtgggtgagcaccatctccacgagcgggggccgcacctactaccgggactccgtcaaggggcgcttcaccatcagccgggacaactccaagaacaccctgtacctccagatgaacagcctgcgcgccgaggacacggccgtgtactactgcgccaagttccggcagtactccggcgggttcgactactggggccagggcaccctggtgaccgtcagctccgcgagcaccaaggggccctccgtgttccccctcgccccgagctccaagagcacgagcggcgggaccgccgccctgggctgcctggtgaaggactacttccccgagcccgtcaccgtgtcctggaacagcggcgcgctcacctccggggtgcacacgttccccgccgtcctgcagagctccggcctgtacagcctctccagcgtggtgaccgtcccgtccagctccctggggacccagacctacatctgcaacgtgaaccacaagcccagcaacacgaaggtggacaagaaggtcgagcccaagtcctgcgacaagacccacacgtgcccgccctgccccgcccccgagctgctcggcgggcccagcgtgttcctgttcccgcccaagcccaaggacaccctgatgatctcccgcacccccgaggtgacctgcgtcgtggtggacgtcagccacgaggacccggaggtgaagttcaactggtacgtcgacggcgtggaggtgcacaacgccaagaccaagccccgggaggagcagtacgcctccacctaccgcgtcgtgagcgtgctcacggtcctgcaccaggactggctgaacggcaaggagtacaagtgcaaggtgtccaacaaggcgctccccgcccccatcgagaagaccatcagcaaggccaaggggcagccgcgggagccccaggtgtacaccctgccgcccagccgcgacgagctgaccaagaaccaggtctccctcacgtgcctggtgaagggcttctaccccagcgacatcgccgtggagtgggagtccaacgggcagcccgagaacaactacaagaccacgcccccggtcctggacagcgacggctccttcttcctctacagcaagctgaccgtggacaagtcccggtggcagcaggggaacgtgttcagctgctccgtcatgcacgaggccctgcacaaccactacacccagaagtccctcagcctgagccccggcaag

SEQ ID NO: 8290 - RNA, 648 nt, synthetic construct
  misc_feature 1..648: note = derived and/or modified sequence opt1 from Otelixizumab_LightChain1
  source 1..648: mol_type = other RNA
gacatccagctgacccagcccaacagcgtgtccaccagcctcggctccacggtcaagctgagctgcaccctgtccagcgggaacatcgagaacaactacgtgcactggtaccagctctacgagggccgctccccgaccaccatgatctacgacgacgacaagcggcccgacggggtgcccgaccgcttcagcggctccatcgaccggagctccaacagcgccttcctgacgatccacaacgtcgccatcgaggacgaggcgatctacttctgccactcctacgtgagctccttcaacgtgttcgggggcggcaccaagctgaccgtcctccgccagcccaaggccgccccgagcgtgaccctgttcccgccctccagcgaggagctgcaggccaacaaggccacgctcgtgtgcctgatctccgacttctaccccggggcggtcaccgtggcctggaaggccgacagcagccccgtgaaggccggcgtcgagaccaccacgccctccaagcagagcaacaacaagtacgcggcctccagctacctgtccctcacccccgagcagtggaagtcccaccggagctacagctgccaggtgacccacgaggggtccaccgtggagaagacggtcgcccccaccgagtgcagc

SEQ ID NO: 8291 - RNA, 1449 nt, synthetic construct
  misc_feature 1..1449: note = derived and/or modified sequence opt1 from Otlertuzumab_HeavyChain1
  source 1..1449: mol_type = other RNA
gaggtgcagctggtccagagcggcgccgaggtgaagaagcccggggagtccctcaagatcagctgcaagggctccgggtacagcttcaccggctacaacatgaactgggtgcgccagatgccggggaagggcctggagtggatgggcaacatcgacccctactacgggggcaccacgtacaaccggaagttcaaggggcaggtcaccatctccgccgacaagagcatctccaccgcgtacctgcagtggagctccctcaaggccagcgacaccgccatgtactactgcgcccgctccgtgggccccttcgacagctgggggcagggcacgctggtgaccgtctccagcggcgggggcgggtccggcggcgggggcagcgggggcgggggctccggcgggggcgggagcggcgggggcggctccgagatcgtgctgacccagagccccgccaccctcagcctgtccccgggggagcgggcgacgctgagctgccgcgcctccgagaacgtgtacagctacctcgcctggtaccagcagaagcccggccaggcgccccggctgctgatctacttcgccaagaccctcgccgaggggatccccgcccgcttctccggcagcgggtccggcaccgacttcaccctgacgatcagctccctggagccggaggacttcgccgtctactactgccagcaccacagcgacaacccctggaccttcggccaggggaccaaggtggagatcaagggcgaccaggagcccaagtccagcgacaagacccacacgagcccgccctgccccgcccccgagctcctcgggggccccagcgtgttcctgttcccgcccaagcccaaggacaccctgatgatctcccggacccccgaggtgacctgcgtcgtggtcgacgtgagccacgaggacccggaggtgaagttcaactggtacgtcgacggcgtggaggtgcacaacgcgaagacgaagccccgcgaggagcagtacaactccacctaccgggtcgtgagcgtgctgaccgtcctgcaccaggactggctcaacgggaaggagtacaagtgcaaggtgtccaacaaggccctgcccgcccccatcgagaagaccatcagcaaggccaagggccagccgcgcgagccccaggtctacacgctgccgcccagccgggacgagctcaccaagaaccaggtgtccctgacctgcctggtgaaggggttctaccccagcgacatcgccgtcgagtgggagtccaacggccagcccgagaacaactacaagaccacgcccccggtgctcgacagcgacgggtccttcttcctgtacagcaagctgaccgtggacaagtcccgctggcagcagggcaacgtcttcagctgctccgtgatgcacgaggcgctccacaaccactacacccagaagtccctgtccctgagccccggcaag

SEQ ID NO: 8292 - RNA, 1347 nt, synthetic construct
  misc_feature 1..1347: note = derived and/or modified sequence opt1 from Oxelumab_HeavyChain1
  source 1..1347: mol_type = other RNA
gaggtgcagctgctcgagagcggcgggggcctggtccagcccgggggctccctgcgcctcagctgcgccgcctccgggttcaccttcaacagctacgcgatgtcctgggtgcggcaggccccgggcaagggcctggagtgggtgagcatcatctccgggagcggcgggttcacctactacgccgactccgtcaagggccgcttcaccatcagccgggacaactcccgcaccaccctgtacctccagatgaacagcctgcgggccgaggacaccgccgtgtactactgcgcgaaggaccgcctggtggcccccgggacgttcgactactggggccagggcgccctcgtcaccgtgtccagcgcctccaccaaggggcccagcgtgttccccctggcgccgtccagcaagtccaccagcggcgggacggccgccctgggctgcctcgtcaaggactacttccccgagcccgtgaccgtgagctggaactccggcgccctgaccagcggggtccacaccttccccgccgtgctgcagtccagcggcctctactccctgagctccgtggtcacggtgccgagctccagcctggggacccagacctacatctgcaacgtgaaccacaagccctccaacaccaaggtcgacaagaaggtggagcccaagagctgcgacaagacgcacacgtgcccgccctgccccgcgcccgagctcctgggcgggccctccgtgttcctgttcccgcccaagcccaaggacaccctcatgatcagccggacccccgaggtgacctgcgtcgtggtcgacgtgtcccacgaggacccggaggtcaagttcaactggtacgtggacggcgtggaggtccacaacgccaagaccaagccccgcgaggagcagtacaacagcacctaccgggtggtgtccgtcctgaccgtgctgcaccaggactggctcaacggcaaggagtacaagtgcaaggtgagcaacaaggccctgcccgcccccatcgagaagacgatctccaaggccaaggggcagccgcgcgagccccaggtctacaccctgccgcccagccgggacgagctcaccaagaaccaggtgagcctgacctgcctggtgaagggcttctacccctccgacatcgcggtcgagtgggagagcaacgggcagcccgagaacaactacaagacgacgcccccggtgctcgactccgacggcagcttcttcctgtactccaagctgaccgtggacaagagccgctggcagcaggggaacgtcttctcctgcagcgtgatgcacgaggccctccacaaccactacacccagaagtccctgagcctgtcccccggc

SEQ ID NO: 8293 - RNA, 642 nt, synthetic construct
  misc_feature 1..642: note = derived and/or modified sequence opt1 from Oxelumab_LightChain1
  source 1..642: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccgcctccagcctgcagtccggcgtgcccagccgcttctccgggagcggctccgggaccgacttcaccctcaccatcagctccctgcagcccgaggacttcgccacgtactactgccagcagtacaacagctacccgtacaccttcggccagggcaccaagctggagatcaagcggaccgtggcggccccctccgtcttcatcttcccgcccagcgacgagcagctcaagagcgggacggcctccgtggtgtgcctgctgaacaacttctacccccgcgaggccaaggtccagtggaaggtggacaacgcgctccagagcggcaactcccaggagagcgtgaccgagcaggactccaaggacagcacctactccctgagctccaccctgacgctcagcaaggccgactacgagaagcacaaggtctacgcctgcgaggtgacccaccaggggctgtccagccccgtgaccaagtccttcaaccggggcgagtgc

SEQ ID NO: 8294 - RNA, 1329 nt, synthetic construct
  misc_feature 1..1329: note = derived and/or modified sequence opt1 from Ozanezumab_HeavyChain1
  source 1..1329: mol_type = other RNA
caggtgcagctggtccagagcggcgccgaggtgaagaagcccggggcctccgtgaaggtcagctgcaaggcgtccggctacaccttcaccagctactggatgcactgggtgcgccaggccccggggcagggcctcgagtggatcgggaacatcaacccctccaacggcggcacgaactacaacgagaagttcaagagcaaggccaccatgacccgggacacctccacgagcaccgcctacatggagctgtccagcctgcgctccgaggacaccgccgtgtactactgcgagctcatgcaggggtactggggccaggggaccctggtcacggtgagctccgcgagcaccaagggcccctccgtgttccccctggccccgagctccaagagcacctccgggggcaccgccgccctcggctgcctggtcaaggactacttccccgagcccgtgacggtgagctggaacagcggggcgctgacctccggcgtccacaccttccccgccgtgctccagagctccgggctgtacagcctgtccagcgtggtcaccgtgccgtccagctccctcggcacgcagacctacatctgcaacgtgaaccacaagcccagcaacaccaaggtcgacaagaaggtggagcccaagtcctgcgacaagacccacacgtgcccgccctgccccgcccccgagctggccggcgcccccagcgtgttcctgttcccgcccaagcccaaggacaccctcatgatctcccggacccccgaggtgacctgcgtcgtggtcgacgtgagccacgaggacccggaggtcaagttcaactggtacgtggacggggtggaggtccacaacgcgaagacgaagccccgcgaggagcagtacaactccacctaccgggtggtgagcgtcctgaccgtgctgcaccaggactggctcaacggcaaggagtacaagtgcaaggtgtccaacaaggccctgcccgcccccatcgagaagaccatcagcaaggccaaggggcagccgcgcgagccccaggtctacacgctgccgccctcccgggacgagctcaccaagaaccaggtgagcctgacctgcctggtgaagggcttctaccccagcgacatcgccgtcgagtgggagtccaacgggcagcccgagaacaactacaagaccacgcccccggtgctcgacagcgacggctccttcttcctgtacagcaagctgaccgtggacaagtcccgctggcagcagggcaacgtcttcagctgctccgtgatgcacgaggcgctccacaaccactacacccagaagtccctgagcctgagccccgggaag

SEQ ID NO: 8295 - RNA, 657 nt, synthetic construct
  misc_feature 1..657: note = derived and/or modified sequence opt1 from Ozanezumab_LightChain1
  source 1..657: mol_type = other RNA
gacatcgtgatgacccagagccccctgtccaacccggtcaccctcggccagcccgtgagcatctcctgccgcagctccaagagcctgctgtacaaggacgggaagacgtacctcaactggttcctgcagcggcccggccagagcccccagctgctcatctacctgatgtccacccgcgcctccggggtgccggaccggttcagcggcgggggctccggcaccgacttcaccctgaagatcagccgcgtcgaggccgaggacgtgggggtgtactactgccagcagctcgtcgagtaccccctgacgttcggccaggggaccaagctggagatcaagcggaccgtggcggccccctccgtgttcatcttcccgcccagcgacgagcagctcaagtccggcaccgccagcgtcgtgtgcctgctgaacaacttctacccccgcgaggccaaggtgcagtggaaggtcgacaacgccctccagtccgggaacagccaggagtccgtgacggagcaggacagcaaggacagcacctactccctgagctccaccctgaccctcagcaaggcggactacgagaagcacaaggtgtacgcctgcgaggtcacgcaccagggcctgtccagccccgtgaccaagtccttcaaccggggcgagtgc

SEQ ID NO: 8296 - RNA, 1089 nt, synthetic construct
  misc_feature 1..1089: note = derived and/or modified sequence opt1 from Ozoralizumab_HeavyChain1
  source 1..1089: mol_type = other RNA
gaggtgcagctggtcgagagcggcgggggcctcgtgcagcccgggggctccctgcgcctgagctgcgccgcctccgggttcaccttcagcgactactggatgtactgggtgcggcaggcgccgggcaagggcctcgagtgggtctccgagatcaacaccaacgggctgatcacgaagtaccccgacagcgtgaagggccgcttcaccatctcccgggacaacgccaagaacaccctgtacctccagatgaacagcctgcgccccgaggacaccgccgtgtactactgcgcccggtcccccagcgggttcaaccgcggccaggggacgctggtcaccgtgtccagcggcggcgggggctccgggggcggcagcgaggtgcagctcgtcgagtccgggggcgggctggtgcagccgggcaacagcctgcggctctcctgcgccgcgagcgggttcaccttctccagcttcggcatgagctgggtgcgccaggcccccggcaaggggctggagtgggtctccagcatctccggcagcgggtccgacaccctgtacgccgacagcgtgaagggccggttcacgatctcccgcgacaacgccaagaccaccctctacctgcagatgaacagcctgcggcccgaggacaccgcggtgtactactgcacgatcgggggctccctcagccgctccagccagggcaccctggtcaccgtgtccagcgggggcgggggctccgggggcggcagcgaggtgcagctggtcgagtccgggggcgggctcgtgcagcccggcggcagcctgcggctgtcctgcgccgccagcgggttcaccttcagcgactactggatgtactgggtgcgccaggccccgggcaaggggctcgagtgggtctccgagatcaacacgaacggcctgatcaccaagtaccccgacagcgtgaaggggcggttcaccatctcccgcgacaacgccaagaacaccctgtacctccagatgaacagcctgcggcccgaggacacggcggtgtactactgcgcccgctcccccagcggcttcaaccggggccaggggaccctggtcaccgtgtccagc

SEQ ID NO: 8297 - RNA, 1350 nt, synthetic construct
  misc_feature 1..1350: note = derived and/or modified sequence opt1 from Palivizumab_HeavyChain
  source 1..1350: mol_type = other RNA
caggtgaccctgcgcgagagcggccccgccctcgtcaagccgacccagacgctgaccctgacctgcaccttctccgggttcagcctctccacgagcggcatgtccgtggggtggatccggcagccgcccggcaaggccctggagtggctggcggacatctggtgggacgacaagaaggactacaaccccagcctcaagtcccgcctgaccatcagcaaggacacctccaagaaccaggtggtcctgaaggtgaccaacatggaccccgccgacacggccacctactactgcgcccggagcatgatcaccaactggtacttcgacgtgtggggcgccgggaccacggtcaccgtgtccagcgcgtccaccaagggccccagcgtgttccccctcgccccctccagcaagtccaccagcgggggcacggccgccctggggtgcctggtcaaggactacttcccggagcccgtgaccgtgtcctggaacagcggcgcgctcaccagcggggtccacaccttccccgccgtgctgcagtccagcggcctgtactccctcagctccgtggtcacggtgcccagctccagcctgggcacccagacctacatctgcaacgtgaaccacaagccgtccaacaccaaggtcgacaagcgcgtggagcccaagagctgcgacaagacgcacacgtgcccgccctgccccgcccccgagctgctcgggggcccctccgtgttcctgttcccgcccaagcccaaggacaccctgatgatcagccggacccccgaggtgacctgcgtcgtggtcgacgtgtcccacgaggaccccgaggtcaagttcaactggtacgtggacggggtggaggtccacaacgccaagaccaagccgcgcgaggagcagtacaacagcacctaccgggtggtgtccgtcctcaccgtgctgcaccaggactggctgaacggcaaggagtacaagtgcaaggtgagcaacaaggccctccccgcgcccatcgagaagacgatctccaaggccaagggccagccccgcgagccgcaggtctacaccctgccgcccagccgggaggagatgaccaagaaccaggtgtccctgacctgcctcgtgaaggggttctaccccagcgacatcgccgtcgagtgggagagcaacggccagcccgagaacaactacaagacgaccccgcccgtgctggactccgacgggagcttcttcctgtactccaagctcaccgtggacaagagccgctggcagcagggcaacgtcttctcctgcagcgtgatgcacgaggccctgcacaaccactacacccagaagtccctgagcctctcccccgggaag

SEQ ID NO: 8298 - RNA, 639 nt, synthetic construct
  misc_feature 1..639: note = derived and/or modified sequence opt1 from Palivizumab_LightChain
  source 1..639: mol_type = other RNA
gacatccagatgacccagagcccctccaccctgagcgcctccgtgggcgaccgcgtcacgatcacgtgcaagtgccagctcagcgtggggtacatgcactggtaccagcagaagccgggcaaggcccccaagctgctgatctacgacacctccaagctcgcgagcggggtgccctcccggttcagcggctccgggagcggcaccgagttcacgctgaccatctccagcctgcagcccgacgacttcgccacctactactgcttccagggctccgggtacccgttcaccttcggcgggggcacgaagctcgagatcaagcgcaccgtcgccgcccccagcgtgttcatcttcccgccctccgacgagcagctcaagagcgggaccgcctccgtggtctgcctgctgaacaacttctacccccgggaggcgaaggtgcagtggaaggtggacaacgccctgcagagcggcaactcccaggagagcgtcaccgagcaggacagcaaggactccacgtacagcctgtccagcaccctcaccctgtccaaggccgactacgagaagcacaaggtgtacgcctgcgaggtgacccaccagggcctgagctcccccgtcaccaagagcttcaaccgcggggagtgc

SEQ ID NO: 8299 - RNA, 360 nt, synthetic construct
  misc_feature 1..360: note = derived and/or modified sequence opt1 from Palivizumab_VH-Region
  source 1..360: mol_type = other RNA
caggtgaccctgcgcgagagcggccccgccctcgtcaagccgacccagacgctgaccctgacctgcaccttctccgggttcagcctctccacgagcggcatgtccgtggggtggatccggcagccgcccggcaaggccctggagtggctggcggacatctggtgggacgacaagaaggactacaaccccagcctcaagtcccgcctgaccatcagcaaggacacctccaagaaccaggtggtcctgaaggtgaccaacatggaccccgccgacacggccacctactactgcgcccggagcatgatcaccaactggtacttcgacgtgtggggcgccgggaccacggtcaccgtgtccagc

SEQ ID NO: 8300 - RNA, 1347 nt, synthetic construct; identical to SEQ ID NO: 7936
  misc_feature 1..1347: note = derived and/or modified sequence opt1 from Pamrevlumab_HeavyChain1
  source 1..1347: mol_type = other RNA

SEQ ID NO: 8301 - RNA, 642 nt, synthetic construct; identical to SEQ ID NO: 7937
  misc_feature 1..642: note = derived and/or modified sequence opt1 from Pamrevlumab_LightChain1
  source 1..642: mol_type = other RNA

SEQ ID NO: 8302 - RNA, 1305 nt, synthetic construct
  misc_feature 1..1305: note = derived and/or modified sequence opt1 from Panitumumab_HeavyChain1
  source 1..1305: mol_type = other RNA
caggtgcagctgcaggagagcggccccgggctcgtcaagccgtccgagaccctgagcctgacctgcacggtgtccggcgggagcgtgtccagcggcgactactactggacctggatccgccagtcccccgggaagggcctcgagtggatcggccacatctactacagcgggaacaccaactacaacccctccctcaagagccggctgaccatctccatcgacacgagcaagacccagttctccctgaagctgagctccgtcaccgccgccgacaccgcgatctactactgcgtgcgcgaccgggtgacgggcgccttcgacatctgggggcagggcaccatggtcaccgtgagctccgccagcaccaaggggccctccgtgttcccgctggccccctgcagccgcagcacgtccgagagcaccgccgcgctcggctgcctggtcaaggactacttccccgagcccgtgaccgtgtcctggaacagcggcgccctgacctccggggtccacacgttcccggccgtgctccagagctccggcctgtacagcctgtccagcgtggtcaccgtgccctccagcaacttcgggacccagacctacacgtgcaacgtggaccacaagccctccaacaccaaggtcgacgagcggaagtgctgcgtggagtgccccgccggcccgagcgtgttcctcttcccgcccaagcccaaggacaccctgatgatctcccgcacccccgaggtcacgtgcgtggtggtcgacgtgagccacgaggaccccgaggtccagttcaactggtacgtggacggcgtggaggtccacaacgcgaagaccaagccccgggaggagcagttcaactccaccttccgcgtggtgagcgtcctgaccgtggtgcaccaggactggctcaacgggaaggagtacaagtgcaaggtctccaacaagggcctgcccgccccgatcgagaagacgatcagcaagaccaaggggcagccccgggagccccaggtgtacaccctgcccccgagccgcgaggagatgaccaagaaccaggtgtccctcacgtgcctggtcaagggcttctaccccagcgacatcgccgtggagtgggagtccaacgggcagcccgagaacaactacaagaccacgcccccgatgctggacagcgacggctccttcttcctctacagcaagctgaccgtggacaagtcccggtggcagcagggcaacgtcttcagctgctccgtgatgcacgaggccctgcacaaccactacacccagaagtccctcagcctgagccccgggaag

SEQ ID NO: 8303 - RNA, 642 nt, synthetic construct
  misc_feature 1..642: note = derived and/or modified sequence opt1 from Panitumumab_LightChain1
  source 1..642: mol_type = other RNA
gacatccagatgacccagagcccctccagcctgtccgccagcgtgggcgaccgcgtcaccatcacgtgccaggcctcccaggacatcagcaactacctcaactggtaccagcagaagccggggaaggcgcccaagctgctgatctacgacgcctccaacctcgagaccggcgtgcccagccggttctccgggagcggctccgggaccgacttcaccttcacgatcagctccctgcagcccgaggacatcgccacctacttctgccagcacttcgaccacctcccgctggccttcggcggcgggaccaaggtggagatcaagcgcaccgtcgccgcgcccagcgtgttcatcttcccgccctccgacgagcagctcaagagcggcacggcctccgtggtctgcctgctgaacaacttctacccccgggaggccaaggtgcagtggaaggtggacaacgccctgcagagcgggaactcccaggagagcgtcaccgagcaggacagcaaggactccacctacagcctgtccagcaccctcacgctgtccaaggcggactacgagaagcacaaggtgtacgcctgcgaggtgacccaccagggcctgagctcccccgtcaccaagagcttcaaccgcggggagtgc

SEQ ID NO: 8304 - RNA, 1326 nt, synthetic construct
  misc_feature 1..1326: note = derived and/or modified sequence opt1 from Pankoab_HeavyChain1
  source 1..1326: mol_type = other RNA
gaggtgcagctggtcgagagcggcgggggcctcgtgcagcccgggggctcccgcctgagctgcgtggcctccgggttcccgttcagcaactactggaactgggtccggcaggcccccggcaagggcctggagtgggtgggggagatccgcctcaagtccaacaactacaccacccactacgcggagagcgtgaagggccggttcaccatctcccgcgacgacagcaagaactccctgtacctgcagaacagcctcaagaccgaggacaccgccgtctactactgcacccggcactactacttcgactactgggggcagggcacgctggtgaccgtgtccagcgcctccaccaaggggcccagcgtcttccccctggccccgtccagcaagtccaccagcggcggcacggccgcgctcgggtgcctggtgaaggactacttccccgagcccgtgaccgtctcctggaacagcggcgccctgaccagcggggtgcacaccttccccgccgtgctccagtccagcggcctgtactccctgagctccgtcgtgacggtgccgagctccagcctcggcacccagacctacatctgcaacgtcaaccacaagccctccaacaccaaggtggacaagaaggtggagcccaagagctgcgacaagacgcacacgtgcccgccctgccccgcccccgagctgctcgggggcccctccgtcttcctgttcccgcccaagcccaaggacaccctgatcagccgcacccccgaggtgacctgcgtggtcgtggacgtctcccacgaggacccggaggtgaagttcaactggtacgtggacggggtcgaggtgcacaacgcgaagaccaagccccgggaggagcagtacaacagcacctaccgcgtggtctccgtgctgaccgtgctccaccaggactggctgaacggcaaggagtacaagtgcaaggtcagcaacaaggccctgcccgcccccatcgagaagacgatctccaaggccaaggggcagccgcgggagccccaggtgtacaccctcccgcccagccgcgacgagctgaccaagaaccaggtgtccctgacctgcctcgtcaagggcttctaccccagcgacatcgccgtggagtgggagagcaacggccagcccgagaacaactacaagacgacgcccccggtgctggactccgacgggagcttcttcctgtactccaagctcaccgtcgacaagagccggtggcagcagggcaacgtgttctcctgcagcgtgcacgaggggctgcacaaccactacacccagaagtccctgagcctctcccccggcaag

SEQ ID NO: 8305 - RNA, 651 nt, synthetic construct
  misc_feature 1..651: note = derived and/or modified sequence opt1 from Pankoab_LightChain1
  source 1..651: mol_type = other RNA
gacatcgtgacccagagccccctgtccaacccggtcacccccggcgagcccgccagcatctcctgccgcagctccaagagcctcctgcactccaacgggatcacgtacttcttctggtacctgcagaagcccggccagagcccgcagctcctgatctaccagtccaacctggccagcggggtgcccgaccggttctccggcagcgggtccggcaccgacttcaccctccgcatcagccgggtggaggcggaggacgtcggcgtgtactactgcgcccagaacctggagctgccgcccaccttcgggcagggcacgaaggtggagatcaagcgcaccgtcgccgccccctccgtgttcatcttcccgcccagcgacgagcagctcaagtccgggaccgccagcgtggtctgcctgctgaacaacttctacccccgggaggcgaaggtgcagtggaaggtggacaacgccctccagtccggcaacagccaggagagcgtcaccgagcaggactccaaggacagcacgtactccctgagctccaccctgaccctcagcaaggccgactacgagaagcacaaggtgtacgcctgcgaggtgacccaccaggggctgtccagccccgtcacgaagtccttcaaccgcggcgagtgc

SEQ ID NO: 8306 - RNA, 651 nt, synthetic construct
  misc_feature 1..651: note = derived and/or modified sequence opt1 from Pankoab_LightChain2
  source 1..651: mol_type = other RNA
gacatcgtgacccagagccccctgtccaacccggtcacccccggcgagcccgccagcatctcctgccgcagctccaagagcctcctgcactccaacgggatcacgtacttcttctggtacctgcagaagcccggccagagcccgcagctcctgatctaccagtccaacctggccagcggggtgcccgaccggttctccggcagcgggtccggcaccgacttcaccctccgcatcagccgggtggaggcggaggacgtcggcgtgtactactgcgccgggaacctggagctgccgcccaccttcggccaggggacgaaggtggagatcaagcgcaccgtcgccgccccctccgtgttcatcttcccgcccagcgacgagcagctcaagtccggcaccgccagcgtggtctgcctgctgaacaacttctacccccgggaggcgaaggtgcagtggaaggtggacaacgccctccagtccgggaacagccaggagagcgtcaccgagcaggactccaaggacagcacgtactccctgagctccaccctgaccctcagcaaggccgactacgagaagcacaaggtgtacgcctgcgaggtgacccaccagggcctgtccagccccgtcacgaagtccttcaaccgcggcgagtgc

SEQ ID NO: 8307 - RNA, 351 nt, synthetic construct
  misc_feature 1..351: note = derived and/or modified sequence opt1 from PankoMab_HeavyChain_VDJ-Region
  source 1..351: mol_type = other RNA
gaggtgaagctggtcgagagcggcgggggcctcgtgcagcccgggggctccatgaagctgagctgcgtggcctccgggttcaccttcagcaactactggatgaactgggtccgccagtccccggagaagggcctggagtgggtggccgagatccggctcaagagcaacaactacaccacgcactacgcggagtccgtgaagggccgcttcaccatcagccgggacgactccaagagctccgtcagcctgcagatgaacaacctgcgcgtggaggacaccgggatctactactgcacccggcactactacttcgactactggggccaggggacgaccctcaccgtgtccagc

SEQ ID NO: 8308 - RNA, 339 nt, synthetic construct
  misc_feature 1..339: note = derived and/or modified sequence opt1 from PankoMab_LightChain_VJ-Region
  source 1..339: mol_type = other RNA
gacatcgtgatgacccaggccgccttcagcaaccccgtcaccctgggcacgtccgcgagcatctcctgccgcagctccaagagcctcctgcactccaacgggatcacctacttcttctggtacctgcagaagccgggcctcagcccccagctgctgatctaccagatgtccaacctcgccagcggggtgcccgaccggttctccagctccggcagcgggaccgacttcaccctgcgcatctcccgggtggaggccgaggacgtcggcgtgtactactgcgcccagaacctggagctgcccccgacgttcggcgggggcaccaagctcgagatcaagcgc

SEQ ID NO: 8309 - RNA, 1707 nt, synthetic construct
  misc_feature 1..1707: note = derived and/or modified sequence opt1 from Panobacumab_HeavyChain1
  source 1..1707: mol_type = other RNA
gaggagcaggtcgtggagagcggcggcggcttcgtgcagcccgggggctccctgcgcctcagctgcgccgcctccgggttcaccttcagcccgtactggatgcactgggtgcggcaggcgcccggcaagggcctggtctgggtgtcccgcatcaacagcgacgggtccacctactacgccgacagcgtgaagggccggttcacgatctcccgcgacaacgcccggaacaccctgtacctccagatgaacagcctgcgcgccgaggacaccgccgtctactactgcgcgcgggaccgctactacgggcccgagatgtggggccaggggaccatggtgacggtgtccagcggctccgccagcgcccccaccctgttcccgctcgtctcctgcgagaacagcccctccgacaccagctccgtggccgtgggctgcctggcgcaggacttcctgcccgacagcatcaccttcagctggaagtacaagaacaactccgacatcagctccacgcgggggttccccagcgtcctccgcggcgggaagtacgccgccacctcccaggtgctgctgccgagcaaggacgtgatgcagggcaccgacgagcacgtcgtgtgcaaggtgcagcaccccaacggcaacaaggagaagaacgtccccctccccgtgatcgccgagctgccgcccaaggtgtccgtcttcgtgccgccccgggacgggttcttcggcaacccccgcaagagcaagctgatctgccaggccaccgggttcagcccccggcagatccaggtgtcctggctccgcgagggcaagcaggtcgggtccggcgtgacgaccgaccaggtccaggcggaggccaaggagagcggccccaccacctacaaggtgacgtccaccctgaccatcaaggagagcgactggctgtcccagagcatgttcacgtgccgggtggaccaccgcgggctcaccttccagcagaacgcctccagcatgtgcgtccccgaccaggacaccgccatccgggtgttcgccatcccgccctccttcgcgagcatcttcctgaccaagagcaccaagctgacgtgcctcgtgaccgacctgaccacctacgactccgtcacgatcagctggacccgccagaacggcgaggccgtgaagacccacaccaacatctccgagagccaccccaacgccacgttctccgccgtgggggaggccagcatctgcgaggacgactggaactccggcgagcggttcacgtgcaccgtcacccacaccgacctgcccagcccgctcaagcagaccatctcccgccccaagggggtggcgctgcaccggcccgacgtgtacctgctgcccccggcccgcgagcagctcaacctgcgcgagagcgccaccatcacgtgcctcgtcaccggcttctcccccgccgacgtgttcgtgcagtggatgcagcggggccagcccctgagcccggagaagtacgtcacctccgcccccatgcccgagccccaggcgccggggcgctacttcgcccacagcatcctgaccgtgtccgaggaggagtggaacaccggcgagacctacacgtgcgtggtcgcccacgaggccctccccaaccgggtgaccgagcgcaccgtggacaagagcaccgggaagcccacgctgtacaacgtctccctggtgatgagcgacaccgcggggacctgctac

SEQ ID NO: 8310 - RNA, 657 nt, synthetic construct
  misc_feature 1..657: note = derived and/or modified sequence opt1 from Panobacumab_LightChain1
  source 1..657: mol_type = other RNA
gacgtggtcatgacccagagccccctgtccctcccggtgaccctgggccagcccgccagcatctcctgccggagctcccagagcctggtgtactccgacgggaacacgtacctcaactggttccagcagcggcccggccagagcccccgccggctgatctacaaggtctccaaccgcgacagcggggtgccggaccggttctccggcagcgggtccggcaccgacttcaccctgaagatcagccgcgtggaggccgaggacgtcggcgtgtactactgcatgcaggggacccactggcccctcacgttcggcgggggcaccaaggtggagatcaagcggaccgtcgcggccccctccgtgttcatcttcccgcccagcgacgagcagctgaagtccgggaccgccagcgtggtctgcctgctcaacaacttctacccccgcgaggccaaggtgcagtggaaggtggacaacgccctgcagtccggcaacagccaggagagcgtcacggagcaggactccaaggacagcacctactccctgagctccaccctcaccctgagcaaggcggactacgagaagcacaaggtgtacgcctgcgaggtgacgcaccagggcctgtccagccccgtcaccaagtccttcaaccgcggggagtgc

SEQ ID NO: 8311 - RNA, 414 nt, synthetic construct
  misc_feature 1..414: note = derived and/or modified sequence opt1 from Panobacumab_LightChain2
  source 1..414: mol_type = other RNA
ggcgacgacgaggccaccatcctggccgacaacaagtgcatgtgcacccgcgtgacgagccggatcatcccctccaccgaggacccgaacgaggacatcgtcgagcgcaacatccggatcgtggtgcccctcaacaaccgcgagaacatcagcgaccccaccagccccctgcggcgcaacttcgtctaccacctgtccgacgtgtgcaagaagtgcgacccggtggaggtcgagctcgaggaccaggtggtgaccgcgacgcagtccaacatctgcaacgaggacgacggggtccccgagacctgctacatgtacgaccggaacaagtgctacaccaccatggtgcccctgcgctaccacggcgagacgaagatggtgcaggccgccctgacccccgacagctgctacccggac

SEQ ID NO: 8312 - RNA, 1359 nt, synthetic construct
  misc_feature 1..1359: note = derived and/or modified sequence opt1 from Parsatuzumab_HeavyChain1
  source 1..1359: mol_type = other RNA
gaggtgcagctggtcgagagcggcgggggcctcgtgcagcccgggggctccctgcgcctgagctgcgccgcctccgggtacaccttcatcgactactacatgaactgggtgcggcaggcgccgggcaagggcctcgagtgggtcggggacatcaacctggacaacagcggcacccactacaaccagaagttcaaggggcgcttcacgatctcccgggacaagagcaagaacaccgcctacctgcagatgaactccctccgcgccgaggacaccgccgtgtactactgcgcccgggagggcgtgtaccacgactacgacgactacgcgatggactactgggggcagggcaccctggtcacggtgagctccgccagcaccaagggcccctccgtgttccccctggcccccagctccaagagcacctccgggggcaccgccgcgctcgggtgcctggtcaaggactacttcccggagcccgtgacggtgagctggaactccggcgccctgaccagcggcgtccacaccttccccgccgtgctccagtccagcgggctgtacagcctgtccagcgtggtcaccgtgccctccagctccctcggcacgcagacctacatctgcaacgtgaaccacaagccgagcaacaccaaggtcgacaagaaggtggagcccaagtcctgcgacaagacccacacgtgcccgccctgccccgcccccgagctgctcgggggccccagcgtgttcctgttcccgcccaagcccaaggacaccctgatgatctcccgcacccccgaggtgacctgcgtcgtggtcgacgtgagccacgaggaccccgaggtcaagttcaactggtacgtggacggggtggaggtccacaacgccaagacgaagccgcgggaggagcagtacaactccacctaccgcgtggtgagcgtcctgaccgtgctccaccaggactggctgaacggcaaggagtacaagtgcaaggtgtccaacaaggcgctgcccgcccccatcgagaagaccatcagcaaggccaagggccagccccgggagccgcaggtctacacgctcccgccctcccgcgaggagatgaccaagaaccaggtgagcctgacctgcctggtgaaggggttctacccctccgacatcgccgtcgagtgggagagcaacggccagcccgagaacaactacaagaccacgccgcccgtgctcgactccgacgggagcttcttcctgtacagcaagctgaccgtggacaagtcccggtggcagcagggcaacgtcttcagctgctccgtgatgcacgaggccctccacaaccactacacccagaagtccctgagcctgagccccgggaag

SEQ ID NO: 8313 - RNA, 657 nt, synthetic construct
  misc_feature 1..657: note = derived and/or modified sequence opt1 from Parsatuzumab_LightChain1
  source 1..657: mol_type = other RNA
gacatccagatgacccagagcccctccagcctgtccgccagcgtgggcgaccgggtcaccatcacgtgccggacctcccagagcctcgtgcacatcaacgccatcacctacctgcactggtaccagcagaagccggggaaggcgcccaagctgctcatctaccgcgtgtccaaccggttcagcggcgtcccctcccgcttcagcgggtccggcagcgggaccgacttcacgctgaccatctccagcctgcagcccgaggacttcgccacctactactgcggccagtccacccacgtgccgctcacgttcggccaggggaccaaggtggagatcaagcggaccgtcgccgcccccagcgtgttcatcttcccgccctccgacgagcagctcaagagcggcaccgcctccgtggtctgcctgctgaacaacttctacccccgcgaggcgaaggtgcagtggaaggtggacaacgccctgcagagcgggaacagccaggagtccgtcacggagcaggacagcaaggactccacctacagcctgtccagcaccctcaccctgtccaaggccgactacgagaagcacaaggtgtacgcctgcgaggtgacgcaccagggcctgagctcccccgtcaccaagagcttcaaccgcggggagtgc

SEQ ID NO: 8314 - RNA, 1353 nt, synthetic construct
  misc_feature 1..1353: note = derived and/or modified sequence opt1 from Pascolizumab_HeavyChain1
  source 1..1353: mol_type = other RNA
caggtgaccctgcgcgagagcggccccgccctcgtcaagccgacccagaccctgaccctgacctgcaccttctccgggttcagcctctccacgagcggcatgggggtgtcctggatccggcagccgcccggcaaggggctggagtggctggcccacatctactgggacgacgacaagcgctacaaccccagcctcaagtcccggctgaccatcagcaaggacacctcccgcaaccaggtggtcctgaccatgacgaacatggaccccgtggacaccgcgacctactactgcgcccggcgcgagaccgtgttctactggtacttcgacgtctggggccggggcacgcccgtgaccgtgagctccgccagcaccaaggggccctccgtcttccccctcgccccgagctccaagagcacctccggcgggacggccgcgctgggctgcctggtgaaggactacttccccgagcccgtgaccgtcagctggaactccggggccctcaccagcggcgtgcacaccttccccgccgtgctgcagagctccggcctgtacagcctctccagcgtcgtgacggtgccgtccagctccctggggacccagacctacatctgcaacgtcaaccacaagcccagcaacaccaaggtggacaagcgcgtggagcccaagtcctgcgacaagacgcacacgtgcccgccctgccccgcccccgagctgctcggcgggcccagcgtcttcctgttcccgcccaagcccaaggacaccctgatgatctcccggacccccgaggtgacctgcgtggtcgtggacgtcagccacgaggacccggaggtgaagttcaactggtacgtggacggcgtcgaggtgcacaacgcgaagaccaagccccgcgaggagcagtacaactccacctaccgggtggtcagcgtgctcaccgtgctgcaccaggactggctgaacggcaaggagtacaagtgcaaggtctccaacaaggccctccccgcccccatcgagaagacgatcagcaaggccaaggggcagccgcgcgagccccaggtgtacaccctgcccccgtcccgggaggagatgaccaagaaccaggtgagcctgacctgcctcgtcaagggcttctacccctccgacatcgccgtggagtgggagagcaacgggcagcccgagaacaactacaagacgacgcccccggtgctggacagcgacggctccttcttcctgtacagcaagctcaccgtcgacaagtcccgctggcagcaggggaacgtgttcagctgctccgtgatgcacgaggcgctgcacaaccactacacccagaagtccctgagcctcagccccggcaag

SEQ ID NO: 8315 - RNA, 654 nt, synthetic construct
  misc_feature 1..654: note = derived and/or modified sequence opt1 from Pascolizumab_LightChain1
  source 1..654: mol_type = other RNA
gacatcgtgctgacccagagcccctccagcctctccgccagcgtcggcgaccgcgtgaccatcacgtgcaaggcctcccagagcgtggactacgacggggactcctacatgaactggtaccagcagaagccgggcaaggcgcccaagctgctgatctacgccgccagcaacctcgagtccgggatccccagccggttctccggcagcgggtccggcaccgacttcaccttcaccatcagctccctgcagcccgaggacatcgccacgtactactgccagcagagcaacgaggacccgcccaccttcggccaggggaccaaggtcgagatcaagcgcaccgtggccgcgccctccgtgttcatcttcccgcccagcgacgagcagctgaagtccggcacggccagcgtcgtgtgcctcctgaacaacttctacccccgggaggccaaggtgcagtggaaggtcgacaacgccctgcagagcgggaactcccaggagagcgtgaccgagcaggactccaaggacagcacctactccctcagctccaccctgacgctgagcaaggcggactacgagaagcacaaggtgtacgcctgcgaggtcacccaccagggcctctccagccccgtgaccaagtccttcaaccgcggggagtgc

SEQ ID NO: 8316 - RNA, 1512 nt, synthetic construct
  misc_feature 1..1512: note = derived and/or modified sequence opt1 from Pasotuxizumab_HeavyChain1
  source 1..1512: mol_type = other RNA
caggtgcagctggtcgagagcggcgggggcctcgtgaagcccggggagtccctgcgcctgagctgcgccgcctccggcttcaccttcagcgactactacatgtactgggtgcggcaggcgccggggaagggcctcgagtgggtcgccatcatctccgacggcgggtactacacctactacagcgacatcatcaagggccgcttcacgatctcccgggacaacgccaagaacagcctgtacctgcagatgaactccctcaaggccgaggacaccgccgtgtactactgcgcgcgcgggttccccctgctgcggcacggcgccatggactactgggggcagggcaccctcgtgaccgtcagctccggcgggggcgggagcggcggcgggggctccgggggcgggggcagcgacatccagatgacgcagtcccccagctccctgagcgcctccgtgggcgaccgcgtgaccatcacgtgcaaggccagccagaacgtcgacaccaacgtggcgtggtaccagcagaagcccgggcaggcccccaagagcctgatctactccgccagctaccggtactccgacgtgcccagccgcttctccggcagcgcctccgggaccgacttcaccctcaccatcagctccgtccagagcgaggacttcgccacctactactgccagcagtacgactcctacccctacacgttcggcgggggcaccaagctggagatcaagagcggcgggggcgggtccgaggtgcagctggtggagagcggcgggggcctcgtccagcccggcgggtccctgaagctgagctgcgcggcctccggcttcaccttcaacaagtacgccatgaactgggtgcggcaggccccggggaagggcctcgagtgggtggcccgcatccggagcaagtacaacaactacgcgacctactacgccgactccgtcaaggaccgcttcacgatcagccgggacgacagcaagaacaccgcctacctgcagatgaacaacctgaagaccgaggacaccgccgtgtactactgcgtgcgccacggcaacttcgggaactcctacatcagctactgggcctactggggccaggggacgctcgtcaccgtgtccagcggcgggggcggctccgggggcgggggcagcgggggcggcgggtcccagaccgtggtcacccaggagcccagcctgacggtgtcccccggcgggaccgtcaccctgacctgcggcagctccacgggggcggtgaccagcggcaactaccccaactgggtgcagcagaagccgggccaggccccgcgggggctcatcggcgggaccaagttcctggcccccggcacccccgcccgcttctccgggagcctgctcggcggcaaggccgcgctgacgctgtccggggtccagccggaggacgaggccgagtactactgcgtgctctggtacagcaaccggtgggtgttcggcgggggcaccaagctgaccgtcctgcaccaccaccaccaccac

SEQ ID NO: 8317 - RNA, 1512 nt, synthetic construct
  misc_feature 1..1512: note = derived and/or modified sequence opt1 from Pasotuxizumab_SingleChain
  source 1..1512: mol_type = other RNA
caggtgcagctggtccagagcggcgggggcctcgtgaagcccggggagtccctgcgcctgagctgcgccgcctccggcttcaccttcagcgactactacatgtactgggtgcggcaggcgccggggaagggcctcgagtgggtcgccatcatctccgacggcgggtactacacctactacagcgacatcatcaagggccgcttcacgatctcccgggacaacgccaagaacagcctgtacctgcagatgaactccctcaaggccgaggacaccgccgtgtactactgcgcgcgcgggttccccctgctgcggcacggcgccatggactactgggggcagggcaccctcgtgaccgtcagctccggcgggggcgggagcggcggcgggggctccgggggcgggggcagcgacatccagatgacgcagtcccccagctccctgagcgcctccgtgggcgaccgcgtgaccatcacgtgcaaggccagccagaacgtcgacaccaacgtggcgtggtaccagcagaagcccgggcaggcccccaagagcctgatctactccgccagctaccggtactccgacgtgcccagccgcttctccggcagcgcctccgggaccgacttcaccctcaccatcagctccgtccagagcgaggacttcgccacctactactgccagcagtacgactcctacccctacacgttcggcgggggcaccaagctggagatcaagagcggcgggggcgggtccgaggtgcagctggtggagagcggcgggggcctcgtccagcccggcgggtccctgaagctgagctgcgcggcctccggcttcaccttcaacaagtacgccatgaactgggtgcggcaggccccggggaagggcctcgagtgggtggcccgcatccggagcaagtacaacaactacgcgacctactacgccgactccgtcaaggaccgcttcacgatcagccgggacgacagcaagaacaccgcctacctgcagatgaacaacctgaagaccgaggacaccgccgtgtactactgcgtgcgccacggcaacttcgggaactcctacatcagctactgggcctactggggccaggggacgctcgtcaccgtgtccagcggcgggggcggctccgggggcgggggcagcgggggcggcgggtcccagaccgtggtcacccaggagcccagcctgacggtgtcccccggcgggaccgtcaccctgacctgcggcagctccacgggggcggtgaccagcggcaactaccccaactgggtgcagcagaagccgggccaggccccgcgggggctcatcggcgggaccaagttcctggcccccggcacccccgcccgcttctccgggagcctgctcggcggcaaggccgcgctgacgctgtccggggtccagccggaggacgaggccgagtactactgcgtgctctggtacagcaaccggtgggtgttcggcgggggcaccaagctgaccgtcctgcaccaccaccaccaccac

SEQ ID NO: 8318 - RNA, 1341 nt, synthetic construct
  misc_feature 1..1341: note = derived and/or modified sequence opt1 from Pateclizumab_HeavyChain1
  source 1..1341: mol_type = other RNA
gaggtgcagctggtcgagagcggcgggggcctcgtgcagcccgggggctccctgcgcctgagctgcgccgcctccgggtacaccttcaccagctacgtgatccactgggtccggcaggcgcccggcaagggcctcgagtgggtggggtacaacaacccctacaacgccggcacgaactacaacgagaagttcaaggggcgcttcaccatctccagcgacaagtccaagaacaccgcctacctgcagatgaacagcctgcgggccgaggacaccgccgtgtactactgctcccgccccacgatgctcccctggttcgcgtactggggccaggggaccctggtcaccgtgagctccgccagcaccaagggcccgtccgtgttccccctggcccccagctccaagagcacgtccggcgggaccgccgcgctcggctgcctggtcaaggactacttccccgagccggtgaccgtgagctggaactccggggccctgaccagcggcgtccacacgttccccgccgtgctccagagctccggcctgtacagcctgtccagcgtggtcaccgtgccctccagctccctcgggacccagacctacatctgcaacgtgaaccacaagcccagcaacacgaaggtcgacaagaaggtggagccgaagtcctgcgacaagacccacacgtgcccgccctgccccgcccccgagctgctgggcgggcccagcgtgttcctcttcccgcccaagcccaaggacaccctgatgatctcccggacccccgaggtgacctgcgtcgtggtcgacgtgagccacgaggaccccgaggtcaagttcaactggtacgtggacggcgtggaggtccacaacgccaagaccaagccccgcgaggagcagtacaactccacctaccgggtggtgagcgtcctgacggtgctccaccaggactggctgaacgggaaggagtacaagtgcaaggtgtccaacaaggcgctgccggcccccatcgagaagaccatcagcaaggccaagggccagccccgcgagccccaggtctacaccctcccgccctcccgggaggagatgaccaagaaccaggtgagcctgacgtgcctggtgaagggcttctacccctccgacatcgccgtcgagtgggagagcaacgggcagccggagaacaactacaagaccaccccgcccgtgctcgacagcgacggctccttcttcctgtacagcaagctgaccgtggacaagtcccgctggcagcaggggaacgtcttcagctgctccgtgatgcacgaggccctccacaaccactacacgcagaagtccctgagcctgagccccggc

SEQ ID NO: 8319 - RNA, 642 nt, synthetic construct
  misc_feature 1..642: note = derived and/or modified sequence opt1 from Pateclizumab_LightChain1
  source 1..642: mol_type = other RNA
gacatccagatgacgcagagcccctccagcctgtccgccagcgtgggcgaccgcgtcaccatcacgtgccgggcctcccaggcggtgagctccgccgtggcctggtaccagcagaagccggggaaggcccccaagctcctgatctacagcgcctcccaccgctacaccggcgtccccagccggttctccgggagcggctccgggaccgacttcaccctgacgatcagctccctccagcccgaggacttcgcgacctactactgccaggagagctactccaccccgtggaccttcggccagggcacgaaggtggagatcaagcgcaccgtggccgcccccagcgtcttcatcttcccgccctccgacgagcagctcaagagcgggaccgccagcgtggtgtgcctgctgaacaacttctacccccgggaggcgaaggtccagtggaaggtggacaacgccctgcagtccggcaacagccaggagtccgtgaccgagcaggacagcaaggactccacgtacagcctgtccagcaccctcaccctgtccaaggccgactacgagaagcacaaggtctacgcctgcgaggtgacccaccaggggctgagctcccccgtgaccaagagcttcaaccgcggcgagtgc

SEQ ID NO: 8320 - RNA, 1341 nt, synthetic construct
  misc_feature 1..1341: note = derived and/or modified sequence opt1 from Patritumab_HeavyChain1
  source 1..1341: mol_type = other RNA
caggtgcagctgcagcagtggggcgccgggctcctgaagcccagcgagaccctgtccctgacctgcgccgtctacggcgggagcttctccggctactactggagctggatccgccagccgcccgggaagggcctggagtggatcggcgagatcaaccactccgggagcacgaactacaacccctccctcaagagccgggtgaccatctccgtggagaccagcaagaaccagttctccctcaagctgagctccgtcaccgcggccgacacggccgtgtactactgcgcccgcgacaagtggacctggtacttcgacctgtggggccgggggaccctcgtgaccgtcagctccgccagcacgaagggcccctccgtgttcccgctggcgcccagctccaagagcaccagcgggggcaccgccgccctgggctgcctcgtgaaggactacttccccgagcccgtcaccgtgtcctggaacagcggggccctgacgtccggcgtgcacaccttcccggcggtcctgcagagctccgggctctacagcctgtccagcgtggtgaccgtcccctccagctccctgggcacccagacgtacatctgcaacgtgaaccacaagcccagcaacaccaaggtggacaagcgcgtcgagcccaagtcctgcgacaagacccacacgtgcccgccctgccccgcccccgagctcctgggcgggccgagcgtgttcctgttcccgcccaagcccaaggacaccctcatgatctcccggacccccgaggtgacctgcgtcgtggtggacgtcagccacgaggaccccgaggtgaagttcaactggtacgtcgacggcgtggaggtgcacaacgccaagaccaagccccgcgaggagcagtacaactccacgtaccgggtcgtgagcgtgctgaccgtcctgcaccaggactggctcaacgggaaggagtacaagtgcaaggtgtccaacaaggccctgcccgccccgatcgagaagaccatcagcaaggcgaagggccagccccgcgagccccaggtgtacaccctgcccccgagccgggaggagatgacgaagaaccaggtctccctgacctgcctcgtgaaggggttctaccccagcgacatcgccgtggagtgggagtccaacggccagcccgagaacaactacaagaccaccccgcccgtcctggacagcgacggctccttcttcctctacagcaagctgacggtggacaagtcccgctggcagcaggggaacgtgttcagctgctccgtcatgcacgaggccctgcacaaccactacacccagaagtccctcagcctgagccccggcaag

SEQ ID NO: 8321 - RNA, 681 nt, synthetic construct; identical to SEQ ID NO: 8277
  misc_feature 1..681: note = derived and/or modified sequence opt1 from Patritumab_hinge-CH2-CH3
  source 1..681: mol_type = other RNA

SEQ ID NO: 8322 - RNA, 660 nt, synthetic construct
  misc_feature 1..660: note = derived and/or modified sequence opt1 from Patritumab_LightChain1
  source 1..660: mol_type = other RNA
gacatcgagatgacccagagccccgactccctggccgtgagcctcggcgagcgcgccaccatcaactgccggtccagccagtccgtcctgtacagctccagcaaccgcaactacctggcgtggtaccagcagaacccggggcagccgcccaagctcctgatctactgggcctccacgcgggagagcggcgtgcccgaccgcttctccgggagcggctccgggaccgacttcaccctgaccatcagctccctccaggccgaggacgtggccgtctactactgccagcagtactacagcacgccccggaccttcggccagggcaccaaggtggagatcaagcgcaccgtggccgcgccctccgtcttcatcttcccgcccagcgacgagcagctgaagtccgggacggccagcgtggtgtgcctgctcaacaacttctacccccgggaggccaaggtccagtggaaggtggacaacgccctgcagagcggcaactcccaggagagcgtgaccgagcaggactccaaggacagcacctactccctgagctccaccctcacgctgagcaaggcggactacgagaagcacaaggtctacgcctgcgaggtgacccaccaggggctgtccagccccgtgaccaagtccttcaaccgcggcgagtgc

SEQ ID NO: 8323 - RNA, 1341 nt, synthetic construct; identical to SEQ ID NO: 8138
  misc_feature 1..1341: note = derived and/or modified sequence opt1 from Pembrolizumab_HeavyChain1
  source 1..1341: mol_type = other RNA

SEQ ID NO: 8324 - RNA, 654 nt, synthetic construct; identical to SEQ ID NO: 8139
  misc_feature 1..654: note = derived and/or modified sequence opt1 from Pembrolizumab_LightChain1
  source 1..654: mol_type = other RNA

SEQ ID NO: 8325 - RNA, 1356 nt, synthetic construct
  misc_feature 1..1356: note = derived and/or modified sequence opt1 from Perakizumab_HeavyChain1
  source 1..1356: mol_type = other RNA
gaggtgcagctggtcgagagcggcgggggcctcgtgcagcccgggggctccctgcgcctgagctgcgccgcctccgggttcaccttcagcgactacaccatgctctgggtgcggcaggcgccgggcaagggcctggagtgggtcgccatcatcaagtccgggggcagctactcctactaccccgacagcgtgaaggggcgcttcacgatctcccgggacaacgccaagaacagcctgtacctccagatgaactccctgcgcgccgaggacaccgccgtgtactactgcgcgcgggacggcgactacgggagctcctacggcgccatggactactggggccaggggaccctggtcaccgtgagctccgccagcacgaagggcccctccgtgttccccctcgccccgagctccaagagcaccagcgggggcaccgcggccctgggctgcctggtcaaggactacttccccgagcccgtgaccgtgtcctggaacagcggggccctcacgtccggcgtccacaccttccccgccgtgctgcagagctccgggctgtacagcctctccagcgtggtcaccgtgccgtccagctccctgggcacccagacgtacatctgcaacgtgaaccacaagcccagcaacaccaaggtcgacaagaaggtggagcccaagtcctgcgacaagacccacacgtgcccgccctgccccgcccccgaggcggccgggggccccagcgtgttcctgttcccgcccaagcccaaggacaccctcatgatctcccgcacccccgaggtgacctgcgtcgtggtcgacgtgagccacgaggacccggaggtcaagttcaactggtacgtggacggcgtggaggtccacaacgccaagaccaagccccgggaggagcagtacaactccacgtaccgcgtggtgagcgtcctgaccgtgctgcaccaggactggctcaacgggaaggagtacaagtgcaaggtgtccaacaaggccctgcccgcccccatcgagaagaccatcagcaaggcgaagggccagccgcgggagccccaggtctacaccctgccgcccagccgcgacgagctcacgaagaaccaggtgtccctgacctgcctggtgaaggggttctaccccagcgacatcgccgtcgagtgggagtccaacggccagcccgagaacaactacaagaccacgcccccggtgctcgacagcgacgggtccttcttcctgtacagcaagctgaccgtggacaagtcccggtggcagcagggcaacgtcttcagctgctccgtgatgcacgaggccctccacaaccactacacccagaagtccctgagcctgagccccggcaag

SEQ ID NO: 8326 - RNA, 645 nt, synthetic construct
  misc_feature 1..645: note = derived and/or modified sequence opt1 from Perakizumab_LightChain1
  source 1..645: mol_type = other RNA
gacatccagatgacgcagagcccctccagcctgtccgccagcgtgggcgaccgcgtcaccatcacgtgccgggcctcccaggacatcaacagctacctctcctggttccagcagaagccggggaaggcgcccaagagcctgatcgtgcgcgccaaccggctggtggacggcgtcccctcccgcttcagcgggtccggcagcgggcaggactactccctcaccatcagctccctgcagcccgaggacttcgccacctactactgcctgcagtacgacgccttcccgccctacaccttcggccagggcacgaagctcgagatcaagcggaccgtggccgcgcccagcgtgttcatcttcccgccctccgacgagcagctcaagagcgggaccgcctccgtcgtgtgcctgctgaacaacttctacccccgcgaggccaaggtgcagtggaaggtcgacaacgccctgcagagcggcaacagccaggagtccgtgaccgagcaggacagcaaggactccacgtacagcctgtccagcaccctcaccctgtccaaggcggactacgagaagcacaaggtgtacgcctgcgaggtcacccaccaggggctgagctcccccgtgaccaagagcttcaaccggggcgagtgc

SEQ ID NO: 8327 - RNA, 1332 nt, synthetic construct
  misc_feature 1..1332: note = derived and/or modified sequence opt1 from Pertuzuab_HeavyChain1
  source 1..1332: mol_type = other RNA
gaggtgcagctggtcgagagcggcgggggcctcgtgcagcccgggggctccctgcgcctgagctgcgccgcctccgggttcaccttcaccgactacacggactgggtgcggcaggcgccgggcaagggcctcgagtgggtcgccgacgtgaaccccaacagcgggggctccatctacaaccagcgcttcaaggggcggttcaccctgagcgtggaccgctccaagaacaccctgtacctccagaacagcctgcgggccgaggacaccgccgtctactactgcgcccgcaacctgggcccctccttctacttcgactactgggggcagggcacgctcgtgaccgtgagctccgcgagcaccaagggcccctccgtcttcccgctggcccccagctccaagagcacctccgggggcacggccgccctggggtgcctcgtgaaggactacttccccgagcccgtgaccgtcagctggaactccggcgcgctgaccagcggcgtgcacaccttcccggccgtgctgcagagctccgggctctacagcctgtccagcgtcgtgacggtgccctccagctccctgggcacccagacctacatctgcaacgtcaaccacaagcccagcaacaccaaggtggacaagaaggtggagcccaagtcctgcgacaagacgcacacgtgcccgccctgccccgcccccgagctcctcgggggcccgagcgtcttcctgttcccgcccaagcccaaggacaccctcatctcccggacccccgaggtgacctgcgtggtcgtggacgtcagccacgaggaccccgaggtgaagttcaactggtacgtggacggggtcgaggtgcacaacgccaagaccaagccccgcgaggagcagtacaactccacctaccgggtggtcagcgtgctgaccgtgctgcaccaggactggctcaacggcaaggagtacaagtgcaaggtctccaacaaggccctgcccgcgccgatcgagaagacgatcagcaaggccaagggccagccccgcgagccccaggtgtacaccctgcccccgtcccgggaggagaccaagaaccaggtgagcctgacctgcctggtcaaggggttctacccctccgacatcgccgtggagtgggagagcaacggccagcccgagaacaactacaagacgaccccgcccgtgctggacagcgacgggtccttcttcctctacagcaagctgaccgtcgacaagtcccgctggcagcagggcaacgtgttcagctgctccgtgcacgaggccctgcacaaccactacacccagaagtccctcagcctgagccccgggaag

SEQ ID NO: 8328 - RNA, 639 nt, synthetic construct
  misc_feature 1..639: note = derived and/or modified sequence opt1 from Pertuzuab_LightChain1
  source 1..639: mol_type = other RNA
gacatccagacccagagcccctccagcctgtccgccagcgtgggcgaccgggtcaccatcacgtgcaaggcctcccaggacgtgagcatcggggtggcgtggtaccagcagaagccgggcaaggcccccaagctcctgatctactccgccagctaccggtacaccggggtcccctcccgcttcagcggctccgggagcggcaccgacttcaccctgacgatctccagcctccagcccgaggacttcgccacctactactgccagcagtactacatctacccgtacaccttcggccaggggaccaaggtggagatcaagcggacggtggccgcgccctccgtcttcatcttcccgcccagcgacgagcagctgaagtccggcaccgccagcgtggtgtgcctgctcaacaacttctacccccgcgaggccaaggtccagtggaaggtggacaacgccctgcagtccgggaacagccaggagagcgtgaccgagcaggactccaaggacagcacctactccctgagctccacgctcaccctgagcaaggcggactacgagaagcacaaggtctacgcctgcgaggtgacccaccagggcctgtccagccccgtgaccaagtccttcaaccgcggggagtgc

SEQ ID NO: 8329 - RNA, 642 nt, synthetic construct
  misc_feature 1..642: note = derived and/or modified sequence opt1 from Pertuzumab_HeavyChain
  source 1..642: mol_type = other RNA
gacatccagatgacccagagcccctccagcctgtccgccagcgtgggcgaccgggtcaccatcacgtgcaaggcctcccaggacgtgagcatcggggtggcgtggtaccagcagaagccgggcaaggcccccaagctcctgatctactccgccagctaccggtacaccggggtcccctcccgcttcagcggctccgggagcggcaccgacttcaccctgacgatctccagcctccagcccgaggacttcgccacctactactgccagcagtactacatctacccgtacaccttcggccaggggaccaaggtggagatcaagcggacggtggccgcgccctccgtcttcatcttcccgcccagcgacgagcagctgaagtccggcaccgccagcgtggtgtgcctgctcaacaacttctacccccgcgaggccaaggtccagtggaaggtggacaacgccctgcagtccgggaacagccaggagagcgtgaccgagcaggactccaaggacagcacctactccctgagctccacgctcaccctgagcaaggcggactacgagaagcacaaggtctacgcctgcgaggtgacccaccagggcctgtccagccccgtgaccaagtccttcaaccgcggggagtgc

SEQ ID NO: 8330 - RNA, 1344 nt, synthetic construct
  misc_feature 1..1344: note = derived and/or modified sequence opt1 from Pertuzumab_LightChain
  source 1..1344: mol_type = other RNA
gaggtgcagctggtcgagagcggcgggggcctcgtgcagcccgggggctccctgcgcctgagctgcgccgcctccgggttcaccttcaccgactacacgatggactgggtgcggcaggcgccgggcaagggcctcgagtgggtcgccgacgtgaaccccaacagcgggggctccatctacaaccagcgcttcaaggggcggttcaccctgagcgtggaccgctccaagaacaccctgtacctccagatgaacagcctgcgggccgaggacaccgccgtctactactgcgcccgcaacctgggcccctccttctacttcgactactgggggcagggcacgctcgtgaccgtgagctccgcgagcaccaagggcccctccgtcttcccgctggcccccagctccaagagcacctccgggggcacggccgccctggggtgcctcgtgaaggactacttccccgagcccgtgaccgtcagctggaactccggcgcgctgaccagcggcgtgcacaccttcccggccgtgctgcagagctccgggctctacagcctgtccagcgtcgtgacggtgccctccagctccctgggcacccagacctacatctgcaacgtcaaccacaagcccagcaacaccaaggtggacaagaaggtggagcccaagtcctgcgacaagacgcacacgtgcccgccctgccccgcccccgagctcctcgggggcccgagcgtcttcctgttcccgcccaagcccaaggacaccctcatgatctcccggacccccgaggtgacctgcgtggtcgtggacgtcagccacgaggaccccgaggtgaagttcaactggtacgtggacggggtcgaggtgcacaacgccaagaccaagccccgcgaggagcagtacaactccacctaccgggtggtcagcgtgctgaccgtgctgcaccaggactggctcaacggcaaggagtacaagtgcaaggtctccaacaaggccctgcccgcgccgatcgagaagacgatcagcaaggccaagggccagccccgcgagccccaggtgtacaccctgcccccgtcccgggaggagatgaccaagaaccaggtgagcctgacctgcctggtcaaggggttctacccctccgacatcgccgtggagtgggagagcaacggccagcccgagaacaactacaagacgaccccgcccgtgctggacagcgacgggtccttcttcctctacagcaagctgaccgtcgacaagtcccgctggcagcagggcaacgtgttcagctgctccgtgatgcacgaggccctgcacaaccactacacccagaagtccctcagcctgagccccggg

SEQ ID NO: 8331 - RNA, 750 nt, synthetic construct
  misc_feature 1..750: note = derived and/or modified sequence opt1 from Pexelizumab_h5g1.1-scFv
  source 1..750: mol_type = other RNA
atggccgacatccagatgacccagagcccctccagcctgtccgccagcgtgggcgaccgcgtcaccatcacgtgcggggcgtccgagaacatctacggcgccctcaactggtaccagcggaagccggggaaggcccccaagctgctgatctacggcgccaccaacctcgccgacggggtgcccagccgcttctccggcagcggctccgggaccgactacaccctgacgatcagctccctgcagcccgaggacttcgcgacctactactgccagaacgtgctcaacaccccgctgaccttcggccaggggacgaaggtcgagatcaagcggaccggcgggggcggcagcgggggcgggggctccggcgggggcgggagccaggtgcagctggtgcagtccggcgccgaggtcgagaagcccggggccagcgtgaagaaggtgtcctgcaaggccagcggctacatcttctccaactactggatccagtgggtccgccaggcgcccggccaggggctcgagtggatgggcgagatcctgcccgggagcggcagcaccgagtacgcccagaagttccaggggcgggtgaccatgacggccgacacctccaccagcaccgcctacatggagctgtccagcctccgctccgaggacacggccgtgtactactgcgcgcggtacttcttcggcagctccccgaactactggtacttcgacgtctggggccaggggaccctggtgaccgtgagctcc

SEQ ID NO: 8332 - RNA, 345 nt, synthetic construct
  misc_feature 1..345: note = derived and/or modified sequence opt1 from Pexelizumab_h5g1.1VHC_+_F_Heavy_Chain_V-Region
  source 1..345: mol_type = other RNA
caggtgcagctggtccagagcggcgccgaggtgaagaagcccggggcctccgtgaaggtcagctgcaaggcgtccggctacatcttcagcaactactggatccagtgggtgcgccaggccccggggcagggcctcgagtggatgggggagatcctgcccggctccggcagcaccgagtacgcccagaagttccaggggcgggtgaccatgacggccgacacctccaccagcaccgcctacatggagctgtccagcctccgctccgaggacacggcggtctactactgcgcccggtacttcttcggcagctcccccaactggtacttcgtgtgggggcagggcacc

SEQ ID NO: 8333 - RNA, 318 nt, synthetic construct
  misc_feature 1..318: note = derived and/or modified sequence opt1 from Pexelizumab_h5g1.1VHC_+_F_Light_Chain_V-Region
  source 1..318: mol_type = other RNA
gacatccagatgacccagagcccctccctgagcgcctccgtgggcgaccgcgtcaccatcacgtgcggggccagcgagaacatctacggcgcgctcaactggtaccagcggaagccggggaaggcccccaagctgctgatctacggcgccaccaacctcgccgacggggtgccctcccgcttcagcggctccggcagcgggaccgactacaccctgacgatctccagcctgcagcccgaggacttcgccacctactactgccagaacgtgctcaacaccccgctgaccttcggccaggggacgaaggtcgagatcaag

SEQ ID NO: 8334 - RNA, 1326 nt, synthetic construct
  misc_feature 1..1326: note = derived and/or modified sequence opt1 from PF-05082566_HeavyChain1
  source 1..1326: mol_type = other RNA
gaggtgcagctggtccagagcggcgccgaggtgaagaagcccggggagtccctccgcatcagctgcaagggctccgggtacagcttctccacctactggatcagctgggtgcggcagatgccgggcaaggggctggagtggatgggcaagatctaccccggcgactcctacaccaactacagcccctccttccaggggcaggtcacgatcagcgccgacaagtccatcagcaccgcgtacctgcagtggtccagcctcaaggcctccgacaccgccatgtactactgcgcccgcggctacgggatcttcgactactggggccaggggaccctggtgacggtgagctccgccagcaccaagggcccctccgtcttcccgctggcgccctgcagccggagcacctccgagagcaccgccgccctcggctgcctggtgaaggactacttccccgagcccgtgacggtctcctggaacagcggggccctgacctccggcgtgcacaccttcccggcggtgctccagagctccgggctgtacagcctgtccagcgtcgtgaccgtgccctccagcaacttcggcacgcagacctacacgtgcaacgtcgaccacaagccctccaacaccaaggtggacaagaccgtggagcgcaagtgctgcgtcgagtgcccgccctgccccgccccgcccgtggccggccccagcgtgttcctcttcccgcccaagcccaaggacaccctgatgatctcccggacccccgaggtgacctgcgtcgtggtcgacgtgagccacgaggaccccgaggtccagttcaactggtacgtggacggggtggaggtccacaacgccaagacgaagccccgcgaggagcagttcaactccaccttccgggtggtgagcgtcctgaccgtggtgcaccaggactggctcaacggcaaggagtacaagtgcaaggtctccaacaaggggctgcccgccccgatcgagaagaccatcagcaagacgaagggccagccccgcgagccccaggtgtacaccctgcccccgagccgggaggagatgaccaagaaccaggtgtccctgacctgcctcgtcaaggggttctaccccagcgacatcgcggtggagtgggagtccaacggccagcccgagaacaactacaagacgaccccgcccatgctggacagcgacggctccttcttcctctacagcaagctgaccgtggacaagtcccgctggcagcaggggaacgtcttcagctgctccgtgatgcacgaggccctgcacaaccactacacccagaagtccctcagcctgagccccggcaag

SEQ ID NO: 8335 - RNA, 642 nt, synthetic construct
  misc_feature 1..642: note = derived and/or modified sequence opt1 from PF-05082568_LightChain1
  source 1..642: mol_type = other RNA
agctacgagctgacccagcccccgtccgtgagcgtctcccccggccagaccgccagcatcacgtgctccggggacaacatcggcgaccagtacgcccactggtaccagcagaagcccgggcagagccccgtgctcgtgatctaccaggacaagaaccgcccgtccggcatccccgagcggttcagcgggtccaacagcggcaacaccgcgaccctgaccatctccggcacgcaggccatggacgaggccgactactactgcgccacctacaccgggttcggcagcctggccgtcttcgggggcgggaccaagctcacggtgctgggccagcccaaggcggccccctccgtgaccctgttcccgcccagctccgaggagctccaggccaacaaggccaccctggtctgcctgatcagcgacttctaccccggcgcggtgaccgtggcctggaaggccgactccagccccgtcaaggccggggtggagacgaccaccccgtccaagcagagcaacaacaagtacgccgcgagctcctacctcagcctgacccccgagcagtggaagtcccaccgcagctactcctgccaggtgacgcacgagggcagcaccgtcgagaagaccgtggcccccaccgagtgctcc

SEQ ID NO: 8336 - RNA, 1341 nt, synthetic construct
  misc_feature 1..1341: note = derived and/or modified sequence opt1 from Pidilizumab_HeavyChain1
  source 1..1341: mol_type = other RNA
caggtgcagctggtccagagcggctccgagctcaagaagcccggggccagcgtgaagatctcctgcaaggccagcggctacaccttcaccaactacgggatgaactgggtgcgccaggcgccgggccaggggctgcagtggatgggctggatcaacacggactccggcgagagcacctacgccgaggagttcaaggggcggttcgtcttctccctggacaccagcgtgaacaccgcctacctccagatcacgtccctgaccgccgaggacaccggcatgtacttctgcgtgcgcgtcgggtacgacgccctggactactggggccaggggaccctcgtgacggtgagctccgcgagcaccaagggcccctccgtcttccccctggcccccagctccaagagcacctccggcgggaccgccgccctgggctgcctcgtgaaggactacttcccggagcccgtgacggtcagctggaactccggggcgctgaccagcggcgtgcacaccttccccgccgtgctgcagagctccggcctctacagcctgtccagcgtcgtgaccgtgccctccagctccctggggacgcagacctacatctgcaacgtcaaccacaagccgagcaacaccaaggtggacaagcgggtggagcccaagtcctgcgacaagacccacacgtgcccgccctgcccggcccccgagctcctgggcgggcccagcgtcttcctgttcccgcccaagcccaaggacaccctcatgatctcccgcacccccgaggtgacctgcgtggtcgtggacgtcagccacgaggaccccgaggtgaagttcaactggtacgtggacggcgtcgaggtgcacaacgccaagacgaagccgcgggaggagcagtacaactccacctaccgcgtggtcagcgtgctgaccgtgctgcaccaggactggctcaacgggaaggagtacaagtgcaaggtctccaacaaggccctgcccgcgcccatcgagaagaccatcagcaaggccaagggccagccccgggagccccaggtgtacacgctgccgccctcccgcgaggagatgaccaagaaccaggtgagcctgacctgcctcgtcaagggcttctacccctccgacatcgccgtggagtgggagagcaacgggcagcccgagaacaactacaagaccacgccgcccgtgctggacagcgacggctccttcttcctctacagcaagctgaccgtcgacaagtcccggtggcagcaggggaacgtgttcagctgctccgtgatgcacgaggccctgcacaaccactacacccagaagtccctcagcctgagccccggcaag

SEQ ID NO: 8337 - RNA, 639 nt, synthetic construct
  misc_feature 1..639: note = derived and/or modified sequence opt1 from Pidilizumab_LightChain1
  source 1..639: mol_type = other RNA
gagatcgtgctgacccagagcccctccagcctctccgccagcgtcggcgaccgggtgaccatcacgtgctccgcccggagctccgtgagctacatgcactggttccagcagaagccggggaaggcgcccaagctgtggatctaccgcacctccaacctggccagcggcgtcccctcccggttcagcgggtccggcagcgggacctcctactgcctcaccatcaacagcctgcagcccgaggacttcgccacgtactactgccagcagcgctccagcttcccgctgaccttcggcggcgggaccaagctcgagatcaagcggaccgtggccgccccctccgtgttcatcttcccgcccagcgacgagcagctcaagagcggcacggcgtccgtcgtgtgcctgctgaacaacttctacccccgcgaggccaaggtgcagtggaaggtcgacaacgccctgcagagcgggaactcccaggagagcgtgaccgagcaggactccaaggacagcacctactccctgagctccaccctcacgctgagcaaggccgactacgagaagcacaaggtgtacgcgtgcgaggtcacccaccagggcctgtccagccccgtgaccaagtccttcaaccgcggggagtgc

SEQ ID NO: 8338 - RNA, 1350 nt, synthetic construct
  misc_feature 1..1350: note = derived and/or modified sequence opt1 from Pinatuzumab_vedotin_HeavyChain1
  source 1..1350: mol_type = other RNA
gaggtgcagctggtcgagagcggcgggggcctcgtgcagcccgggggctccctgcgcctgagctgcgccgcctccgggtacgagttcagccggtcctggatgaactgggtgcgccaggcgccgggcaagggcctcgagtgggtcgggcggatctaccccggcgacggggacaccaactacagcggcaagttcaaggggcgcttcaccatctccgccgacacgagcaagaacaccgcctacctgcagatgaactccctgcgggccgaggacaccgccgtgtactactgcgcgcgcgacggcagctcctgggactggtacttcgacgtgtggggccaggggaccctcgtcacggtgagctccgccagcaccaagggcccctccgtgttccccctggccccgagctccaagagcacctccgggggcaccgccgcgctgggctgcctcgtcaaggactacttccccgagcccgtgacggtgagctggaacagcggggccctgacctccggcgtccacaccttccccgccgtgctgcagagctccgggctctacagcctgtccagcgtggtcaccgtgccgtccagctccctgggcacgcagacctacatctgcaacgtgaaccacaagcccagcaacaccaaggtcgacaagaaggtggagcccaagtcctgcgacaagacccacacgtgcccgccctgccccgcccccgagctcctcgggggccccagcgtgttcctgttcccgcccaagcccaaggacaccctcatgatctcccggacccccgaggtgacctgcgtcgtggtcgacgtgagccacgaggacccggaggtcaagttcaactggtacgtggacggcgtggaggtccacaacgccaagacgaagccccgcgaggagcagtacaactccacctaccgggtggtgagcgtcctgaccgtgctgcaccaggactggctcaacgggaaggagtacaagtgcaaggtgtccaacaaggcgctgcccgcccccatcgagaagaccatcagcaaggccaagggccagccgcgcgagccccaggtctacacgctgccgccctcccgggaggagatgaccaagaaccaggtgagcctgacctgcctggtgaaggggttctaccccagcgacatcgccgtcgagtgggagtccaacggccagcccgagaacaactacaagaccacgcccccggtgctggacagcgacgggtccttcttcctctacagcaagctgaccgtggacaagtcccgctggcagcagggcaacgtcttcagctgctccgtgatgcacgaggccctgcacaaccactacacccagaagtccctcagcctgagccccggcaag

SEQ ID NO: 8339 - RNA, 657 nt, synthetic construct
  misc_feature 1..657: note = derived and/or modified sequence opt1 from Pinatuzumab_vedotin_LightChain1
  source 1..657: mol_type = other RNA
gacatccagatgacccagagcccctccagcctgtccgccagcgtgggcgaccgcgtcaccatcacgtgccggtccagccagtccatcgtgcacagcgtggggaacaccttcctcgagtggtaccagcagaagccgggcaaggcccccaagctgctgatctacaaggtctccaaccgcttcagcggggtgccctcccggttcagcggctccgggagcggcaccgacttcaccctcacgatctccagcctgcagcccgaggacttcgcgacctactactgcttccagggctcccagttcccgtacaccttcgggcagggcaccaaggtggagatcaagcgcacggtcgccgcccccagcgtgttcatcttcccgccctccgacgagcagctcaagagcgggaccgccagcgtggtctgcctgctgaacaacttctacccccgggaggccaaggtgcagtggaaggtggacaacgcgctgcagtccggcaacagccaggagtccgtcaccgagcaggacagcaaggactccacctacagcctctccagcacgctgaccctgtccaaggccgactacgagaagcacaaggtgtacgcctgcgaggtgacccaccaggggctcagctcccccgtcaccaagagcttcaaccgcggcgagtgc

SEQ ID NO: 8340 - RNA, 1023 nt, synthetic construct
  misc_feature 1..1023: note = derived and/or modified sequence opt1 from Placulumab_chain1
  source 1..1023: mol_type = other RNA
gacatccagatgacccagagcccctccagcctgtccgccagcgtgggcgaccgcgtcaccatcacgtgccgggcctcccaggcgatcgacagctacctccactggtaccagcagaagcccgggaaggcccccaagctgctgatctactccgccagcaacctcgagaccggcgtgccctcccgcttcagcgggtccggcagcgggaccgacttcaccctgacgatctccagcctgctccccgaggacttcgccacctactactgccagcaggtcgtgtggcggccgttcaccttcggccagggcaccaaggtggagatcaagcgcgtggagcccaagtccagcgacaagacgcacacgtgcccgccctgccccgcccccgagctgctcgggggcccctccgtcttcctgttcccgcccaagcccaaggacaccctgatgatcagccggacccccgaggtgacctgcgtggtcgtggacgtgtcccacgaggaccccgaggtcaagttcaactggtacgtggacggggtggaggtccacaacgcgaagaccaagccgcgcgaggagcagtacaacagcacctaccgggtggtgagcgtcctgaccgtgctccaccaggactggctgaacggcaaggagtacaagtgcaaggtgtccaacaaggccctgcccgcccccatcgagaagacgatcagcaaggccaaggggcagccccgcgagccgcaggtctacaccctcccgccctcccgggacgagctgaccaagaaccaggtgagcctgacctgcctcgtgaagggcttctacccctccgacatcgcggtcgagtgggagagcaacggccagcccgagaacaactacaagacgaccccgcccgtgctggactccgacgggagcttcttcctgtactccaagctcaccgtcgacaagagccgctggcagcagggcaacgtgttctcctgcagcgtgatgcacgaggccctgcacaaccactacacccagaagtccctgagcctctcccccgggaag

SEQ ID NO: 8341 - RNA, 1023 nt, synthetic construct; identical to SEQ ID NO: 8340
  misc_feature 1..1023: note = derived and/or modified sequence opt1 from Placulumab_HeavyChain1
  source 1..1023: mol_type = other RNA

SEQ ID NO: 8342 - RNA, 1341 nt, synthetic construct
  misc_feature 1..1341: note = derived and/or modified sequence opt1 from Plozalizumab_HeavyChain1
  source 1..1341: mol_type = other RNA
gaggtgcagctggtcgagagcggcgggggcctcgtgaagcccgggggctccctgcgcctgagctgcgccgcctccgggttcaccttcagcgcgtacgccatgaactgggtgcggcaggccccgggcaagggcctcgagtgggtcgggcgcatccggaccaagaacaacaactacgccacgtactacgccgactccgtgaaggaccgcttcaccatcagccgggacgactccaagaacaccctgtacctgcagatgaacagcctcaagaccgaggacacggcggtgtactactgcaccaccttctacggcaacggggtctggggccaggggaccctggtgacggtgtccagcgcctccaccaagggccccagcgtcttccccctggccccctccagcaagtccaccagcggcgggaccgccgcgctcggctgcctggtgaaggactacttcccggagcccgtgacggtctcctggaacagcggggccctgacctccggcgtgcacaccttccccgccgtgctccagagcagcggcctgtactccctgagctccgtcgtgaccgtgcccagctccagcctcgggacgcagacctacatctgcaacgtcaaccacaagccgtccaacaccaaggtggacaagaaggtggagcccaagagctgcgacaagacccacacgtgcccgccctgcccggcccccgagctggccggcgcgccctccgtcttcctgttcccgcccaagcccaaggacaccctcatgatcagccgcacccccgaggtgacctgcgtggtcgtggacgtctcccacgaggaccccgaggtgaagttcaactggtacgtggacggggtcgaggtgcacaacgccaagacgaagccgcgggaggagcagtacaacagcacctaccgcgtggtctccgtgctgaccgtgctgcaccaggactggctcaacggcaaggagtacaagtgcaaggtcagcaacaaggccctgcccgcccccatcgagaagaccatctccaaggccaaggggcagccccgggagccccaggtgtacacgctgccgcccagccgcgacgagctcaccaagaaccaggtgtccctgacctgcctggtcaagggcttctaccccagcgacatcgcggtggagtgggagtccaacggccagcccgagaacaactacaagaccacgccgcccgtgctcgacagcgacgggagcttcttcctgtactccaagctgaccgtcgacaagagccggtggcagcagggcaacgtgttctcctgcagcgtgatgcacgaggccctccacaaccactacacccagaagtccctgagcctgtcccccgggaag

SEQ ID NO: 8343 - RNA, 657 nt, synthetic construct
  misc_feature 1..657: note = derived and/or modified sequence opt1 from Plozalizumab_LightChain1
  source 1..657: mol_type = other RNA
gacgtggtcatgacccagagccccctgtccctcccggtgaccctgggccagcccgccagcatctcctgcaagagctcccagagcctgctcgactccgacgggaagacgttcctgaactggttccagcagcgccccggccagagcccccggcgcctgatctacctcgtgtccaagctggacagcggggtcccggaccggttctccggcagcgggtccggcaccgacttcaccctgaagatcagccgcgtggaggccgaggacgtgggcgtctactactgctggcaggggacccacttcccctacacgttcggccaggggacccggctcgagatcaagcgcaccgtggcggccccctccgtgttcatcttcccgcccagcgacgagcagctgaagtccggcaccgccagcgtcgtgtgcctgctcaacaacttctacccccgggaggccaaggtgcagtggaaggtcgacaacgccctgcagtccgggaacagccaggagagcgtgacggagcaggactccaaggacagcacctactccctgagctccaccctcaccctgagcaaggcggactacgagaagcacaaggtgtacgcctgcgaggtcacgcaccagggcctgtccagccccgtgaccaagtccttcaaccgcggcgagtgc

SEQ ID NO: 8344 - RNA, 1341 nt, synthetic construct
  misc_feature 1..1341: note = derived and/or modified sequence opt1 from Pogalizumab_HeavyChain1
  source 1..1341: mol_type = other RNA
gaggtgcagctggtccagagcggcgccgaggtgaagaagcccggggcctccgtgaaggtcagctgcaaggcgtccggctacaccttcaccgacagctacatgtcctgggtgcgccaggccccggggcagggcctcgagtggatcggggacatgtaccccgacaacggcgacagctcctacaaccagaagttccgggagcgcgtgacgatcacccgggacaccagcacctccacggcctacctggagctgagctccctccgcagcgaggacaccgccgtctactactgcgtgctggcgccccggtggtacttctccgtgtggggccaggggaccctggtcaccgtgagctccgccagcacgaagggcccctccgtgttcccgctcgcccccagctccaagagcaccagcgggggcaccgccgccctggggtgcctggtcaaggactacttccccgagcccgtgaccgtgtcctggaacagcggcgcgctcacgtccggcgtccacaccttcccggccgtgctgcagagctccgggctgtacagcctctccagcgtggtcaccgtgccctccagctccctgggcacccagacgtacatctgcaacgtgaaccacaagcccagcaacaccaaggtcgacaagaaggtggagcccaagtcctgcgacaagacccacacgtgcccgccctgccccgcccccgagctgctcgggggcccgagcgtgttcctgttcccgcccaagcccaaggacaccctgatgatctcccgcacccccgaggtgacctgcgtcgtcgtggacgtgagccacgaggaccccgaggtcaagttcaactggtacgtggacggcgtggaggtccacaacgccaagaccaagccccgggaggagcagtacaactccacgtaccgcgtggtgagcgtcctcaccgtgctgcaccaggactggctgaacgggaaggagtacaagtgcaaggtgtccaacaaggccctccccgcgccgatcgagaagaccatcagcaaggccaagggccagccccgggagccccaggtctacaccctgcccccgagccgcgaggagatgacgaagaaccaggtgtccctgacctgcctcgtgaaggggttctaccccagcgacatcgccgtcgagtgggagtccaacggccagcccgagaacaactacaagaccaccccgcccgtgctggacagcgacgggtccttcttcctgtacagcaagctcacggtggacaagtcccggtggcagcagggcaacgtcttcagctgctccgtgatgcacgaggccctgcacaaccactacacccagaagtccctgagcctcagccccggcaag

SEQ ID NO: 8345 - RNA, 642 nt, synthetic construct
  misc_feature 1..642: note = derived and/or modified sequence opt1 from Pogalizumab_LightChain1
  source 1..642: mol_type = other RNA
gacatccagatgacccagagcccctccagcctgtccgccagcgtgggcgaccgggtcaccatcacgtgccgggcctcccaggacatcagcaactacctcaactggtaccagcagaagccggggaaggcgcccaagctgctgatctactacacctcccgcctccggagcggcgtgccctcccgcttcagcgggtccggcagcgggaccgacttcaccctgacgatctccagcctgcagcccgaggacttcgccacctactactgccagcagggccacaccctcccgcccaccttcggccaggggacgaaggtggagatcaagcggaccgtcgccgccccctccgtgttcatcttcccgcccagcgacgagcagctgaagtccggcaccgccagcgtggtctgcctgctcaacaacttctacccccgcgaggcgaaggtgcagtggaaggtggacaacgccctgcagtccgggaacagccaggagagcgtcaccgagcaggactccaaggacagcacgtactccctgagctccaccctcaccctgagcaaggccgactacgagaagcacaaggtgtacgcctgcgaggtgacccaccagggcctgtccagccccgtcacgaagtccttcaaccgcggggagtgc

SEQ ID NO: 8346 - RNA, 1341 nt, synthetic construct
  misc_feature 1..1341: note = derived and/or modified sequence opt1 from Polatuzumab_vedotin_HeavyChain1
  source 1..1341: mol_type = other RNA
gaggtgcagctggtcgagagcggcgggggcctcgtgcagcccgggggctccctgcgcctgagctgcgccgcctccgggtacaccttcagctcctactggatcgagtgggtgcggcaggcgccgggcaagggcctcgagtggatcggggagatcctgcccggcgggggcgacaccaactacaacgagatcttcaaggggcgcgccacgttcagcgccgacacctccaagaacaccgcctacctgcagatgaacagcctccgggccgaggacaccgcggtctactactgcacgcgccgggtgcccatccgcctggactactggggccagggcaccctggtgaccgtctccagcgcctccaccaaggggcccagcgtgttcccgctcgccccctccagcaagtccacgagcggcgggaccgccgcgctgggctgcctggtgaaggactacttccccgagcccgtcaccgtgtcctggaacagcggcgccctcacctccggggtgcacacgttcccggccgtcctgcagagcagcggcctgtactccctcagctccgtggtgaccgtccccagctccagcctggggacccagacctacatctgcaacgtgaaccacaagccctccaacacgaaggtggacaagaaggtcgagcccaagagctgcgacaagacccacacgtgcccgccctgccccgcccccgagctgctcggcgggccgtccgtgttcctgttcccgcccaagcccaaggacaccctgatgatcagccggacccccgaggtgacctgcgtcgtggtggacgtctcccacgaggaccccgaggtgaagttcaactggtacgtcgacggcgtggaggtgcacaacgccaagaccaagccccgcgaggagcagtacaacagcacctaccgggtcgtgtccgtgctcacggtcctgcaccaggactggctgaacggcaaggagtacaagtgcaaggtgagcaacaaggcgctccccgccccgatcgagaagaccatctccaaggccaaggggcagccccgcgagccccaggtgtacaccctgcccccgagccgggaggagatgaccaagaaccaggtctccctgacgtgcctcgtgaagggcttctaccccagcgacatcgccgtggagtgggagtccaacgggcagcccgagaacaactacaagaccaccccgcccgtcctggacagcgacggcagcttcttcctgtactccaagctcaccgtggacaagagccgctggcagcaggggaacgtgttctcctgcagcgtcatgcacgaggccctgcacaaccactacacgcagaagtccctgagcctctcccccggcaag

SEQ ID NO: 8347 - RNA, 654 nt, synthetic construct
  misc_feature 1..654: note = derived and/or modified sequence opt1 from Polatuzumab_vedotin_LightChain1
  source 1..654: mol_type = other RNA
gacatccagctgacccagagcccctccagcctctccgccagcgtgggcgaccgcgtcaccatcacgtgcaaggcctcccagagcgtggactacgagggggactccttcctgaactggtaccagcagaagccgggcaaggcgcccaagctgctcatctacgccgccagcaacctggagtccggggtgcccagccggttctccggcagcgggtccggcaccgacttcaccctgaccatcagctccctccagcccgaggacttcgccacgtactactgccagcagagcaacgaggacccgctgaccttcggccaggggaccaaggtcgagatcaagcgcaccgtggccgcgccctccgtgttcatcttcccgcccagcgacgagcagctgaagtccggcacggccagcgtcgtgtgcctcctgaacaacttctacccccgggaggccaaggtgcagtggaaggtcgacaacgccctgcagagcgggaactcccaggagagcgtgaccgagcaggactccaaggacagcacctactccctcagctccaccctgacgctgagcaaggcggactacgagaagcacaaggtgtacgcctgcgaggtcacccaccagggcctctccagccccgtgaccaagtccttcaaccgcggggagtgc

SEQ ID NO: 8348 - RNA, 1326 nt, synthetic construct
  misc_feature 1..1326: note = derived and/or modified sequence opt1 from Ponezumab_HeavyChain1
  source 1..1326: mol_type = other RNA
caggtgcagctggtccagagcggcgccgaggtgaagaagcccggggcctccgtgaaggtcagctgcaaggcgtccggctactacaccgaggcctactacatccactgggtgcgccaggccccggggcagggcctcgagtggatggggcggatcgaccccgccaccggcaacacgaagtacgcgccccgcctgcaggaccgggtgaccatgacccgcgacaccagcacgtccaccgtctacatggagctgagctccctccggagcgaggacaccgccgtgtactactgcgcctccctgtacagcctgcccgtgtactggggccaggggaccacggtcaccgtgtccagcgcctccaccaagggcccgagcgtgttccccctcgccccctgctcccgcagcacctccgagagcacggcggccctggggtgcctggtcaaggactacttccccgagccggtgaccgtgtcctggaacagcggcgccctcaccagcggggtccacaccttccccgccgtgctgcagtccagcggcctgtactccctcagctccgtggtcacggtgcccagctccaacttcggcacccagacctacacgtgcaacgtggaccacaagcccagcaacaccaaggtcgacaagaccgtggagcggaagtgctgcgtggagtgcccgccctgccccgcgcccccggtcgccgggccctccgtgttcctgttcccgcccaagcccaaggacaccctgatgatcagccgcacccccgaggtcacgtgcgtggtggtcgacgtgtcccacgaggaccccgaggtgcagttcaactggtacgtcgacggcgtggaggtgcacaacgccaagaccaagccccgggaggagcagttcaacagcaccttccgcgtcgtgtccgtgctcaccgtcgtgcaccaggactggctgaacgggaaggagtacaagtgcaaggtgagcaacaagggcctgccgtccagcatcgagaagacgatctccaagaccaagggccagccccgggagccccaggtctacaccctgcccccgagccgcgaggagatgaccaagaaccaggtgtccctcacgtgcctggtgaaggggttctaccccagcgacatcgccgtcgagtgggagagcaacggccagcccgagaacaactacaagaccaccccgcccatgctcgactccgacgggagcttcttcctgtactccaagctgaccgtggacaagagccggtggcagcagggcaacgtgttctcctgcagcgtcatgcacgaggccctccacaaccactacacgcagaagtccctgagcctgtcccccgggaag

SEQ ID NO: 8349 - RNA, 657 nt, synthetic construct
  misc_feature 1..657: note = derived and/or modified sequence opt1 from Ponezumab_LightChain1
  source 1..657: mol_type = other RNA
gacgtggtcatgacgcagagccccctgtccctcccggtgaccctgggccagcccgccagcatctcctgcaagagctcccagagcctgctctactccgacgccaagacgtacctgaactggttccagcagcgccccgggcagagcccccggcgcctgatctaccagatctcccggctcgacccgggcgtgcccgaccgcttcagcgggtccggcagcgggaccgacttcaccctgaagatctcccgggtcgaggcggaggacgtgggcgtgtactactgcctgcagggcacccactaccccgtcctcttcgggcagggcacgcgcctggagatcaagcggaccgtggccgcccccagcgtgttcatcttcccgccctccgacgagcagctcaagagcgggaccgcctccgtcgtgtgcctgctgaacaacttctacccccgcgaggccaaggtgcagtggaaggtcgacaacgcgctgcagagcggcaactcccaggagagcgtgaccgagcaggacagcaaggactccacgtacagcctctccagcaccctgaccctgtccaaggccgactacgagaagcacaaggtgtacgcctgcgaggtcacccaccaggggctcagctcccccgtgaccaagagcttcaaccggggcgagtgc

SEQ ID NO: 8350 - RNA, 1362 nt, synthetic construct
  misc_feature 1..1362: note = derived and/or modified sequence opt1 from Pritoxaximab_HeavyChain1
  source 1..1362: mol_type = other RNA
caggtgcagctgcaggagagcggcgccgagctcgtccgctccggggccagcgtgcggatgtcctgcaaggcgagcggctacaccttcacctcctacaacatgcactgggtgaagcagacgcccgggcagggcctggagtggatcgggtacatctacccgggcaacggcgggaccaactacatccagaagttcaagggcaaggccatcctgaccgccgacaccagctccagcacggcctacatgcagatctccagcctcacctccgaggacagcgccgtctacttctgcacccgctcccccagccactactccagcgacccctacttcgactactgggggcagggcaccacgctgaccgtgtccagcgagttcgcgtccaccaaggggcccagcgtgttcccgctggcccccagctccaagagcacctccggcggcacggccgccctcgggtgcctggtcaaggactacttccccgagcccgtgaccgtgagctggaactccggcgcgctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacgtgcccgccctgccccgcccccgagctgctcgggggcccgtccgtgttcctcttcccgcccaagcccaaggacaccctgatgatcagccggacccccgaggtgacctgcgtcgtggtcgacgtgtcccacgaggaccccgaggtgaagttcaactggtacgtcgacggggtggaggtccacaacgccaagaccaagccccgcgaggagcagtacaacagcacctaccgggtggtgagcgtcctgaccgtgctccaccaggactggctgaacggcaaggagtacaagtgcaaggtgtccaacaaggccctgcccgcgccgatcgagaagacgatcagcaaggccaaggggcagccccgcgagccccaggtctacaccctgcccccgtcccgggacgagctgaccaagaaccaggtgagcctgacctgcctcgtgaagggcttctacccctccgacatcgccgtcgagtgggagagcaacggccagcccgagaacaactacaagacgaccccgcccgtgctggactccgacgggagcttcttcctgtactccaagctcaccgtggacaagagccgctggcagcagggcaacgtcttctcctgcagcgtgatgcacgaggccctgcacaaccactacacccagaagtccctgagcctctcccccgggaag

SEQ ID NO: 8351 - RNA, 642 nt, synthetic construct
  misc_feature 1..642: note = derived and/or modified sequence opt1 from Pritoxaximab_LightChain1
  source 1..642: mol_type = other RNA
gacatcgtgatgagccagtcccacaagttcatgagcacctccgtcggcgaccgggtgagcatcacgtgcaaggcctcccaggacgtggggaccgccgtcgcgtggtaccagcagaaccccggccagagcccgaagttcctgatctactgggcctccacccggcacaccggggtgcccgaccgcttcaccggcagcgggtccggcacggacttcaccctcaccatcaccaacgtgcagagcgaggacctggccgactacttctgccagcagtactccagctaccccctgacgttcggcgccgggacctccctcgagctgaagcggaccgtcgccgcgcccagcgtgttcatcttcccgccctccgacgagcagctcaagagcggcaccgcctccgtggtctgcctgctgaacaacttctacccccgcgaggccaaggtgcagtggaaggtggacaacgccctgcagagcgggaactcccaggagagcgtcacggagcaggacagcaaggactccacctacagcctctccagcaccctgaccctgtccaaggcggactacgagaagcacaaggtgtacgcctgcgaggtgacgcaccagggcctcagctcccccgtcaccaagagcttcaaccgcggggagtgc

SEQ ID NO: 8352 - RNA, 1350 nt, synthetic construct
  misc_feature 1..1350: note = derived and/or modified sequence opt1 from Pritumumab_HeavyChain1
  source 1..1350: mol_type = other RNA
gaggtgcagctgctcgagagcggcggggacctggtccagcccggcgggtccctgcgcctcagctgcgccgcctccggcttcaccttcagcaactacgcgatgtcctgggtgcggcaggcccccgggaagggcctggagtgggtgagcgccatcaccccctccggcgggagcacgaactacgccgactccgtcaagggccgcttcaccatcagccgggacaactcccagaacaccctgtacctccagatgaacagcctgcgcgtggaggacaccgccgtgtacatctgcgggcgggtcccctaccgctccacgtggtaccccctgtactggggccaggggaccctcgtgaccgtgagctccgcgagcaccaagggcccgtccgtcttccccctggcccccagctccaagagcacgagcggcgggaccgccgccctgggctgcctcgtgaaggactacttccccgagccggtgaccgtctcctggaacagcggggcgctgacctccggcgtgcacacgttccccgccgtgctgcagagctccggcctctacagcctgtccagcgtcgtgaccgtgccctccagctccctggggacccagacctacatctgcaacgtcaaccacaagcccagcaacacgaaggtggacaagaaggtggagccgaagtcctgcgacaagacccacacgtgcccgccctgccccgcccccgagctcctgggcgggcccagcgtcttcctgttcccgcccaagcccaaggacaccctcatgatctcccggacccccgaggtgacctgcgtggtcgtggacgtcagccacgaggaccccgaggtgaagttcaactggtacgtggacggcgtcgaggtgcacaacgccaagaccaagccccgcgaggagcagtacaactccacctaccgggtggtcagcgtgctgacggtgctgcaccaggactggctcaacgggaaggagtacaagtgcaaggtctccaacaaggccctgccggcgcccatcgagaagaccatcagcaaggccaagggccagccccgcgagccccaggtgtacaccctgccgcccagccgggacgagctcaccaagaaccaggtgtccctgacgtgcctggtcaagggcttctaccccagcgacatcgccgtggagtgggagtccaacgggcagccggagaacaactacaagaccaccccgcccgtgctcgacagcgacggctccttcttcctgtacagcaagctgaccgtcgacaagtcccgctggcagcaggggaacgtgttcagctgctccgtgatgcacgaggccctccacaaccactacacgcagaagtccctgagcctgagccccggcaag

SEQ ID NO: 8353 - RNA, 642 nt, synthetic construct
  misc_feature 1..642: note = derived and/or modified sequence opt1 from Pritumumab_LightChain1
  source 1..642: mol_type = other RNA
gacatccagatgacccagagcccctccagcctgtccgccagcgtgggcgaccgcgtcaccatcacgtgccgggcctcccaggacatcagcaactacctcgcgtggttccagcagaagccggggaaggcccccaagtccctgatctacgccgccagctccctgcacagcaaggtgcccacccagttctccggcagcgggtccggcaccgacttcaccctcacgatcagctccctgcagcccgaggacttcgccacctactactgcctgcagtacagcacctacccgatcaccttcgggggcggcacgaaggtggagatcaagcgcaccgtcgcggccccctccgtgttcatcttcccgcccagcgacgagcagctcaagtccgggaccgccagcgtggtctgcctgctgaacaacttctacccccgggaggccaaggtgcagtggaaggtggacaacgcgctccagagcggcaactcccaggagagcgtcaccgagcaggactccaaggacagcacgtactccctgagctccaccctgaccctcagcaaggccgactacgagaagcacaaggtgtacgcctgcgaggtgacccaccaggggctgtccagccccgtcacgaagtccttcaaccgcggcgagtgc

SEQ ID NO: 8354 - RNA, 1341 nt, synthetic construct
  misc_feature 1..1341: note = derived and/or modified sequence opt1 from Quilizumab_HeavyChain1
  source 1..1341: mol_type = other RNA
gaggtgcagctggtcgagagcggcgggggcctcgtgcagcccgggggctccctgcgcctgagctgcgccgcctccgggttcaccttcagcgactacggcatcgcgtgggtgcggcaggccccgggcaaggggctcgagtgggtcgccttcatctccgacctggcctacaccatctactacgccgacacggtgaccggccgcttcaccatcagccgggacaactccaagaacaccctgtacctccagatgaacagcctgcgcgcggaggacacggccgtgtactactgcgcccgggacaactgggacgccatggactactgggggcagggcaccctggtcaccgtgtccagcgcgtccaccaaggggcccagcgtgttccccctcgccccctccagcaagtccacgagcggcggcaccgccgccctggggtgcctggtcaaggactacttcccggagcccgtgaccgtgtcctggaacagcggcgccctcacctccggggtccacacgttccccgcggtgctgcagagcagcggcctgtactccctcagctccgtggtcaccgtgcccagctccagcctgggcacccagacctacatctgcaacgtgaaccacaagccgtccaacacgaaggtcgacaagaaggtggagcccaagagctgcgacaagacccacacgtgcccgccctgccccgcccccgagctgctcgggggcccctccgtgttcctgttcccgcccaagcccaaggacaccctgatgatcagccgcacccccgaggtgacctgcgtcgtggtcgacgtgtcccacgaggaccccgaggtcaagttcaactggtacgtggacggggtggaggtccacaacgccaagaccaagccgcgggaggagcagtacaacagcacctaccgcgtggtgtccgtcctcacggtgctgcaccaggactggctgaacggcaaggagtacaagtgcaaggtgagcaacaaggccctccccgcccccatcgagaagaccatctccaaggcgaaggggcagccccgggagccgcaggtctacaccctgccgcccagccgcgaggagatgaccaagaaccaggtgtccctgacgtgcctcgtgaagggcttctaccccagcgacatcgccgtcgagtgggagtccaacggccagcccgagaacaactacaagaccaccccgcccgtgctggacagcgacgggagcttcttcctgtactccaagctcaccgtggacaagagccggtggcagcagggcaacgtcttctcctgcagcgtgatgcacgaggccctgcacaaccactacacgcagaagtccctgagcctctcccccgggaag

SEQ ID NO: 8355 - RNA, 657 nt, synthetic construct
  misc_feature 1..657: note = derived and/or modified sequence opt1 from Quilizumab_LightChain1
  source 1..657: mol_type = other RNA
gacatccagatgacccagagcccctccagcctgtccgccagcgtgggcgaccgcgtcaccatcacgtgccggtccagccagtccctcgtgcacaacaacgccaacacctacctgcactggtaccagcagaagccggggaaggcgcccaagctgctcatctacaaggtgagcaaccgcttctccggcgtccccagccggttctccgggagcggctccgggaccgacttcaccctgacgatcagctccctgcagcccgaggacttcgccacctactactgcagccagaacaccctcgtgccgtggaccttcggccagggcacgaaggtggagatcaagcgcaccgtcgccgccccctccgtgttcatcttcccgcccagcgacgagcagctgaagtccgggaccgccagcgtggtctgcctgctcaacaacttctacccccgggaggcgaaggtgcagtggaaggtggacaacgccctgcagagcggcaactcccaggagagcgtcaccgagcaggactccaaggacagcacgtactccctgagctccaccctcaccctgagcaaggccgactacgagaagcacaaggtgtacgcctgcgaggtgacccaccaggggctgtccagccccgtcacgaagtccttcaaccgcggcgagtgc

SEQ ID NO: 8356 - RNA, 1335 nt, synthetic construct
  misc_feature 1..1335: note = derived and/or modified sequence opt1 from Racotumomab_HeavyChain1
  source 1..1335: mol_type = other RNA
caggtgcagctgcagcagagcggcgccgagctcgtcaagcccggggcctccgtgaagctgagctgcaaggcgtccggctacaccttcaccagctacgacatcaactgggtgcgccagcggccggagcaggggctggagtggatcggctggatcttccccggggacggctccaccaagtacaacgagaagttcaagggcaaggccaccctcaccaccgacaagagctccagcacggcctacatgcagctgtcccgcctgaccagcgaggactccgccgtctacttctgcgcccgggaggactactacgacaacagctactacttcgactactgggggcagggcaccaccctcacggtgtccagcgcgaagaccaccccgccctccgtgtaccccctggcccccgggagcgccgcccagaccaactccatggtcacgctgggctgcctcgtgaaggggtacttccccgagcccgtgaccgtcacctggaacagcggctccctgagcagcggcgtgcacaccttcccggcggtgctgcagtccgacctctacacgctgagctccagcgtcaccgtgccctccagcccccgcccctccgagaccgtgacctgcaacgtcgcccacccggccagctccacgaaggtggacaagaagatcgtgccccgggactgcgggtgcaagccctgcatctgcaccgtccccgaggtgagctccgtgttcatcttcccgcccaagcccaaggacgtcctgaccatcaccctcacgcccaaggtgacctgcgtggtcgtggacatcagcaaggacgacccggaggtccagttctcctggttcgtggacgacgtggaggtccacaccgcccagacccagccccgcgaggagcagttcaacagcacgttccggtccgtgagcgagctgcccatcatgcaccaggactggctgaacggcaaggagttcaagtgccgcgtgaactccgccgcgttccccgccccgatcgagaagaccatcagcaagaccaaggggcggcccaaggcgccccaggtctacaccatcccgccgcccaaggagcagatggccaaggacaaggtgtccctcacgtgcatgatcaccgacttcttccccgaggacatcaccgtggagtggcagtggaacggccagcccgccgagaactacaagaacacccagcccatcatgaacacgaacggcagctacttcgtctacagcaagctgaacgtgcagaagtccaactgggaggccgggaacaccttcacgtgcagcgtgctgcacgagggcctccacaaccaccacaccgagaagtccctgagccactcccccgggaag

SEQ ID NO: 8357 - RNA, 642 nt, synthetic construct
  misc_feature 1..642: note = derived and/or modified sequence opt1 from Racotumomab_LightChain1
  source 1..642: mol_type = other RNA
gacatccagatgacccagaccacgagctccctgagcgcctccctcggcgaccgcgtgaccatcagctgccgggcctcccaggacatcagcaactacctgaactggtaccagcagaagcccgacgggaccgtcaagctgctcatctactacacctcccgcctgcacagcggcgtgccgtcccggttcagcgggtccggcagcgggacggactactccctgaccatcagcaacctcgagcaggaggacatcgcgacctacttctgccagcagggcaacaccctgccctggacgttcggcgggggcaccaagctggagatcaagcgcgccgacgccgcccccaccgtgtccatcttcccgcccagctccgagcagctcaccagcgggggcgcctccgtcgtgtgcttcctgaacaacttctaccccaaggacatcaacgtgaagtggaagatcgacgggagcgagcggcagaacggcgtcctgaacagctggacggaccaggactccaaggacagcacctactccatgagctccaccctcaccctgacgaaggacgagtacgagcgccacaacagctacacgtgcgaggcgacccacaagacctccaccagccccatcgtgaagtccttcaaccggaacgagtgc

SEQ ID NO: 8358 - RNA, 1089 nt, synthetic construct; identical to SEQ ID NO: 8296
  misc_feature 1..1089: note = derived and/or modified sequence opt1 from Racotumomab_scVH-VH'-VH_chain
  source 1..1089: mol_type = other RNA

SEQ ID NO: 8359 - RNA, 1071 nt, synthetic construct
  misc_feature 1..1071: note = derived and/or modified sequence opt1 from Radretumab_HeavyChain1
  source 1..1071: mol_type = other RNA
gaggtgcagctgctcgagagcggcgggggcctggtccagcccgggggctccctgcgcctcagctgcgccgcctccgggttcaccttcagctccttcagcatgtcctgggtgcggcaggcgccgggcaagggcctggagtgggtgagctccatcagcgggtccagcggcaccacgtactacgccgactccgtcaaggggcgcttcaccatcagccgggacaactccaagaacaccctgtacctccagatgaacagcctgcgcgccgaggacaccgccgtgtactactgcgccaagcccttcccctacttcgactactggggccaggggacgctggtgaccgtctccagcggcgacggctccagcgggggcagcgggggcgcgtccgagatcgtgctcacccagagccccggcaccctgtccctgagcccgggggagcgggccacgctctcctgccgcgccagccagtccgtgagctccagcttcctggcctggtaccagcagaagcccggccaggcgccccggctgctcatctactacgcctccagccgcgccaccgggatccccgaccggttctccggcagcgggtccggcaccgacttcaccctgacgatcagccgcctggagccggaggacttcgccgtctactactgccagcagaccggccggatcccgcccaccttcgggcagggcaccaaggtggagatcaagtccgggggcagcgggggcccccgcgccgcgcccgaggtgtacgccttcgccacgcccgagtggcccggctcccgggacaagcgcaccctcgcctgcctgatccagaacttcatgcccgaggacatcagcgtccagtggctgcacaacgaggtgcagctcccggacgcccggcacagcaccacccagccccgcaagacgaaggggtccggcttcttcgtgttcagccggctggaggtcacccgcgcggagtgggagcagaaggacgagttcatctgccgggccgtgcacgaggccgcctcccccagccagaccgtgcagcgcgccgtctccgtgaaccccgagagctcccggcgcgggggctgc

SEQ ID NO: 8360 - RNA, 414 nt, synthetic construct; identical to SEQ ID NO: 8311
  misc_feature 1..414: note = derived and/or modified sequence opt1 from Radretumab_j_chain
  source 1..414: mol_type = other RNA

SEQ ID NO: 8361 - RNA, 1368 nt, synthetic construct
  misc_feature 1..1368: note = derived and/or modified sequence opt1 from Rafivirumab_HeavyChain1
  source 1..1368: mol_type = other RNA
caggtgcagctggtccagagcggcgccgaggtgaagaagcccgggtccagcgtgaaggtctcctgcaaggccagcggcgggaccttcaaccgctacaccgtgaactgggtgcggcaggcgccgggccaggggctcgagtggatgggcggcatcatccccatcttcgggacggccaactacgcccagcgcttccagggccggctgaccatcaccgccgacgagtccaccagcacggcctacatggagctgtccagcctccgctccgacgacaccgcggtctacttctgcgcccgggagaacctggacaacagcgggacctactactacttctccggctggttcgacccctgggggcagggcaccctggtgacggtgagctccgccagcaccaagggcccctccgtcttcccgctcgcccccagctccaagagcacctccgggggcaccgcggccctggggtgcctggtgaaggactacttccccgagcccgtgacggtcagctggaacagcggcgccctcacctccggcgtgcacaccttcccggccgtgctgcagagctccgggctgtacagcctctccagcgtcgtgaccgtgccctccagctccctgggcacgcagacctacatctgcaacgtcaaccacaagcccagcaacaccaaggtggacaagcgcgtggagcccaagtcctgcgacaagacccacacgtgcccgccctgccccgcccccgagctgctcgggggcccgagcgtcttcctgttcccgcccaagcccaaggacaccctgatgatctcccggacccccgaggtgacctgcgtggtcgtggacgtcagccacgaggaccccgaggtgaagttcaactggtacgtggacggggtcgaggtgcacaacgcgaagacgaagccccgcgaggagcagtacaactccacctaccgggtggtcagcgtgctcaccgtgctgcaccaggactggctgaacggcaaggagtacaagtgcaaggtctccaacaaggccctccccgccccgatcgagaagaccatcagcaaggccaagggccagccccgcgagccccaggtgtacacgctgcccccgtcccgggaggagatgaccaagaaccaggtgagcctgacctgcctcgtcaaggggttctaccccagcgacatcgccgtggagtgggagtccaacggccagcccgagaacaactacaagaccacgccgcccgtgctggacagcgacgggtccttcttcctgtacagcaagctcaccgtcgacaagtcccgctggcagcagggcaacgtgttcagctgctccgtgatgcacgaggcgctgcacaaccactacacccagaagtccctgagcctcagccccggg

SEQ ID NO: 8362 - RNA, 1368 nt, synthetic construct
  misc_feature 1..1368: note = derived and/or modified sequence opt1 from Rafivirumab_HeavyChain
  source 1..1368: mol_type = other RNA
gaggtgcagctggtccagagcggcgccgaggtgaagaagcccgggtccagcgtgaaggtctcctgcaaggccagcggcgggaccttcaaccgctacaccgtgaactgggtgcggcaggcgccgggccaggggctcgagtggatgggcggcatcatccccatcttcgggacggccaactacgcccagcgcttccagggccggctgaccatcaccgccgacgagtccaccagcacggcctacatggagctgtccagcctccgctccgacgacaccgcggtctacttctgcgcccgggagaacctggacaacagcgggacctactactacttctccggctggttcgacccctgggggcagggcaccctggtgacggtgagctccgccagcaccaagggcccctccgtcttcccgctcgcccccagctccaagagcacctccgggggcaccgcggccctggggtgcctggtgaaggactacttccccgagcccgtgacggtcagctggaacagcggcgccctcacctccggcgtgcacaccttcccggccgtgctgcagagctccgggctgtacagcctctccagcgtcgtgaccgtgccctccagctccctgggcacgcagacctacatctgcaacgtcaaccacaagcccagcaacaccaaggtggacaagcgcgtggagcccaagtcctgcgacaagacccacacgtgcccgccctgccccgcccccgagctgctcgggggcccgagcgtcttcctgttcccgcccaagcccaaggacaccctgatgatctcccggacccccgaggtgacctgcgtggtcgtggacgtcagccacgaggaccccgaggtgaagttcaactggtacgtggacggggtcgaggtgcacaacgcgaagacgaagccccgcgaggagcagtacaactccacctaccgggtggtcagcgtgctcaccgtgctgcaccaggactggctgaacggcaaggagtacaagtgcaaggtctccaacaaggccctccccgccccgatcgagaagaccatcagcaaggccaagggccagccccgcgagccccaggtgtacacgctgcccccgtcccgggaggagatgaccaagaaccaggtgagcctgacctgcctcgtcaaggggttctaccccagcgacatcgccgtggagtgggagtccaacggccagcccgagaacaactacaagaccacgccgcccgtgctggacagcgacgggtccttcttcctgtacagcaagctcaccgtcgacaagtcccgctggcagcagggcaacgtgttcagctgctccgtgatgcacgaggcgctgcacaaccactacacccagaagtccctgagcctcagccccggg

SEQ ID NO: 8363 - RNA, 654 nt, synthetic construct
  misc_feature 1..654: note = derived and/or modified sequence opt1 from Rafivirumab_LightChain1
  source 1..654: mol_type = other RNA
cagagcgccctgacccagccccgctccgtgagcggctccccggggcagagcgtcaccatctcctgcacgggcaccagctccgacatcgggggctacaacttcgtgagctggtaccagcagcaccccgggaaggcccccaagctcatgatctacgacgcgaccaagcggccctccggcgtgccggaccgcttcagcggctccaagagcgggaacaccgcctccctgacgatcagcggcctgcaggccgaggacgaggccgactactactgctgctcctacgccggggactacacccccggcgtcgtgttcgggggcggcaccaagctcaccgtgctggggcagcccaaggcggcccccagcgtcacgctgttcccgccctccagcgaggagctccaggccaacaaggccaccctggtgtgcctgatctccgacttctaccccggcgcggtgaccgtcgcctggaaggccgacagcagccccgtgaaggccggggtggagaccacgaccccgtccaagcagagcaacaacaagtacgccgcgtccagctacctctccctgacccccgagcagtggaagtcccaccggagctacagctgccaggtcacccacgagggctccacggtggagaagaccgtggcccccaccgagtgcagc

SEQ ID NO: 8364 - RNA, 654 nt, synthetic construct
  misc_feature 1..654: note = derived and/or modified sequence opt1 from Rafivirumab_LightChain
  source 1..654: mol_type = other RNA
gagagcgccctgacccagccccgctccgtgagcggctccccggggcagagcgtcaccatctcctgcacgggcaccagctccgacatcgggggctacaacttcgtgagctggtaccagcagcaccccgggaaggcccccaagctcatgatctacgacgcgaccaagcggccctccggcgtgccggaccgcttcagcggctccaagagcgggaacaccgcctccctgacgatcagcggcctgcaggccgaggacgaggccgactactactgctgctcctacgccggggactacacccccggcgtcgtgttcgggggcggcaccaagctcaccgtgctggggcagcccaaggcggcccccagcgtcacgctgttcccgccctccagcgaggagctccaggccaacaaggccaccctggtgtgcctgatctccgacttctaccccggcgcggtgaccgtcgcctggaaggccgacagcagccccgtgaaggccggggtggagaccacgaccccgtccaagcagagcaacaacaagtacgccgcgtccagctacctctccctgacccccgagcagtggaagtcccaccggagctacagctgccaggtcacccacgagggctccacggtggagaagaccgtggcccccaccgagtgcagc

SEQ ID NO: 8365 - RNA, 1332 nt, synthetic construct
  misc_feature 1..1332: note = derived and/or modified sequence opt1 from Ralpancizumab_HeavyChain1
  source 1..1332: mol_type = other RNA
caggtgcagctggtccagagcggcgccgaggtgaagaagcccggggcctccgtgaaggtcagctgcaaggcgtccggctacaccttcaccagctactacatgcactgggtgcgccaggccccggggcagggcctcgagtggatgggggagatccacccctccggcggccggacgaactacaacgagaagttcaagagccgcgtgaccatgacccgggacacctccacgagcaccgtctacatggagctgtccagcctgcgctccgaggacaccgccgtgtactactgcgcccgggagcgccccctctacgccagcgacctgtgggggcagggcaccacggtgaccgtctccagcgcgtccaccaaggggcccagcgtgttcccgctggccccctgctcccggagcacctccgagagcacggccgccctcggctgcctggtgaaggactacttccccgagcccgtcaccgtgagctggaactccggggcgctgaccagcggcgtgcacaccttcccggccgtcctccagtccagcggcctgtactccctgagctccgtggtgacggtccccagctccaacttcgggacccagacctacacgtgcaacgtggaccacaagcccagcaacaccaaggtggacaagaccgtcgagcgcaagtgctgcgtggagtgcccgccctgccccgccccgcccgtggccggcccctccgtcttcctcttcccgcccaagcccaaggacaccctgatgatcagccggacccccgaggtgacgtgcgtcgtggtggacgtctcccacgaggaccccgaggtgcagttcaactggtacgtggacggggtcgaggtgcacaacgccaagaccaagccccgcgaggagcagttcaacagcaccttccgggtggtctccgtgctgaccgtggtccaccaggactggctcaacggcaaggagtacaagtgcaaggtgagcaacaagggcctgccctccagcatcgagaagacgatctccaagaccaaggggcagccgcgcgagccccaggtgtacaccctgccgcccagccgggaggagatgaccaagaaccaggtcagcctcacgtgcctggtgaagggcttctacccctccgacatcgcggtggagtgggagagcaacgggcagcccgagaacaactacaagaccacgcccccgatgctggactccgacggcagcttcttcctctactccaagctgaccgtcgacaagagccgctggcagcaggggaacgtgttctcctgcagcgtgatgcacgaggccctgcacaaccactacacccagaagtccctcagcctgtcccccggcaag

SEQ ID NO: 8366 - RNA, 642 nt, synthetic construct
  misc_feature 1..642: note = derived and/or modified sequence opt1 from Ralpancizumab_LightChain1
  source 1..642: mol_type = other RNA
gacatccagatgacgcagagcccctccagcctgtccgccagcgtgggcgaccgcgtcaccatcacgtgcaaggcctcccaggacgtgcacaccgcggtggcctggtaccagcagaagccggggaaggcccccaagctcctgatctaccacgccagctaccggtacaccggcgtcccctcccgcttcagcgggtccggcagcgggaccgacttcacgttcaccatctccagcctgcagcccgaggacatcgccacctactactgccagcagcggtactccctctggcgcaccttcggccagggcacgaagctggagatcaagcggaccgtggcggccccgagcgtgttcatcttcccgccctccgacgagcagctcaagagcgggaccgcctccgtcgtgtgcctgctgaacaacttctacccccgcgaggccaaggtgcagtggaaggtcgacaacgcgctgcagagcggcaactcccaggagagcgtgaccgagcaggacagcaaggactccacgtacagcctctccagcaccctgaccctgtccaaggccgactacgagaagcacaaggtgtacgcctgcgaggtcacccaccaggggctcagctcccccgtgaccaagagcttcaaccggggcgagtgc

SEQ ID NO: 8367 - RNA, 1338 nt, synthetic construct
  misc_feature 1..1338: note = derived and/or modified sequence opt1 from Ramucirumab_HeavyChain1
  source 1..1338: mol_type = other RNA
gaggtgcagctggtccagagcggcgggggcctcgtgaagcccgggggctccctgcgcctgagctgcgccgcctccgggttcaccttcagctcctacagcatgaactgggtgcggcaggcgccgggcaagggcctcgagtgggtctccagcatctccagctccagctcctacatctactacgccgacagcgtgaaggggcgcttcaccatctcccgggacaacgccaagaacagcctgtacctgcagatgaactccctccgcgccgaggacacggccgtgtactactgcgcgcgggtcaccgacgccttcgacatctggggccaggggaccatggtgaccgtgagctccgccagcacgaagggccccagcgtcttccccctggccccctccagcaagtccaccagcgggggcaccgcggccctgggctgcctcgtgaaggactacttcccggagcccgtgaccgtctcctggaacagcggggccctgacgtccggcgtgcacaccttccccgccgtgctgcagagctccgggctctacagcctgtccagcgtcgtgaccgtgccctccagctccctgggcacccagacgtacatctgcaacgtcaaccacaagccgagcaacaccaaggtggacaagaaggtggagcccaagtcctgcgacaagacccacacgtgcccgccctgcccggcccccgagctcctgggcgggcccagcgtcttcctgttcccgcccaagcccaaggacaccctcatgatctcccgcacccccgaggtgacctgcgtggtcgtggacgtcagccacgaggaccccgaggtgaagttcaactggtacgtggacggcgtcgaggtgcacaacgcgaagaccaagccgcgggaggagcagtacaacagcacgtaccgcgtggtctccgtgctgaccgtgctgcaccaggactggctcaacgggaaggagtacaagtgcaaggtcagcaacaaggccctgcccgcccccatcgagaagaccatctccaaggccaagggccagccccgggagccccaggtgtacaccctgccgcccagccgcgaggagatgacgaagaaccaggtgtccctgacctgcctcgtcaaggggttctaccccagcgacatcgccgtggagtgggagtccaacggccagcccgagaacaactacaagaccaccccgcccgtgctggacagcgacggctccttcttcctctacagcaagctgacggtcgacaagtcccggtggcagcaggggaacgtgttcagctgctccgtgatgcacgaggcgctgcacaaccactacacccagaagtccctcagcctgagccccggcaag

SEQ ID NO: 8368 - RNA, 642 nt, synthetic construct
  misc_feature 1..642: note = derived and/or modified sequence opt1 from Ramucirumab_LightChain1
  source 1..642: mol_type = other RNA
gacatccagatgacccagagcccctccagcgtgtccgccagcatcggcgaccgcgtcaccatcacgtgccgggcctcccaggggatcgacaactggctgggctggtaccagcagaagccggggaaggcgcccaagctcctgatctacgacgccagcaacctggacaccggcgtgccctcccgcttcagcgggtccggcagcggcacctacttcaccctcacgatctccagcctgcaggccgaggacttcgccgtgtacttctgccagcaggccaaggcgttcccgcccaccttcgggggcgggaccaaggtcgacatcaagggcaccgtggccgccccctccgtgttcatcttcccgcccagcgacgagcagctgaagtccgggacggccagcgtcgtgtgcctcctgaacaacttctacccccgggaggcgaaggtgcagtggaaggtcgacaacgccctgcagtccggcaacagccaggagtccgtgaccgagcaggacagcaaggacagcacctactccctcagctccaccctgacgctgagcaaggccgactacgagaagcacaaggtgtacgcctgcgaggtcacccaccagggcctctccagccccgtgaccaagtccttcaaccgcggggagtgc

SEQ ID NO: 8369 - RNA, 687 nt, synthetic construct
  misc_feature 1..687: note = derived and/or modified sequence opt1 from Ranibiziuab_HeavyChain1
  source 1..687: mol_type = other RNA
gaggtgcagctggtcgagagcggcgggggcctcgtgcagcccgggggctccctgcgcctgagctgcgccgcctccgggtacgacttcacccactacggcaactgggtgcggcaggcgccgggcaaggggctcgagtgggtcggctggatcaacacctacacgggggagcccacctacgccgccgacttcaagcgccggttcaccttcagcctggacacctccaagagcacggcctacctgcagaactccctccgcgccgaggacaccgcggtgtactactgcgccaagtacccctactactacggcaccagccactggtacttcgacgtgtgggggcagggcaccctggtcacggtgtccagcgcctccaccaagggccccagcgtgttcccgctggccccctccagcaagtccaccagcgggggcaccgcggccctcgggtgcctggtcaaggactacttccccgagcccgtgacggtgtcctggaacagcggcgccctgacctccggcgtccacaccttcccggccgtgctccagagcagcgggctgtactccctgagctccgtggtcaccgtgcccagctccagcctcggcacgcagacctacatctgcaacgtgaaccacaagccctccaacaccaaggtcgacaagaaggtggagcccaagagctgcgacaagacccacctg

SEQ ID NO: 8370 - RNA, 642 nt, synthetic construct
  misc_feature 1..642: note = derived and/or modified sequence opt1 from Ranibiziuab_LightChain1
  source 1..642: mol_type = other RNA
gacatccagctgacgcagagcccctccagcctctccgccagcgtgggcgaccgcgtcaccatcacgtgctccgccagccaggacatctccaactacctgaactggtaccagcagaagccggggaaggcgcccaaggtgctgatctacttcaccagctccctccacagcggcgtgccctcccggttcagcgggtccggcagcgggaccgacttcaccctgacgatctccagcctgcagcccgaggacttcgccacctactactgccagcagtactccaccgtcccgtggaccttcggccagggcacgaaggtggagatcaagcgcaccgtggccgcccccagcgtcttcatcttcccgccctccgacgagcagctcaagagcgggaccgccagcgtggtgtgcctgctgaacaacttctacccccgggaggcgaaggtccagtggaaggtggacaacgccctccagtccggcaacagccaggagtccgtgaccgagcaggacagcaaggactccacgtacagcctgtccagcaccctgaccctctccaaggccgactacgagaagcacaaggtctacgcctgcgaggtgacccaccaggggctgagctcccccgtgaccaagagcttcaaccgcggcgagtgc

SEQ ID NO: 8371 - RNA, 639 nt, synthetic construct
  misc_feature 1..639: note = derived and/or modified sequence opt1 from Ranibizumab_fab_fragment
  source 1..639: mol_type = other RNA
gacatccagctgacgcagagcccctccagcctctccgccagcgtgggcgaccgcgtcaccatcacgtgctccgccagccaggacatctccaactacctgaactggtaccagcagaagccggggaaggcgcccaaggtgctgatctacttcaccagctccctccacagcggcgtgccctcccggttcagcgggtccggcagcgggaccgacttcaccctgacgatctccagcctgcagcccgaggacttcgccacctactactgccagcagtactccaccgtcccgtggaccttcggccagggcacgaaggtggagatcaagcgcaccgtggccgcccccagcgtcttcatcttcccgccctccgacgagcagctcaagagcgggaccgccagcgtggtgtgcctgctgaacaacttctacccccgggaggcgaaggtccagtggaaggtggacaacgccctccagtccggcaacagccaggagtccgtgaccgagcaggacagcaaggactccacgtacagcctgtccagcaccctgaccctctccaaggccgactacgagaagcacaaggtctacgcctgcgaggtgacccaccaggggctgagctcccccgtgaccaagagcttcaaccgcggcgag

SEQ ID NO: 8372 - RNA, 693 nt, synthetic construct
  misc_feature 1..693: note = derived and/or modified sequence opt1 from Ranibizumab_HeavyChain
  source 1..693: mol_type = other RNA
gaggtgcagctggtcgagagcggcgggggcctcgtgcagcccgggggctccctgcgcctgagctgcgccgcctccgggtacgacttcacccactacggcatgaactgggtgcggcaggcgccgggcaaggggctcgagtgggtcggctggatcaacacctacacgggggagcccacctacgccgccgacttcaagcgccggttcaccttcagcctggacacctccaagagcacggcctacctgcagatgaactccctccgcgccgaggacaccgcggtgtactactgcgccaagtacccctactactacggcaccagccactggtacttcgacgtgtgggggcagggcaccctggtcacggtgtccagcgcctccaccaagggccccagcgtgttcccgctggccccctccagcaagtccaccagcgggggcaccgcggccctcgggtgcctggtcaaggactacttccccgagcccgtgacggtgtcctggaacagcggcgccctgacctccggcgtccacaccttcccggccgtgctccagagcagcgggctgtactccctgagctccgtggtcaccgtgcccagctccagcctcggcacgcagacctacatctgcaacgtgaaccacaagccctccaacaccaaggtcgacaagaaggtggagcccaagagctgcgacaagacccacctg

SEQ ID NO: 8373 - RNA, 654 nt, synthetic construct
  misc_feature 1..654: note = derived and/or modified sequence opt1 from Ranibizumab_LightChain
  source 1..654: mol_type = other RNA
gaggtgcagctggtcgagagcggcgggggcctcgtgcagcccgggggctccctgcgcctgagctgcgccgcctccgggtacgacttcacccactacggcatgaactgggtgcggcaggcgccgggcaaggggctcgagtgggtcggctggatcaacacctacacgggggagcccacctacgccgccgacttcaagcgccggttcaccttcagcctggacacctccaagagcacggcctacctgcagatgaactccctccgcgccgaggacaccgcggtgtactactgcgccaagtacccctactactacggcaccagccactggtacttcgacgtgtgggggcagggcaccctggtcacggtgtccagcgcctccaccaagggccccagcgtgttcccgctggccccctccgggaccgcggccctcggctgcctggtcaaggactacttccccgagcccgtgaccgtgagctggaactccggggccctgacgagcggcgtccacaccttcccggccgtgctccagtccagcggcctgtactccctgagcagcgtggtcaccgtgccctccagctccctcgggacccagacgtacatctgcaacgtgaaccacaagcccagcaacaccaaggtcgacaagaaggtggagcccaag

SEQ ID NO: 8374 - RNA, 642 nt, synthetic construct; identical to SEQ ID NO: 8370
  misc_feature 1..642: note = derived and/or modified sequence opt1 from Ranibizumab_LightChain_variant
  source 1..642: mol_type = other RNA

SEQ ID NO: 8375 - RNA, 1368 nt, synthetic construct
  misc_feature 1..1368: note = derived and/or modified sequence opt1 from Refanezumab_HeavyChain1
  source 1..1368: mol_type = other RNA
caggtgcagctggtccagagcggctccgagctcaagaagcccggggccagcgtgaaggtgtcctgcaaggccagcggctacaccttcaccaactacgggatgaactgggtccgccaggcgccgggccaggggctggagtggatgggctggatcaacacgtacaccggcgagcccacctacgccgacgacttcaccgggcggttcgtgttctccctggacacgagcgtgtccaccgcctacctccagatcagctccctgaaggccgaggacaccgccgtctactactgcgcgcgcaaccccatcaactactacggcatcaactacgaggggtacgtgatggactactggggccaggggaccctggtgacggtcagctccgccagcaccaagggcccctccgtgttcccgctcgcccccagctccaagagcacctccggcgggaccgccgcgctgggctgcctggtgaaggactacttccccgagcccgtcacggtgagctggaactccggggccctcaccagcggcgtgcacaccttcccggccgtcctgcagagctccggcctgtacagcctctccagcgtggtgaccgtcccctccagctccctggggacgcagacctacatctgcaacgtgaaccacaagcccagcaacaccaaggtggacaagaaggtcgagcccaagtcctgcgacaagacccacacgtgcccgccctgccccgcccccgagctggccggcgcgccgagcgtgttcctcttcccgcccaagcccaaggacaccctgatgatctcccggacccccgaggtgacctgcgtcgtggtcgacgtgagccacgaggaccccgaggtgaagttcaactggtacgtcgacggggtggaggtgcacaacgccaagacgaagccccgcgaggagcagtacaactccacctaccgggtcgtgagcgtgctgaccgtcctccaccaggactggctgaacggcaaggagtacaagtgcaaggtgtccaacaaggccctgcccgccccgatcgagaagaccatcagcaaggccaaggggcagccccgcgagccccaggtgtacacgctgcccccgtcccgggacgagctcaccaagaaccaggtcagcctgacctgcctcgtgaagggcttctacccctccgacatcgcggtggagtgggagagcaacggccagcccgagaacaactacaagaccacgccgcccgtcctggacagcgacgggtccttcttcctgtacagcaagctcaccgtggacaagtcccgctggcagcagggcaacgtgttcagctgctccgtcatgcacgaggccctgcacaaccactacacccagaagtccctgagcctcagccccgggaag

SEQ ID NO: 8376 - RNA, 657 nt, synthetic construct
  misc_feature 1..657: note = derived and/or modified sequence opt1 from Refanezumab_LightChain1
  source 1..657: mol_type = other RNA
gacatcgtgatgacccagagccccgactccctggccgtcagcctcggcgagcgcgccaccatcaactgcaagtccagccactccgtgctgtacagctccaaccagaagaactacctggcgtggtaccagcagaagccggggcagccgcccaagctcctgatctactgggccagcacgcgggagtccggcgtgcccgaccgcttcagcgggtccggcagcgggaccgacttcaccctgaccatctccagcctccaggccgaggacgtcgccgtgtactactgccaccagtacctgtccagcctgacgttcggccagggcaccaagctcgagatcaagcggaccgtggccgcgccctccgtcttcatcttcccgcccagcgacgagcagctgaagtccgggaccgccagcgtggtgtgcctgctcaacaacttctacccccgcgaggccaaggtccagtggaaggtggacaacgccctgcagagcggcaactcccaggagagcgtgacggagcaggactccaaggacagcacctactccctgagctccaccctcaccctgagcaaggcggactacgagaagcacaaggtctacgcctgcgaggtgacgcaccaggggctgtccagccccgtgaccaagtccttcaaccggggcgagtgc

SEQ ID NO: 8377 - RNA, 1314 nt, synthetic construct
  misc_feature 1..1314: note = derived and/or modified sequence opt1 from REGN2810_HeavyChain1
  source 1..1314: mol_type = other RNA
gaggtgcagctgctcgagagcggcggggtcctggtgcagcccggcgggtccctgcgcctcagctgcgccgcctccggcttcaccttcagcaacttcgggacctgggtgcggcaggcgcccggcaagggcctggagtgggtctccgggatcagcggcgggggccgcgacacgtacttcgccgactccgtgaaggggcggttcaccatcagccgcgacaactccaagaacaccctgtacctccagaacagcctgaagggcgaggacaccgccgtgtactactgcgtcaagtggggcaacatctacttcgactactgggggcagggcacgctggtgaccgtgtccagcgcctccaccaaggggcccagcgtcttccccctcgccccctgctcccggagcacctccgagagcacggcggccctgggctgcctggtgaaggactacttcccggagcccgtgaccgtctcctggaacagcggcgccctcaccagcggggtgcacaccttccccgccgtgctgcagtccagcggcctgtactccctcagctccgtcgtgacggtgcccagctccagcctggggaccaagacctacacgtgcaacgtcgaccacaagccgtccaacaccaaggtggacaagcgcgtggagagcaagtacggcccgccctgcccgccctgccccgcgcccgagttcctcgggggcccctccgtcttcctgttcccgcccaagcccaaggacaccctgatcagccggacccccgaggtgacctgcgtggtcgtggacgtctcccaggaggacccggaggtgcagttcaactggtacgtggacggcgtcgaggtgcacaacgccaagacgaagccccgcgaggagcagttcaacagcacctaccgggtggtctccgtgctgaccgtgctccaccaggactggctgaacgggaaggagtacaagtgcaaggtcagcaacaagggcctgccctccagcatcgagaagaccatctccaaggccaaggggcagccccgcgagccccaggtgtacacgctcccgcccagccaggaggagaccaagaaccaggtgagcctgacctgcctggtcaagggcttctacccctccgacatcgccgtggagtgggagagcaacgggcagcccgagaacaactacaagaccacgccgcccgtgctcgactccgacggcagcttcttcctgtactcccggctgaccgtcgacaagagccgctggcaggagggcaacgtgttctcctgcagcgtgcacgaggccctccacaaccactacacccagaagtccctgagcctgtccctcggg

SEQ ID NO: 8378 - RNA, 639 nt, synthetic construct
  misc_feature 1..639: note = derived and/or modified sequence opt1 from REGN2810_LightChain1
  source 1..639: mol_type = other RNA
gacatccagacccagagcccctccagcctgtccgccagcgtgggcgactccatcaccatcacgtgccgcgccagcctctccatcaacaccttcctgaactggtaccagcagaagccggggaaggcgcccaacctgctcatctacgccgccagctccctgcacggcggggtccccagccggttctccggcagcgggtccggcaccgacttcaccctgacgatccgcaccctccagcccgaggacttcgccacctactactgccagcagagctccaacaccccgttcacgttcggccccgggaccgtggtggacttccggcgcaccgtcgccgcgcccagcgtgttcatcttcccgccctccgacgagcagctcaagagcggcaccgcctccgtggtctgcctgctgaacaacttctacccccgggaggccaaggtgcagtggaaggtggacaacgccctgcagagcgggaacagccaggagtccgtcacggagcaggacagcaaggactccacctacagcctgtccagcaccctcaccctgtccaaggcggactacgagaagcacaaggtgtacgcctgcgaggtgacgcaccagggcctgagctcccccgtcaccaagagcttcaaccgcggggagtgc

SEQ ID NO: 8379 - RNA, 651 nt, synthetic construct
  misc_feature 1..651: note = derived and/or modified sequence opt1 from rhuMab_HER2(9CI)_LightChain
  source 1..651: mol_type = other RNA
gtgcacagcgacatccagatgacccagtcccccagctccctgagcgcctccgtcggcgaccgggtgaccatcacgtgcaaggccagccaggacgtgtccatcggggtcgcgtggtaccagcagaagccgggcaaggcccccaagctcctgatctacagcgcctcctaccggtacaccggggtgcccagccgcttctccggcagcgggtccggcaccgacttcaccctgacgatcagctccctccagcccgaggacttcgccacctactactgccagcagtactacatctacccgtacaccttcggccaggggaccaaggtggagatcaagcggacggtcgccgcgcccagcgtgttcatcttcccgccctccgacgagcagctcaagagcggcaccgcctccgtggtctgcctgctgaacaacttctacccccgcgaggccaaggtgcagtggaaggtggacaacgccctgcagagcgggaacagccaggagtccgtcaccgagcaggacagcaaggactccacctacagcctgtccagcacgctcaccctgtccaaggcggactacgagaagcacaaggtgtacgcctgcgaggtgacccaccagggcctgagctcccccgtcaccaagagcttcaaccgcggggagtgc

SEQ ID NO: 8380 - RNA, 1215 nt, synthetic construct
  misc_feature 1..1215: note = derived and/or modified sequence opt1 from rhuMab_HER2_HeavyChain
  source 1..1215: mol_type = other RNA
gaggtgcagctggtcgagagcggcgggggcctcgtgcagcccgggggctccctgcgcctgagctgcgccgcctccgggttcaccttcaccgactacacgatggactgggtgcggcaggcgccgggcaagggcctcaccgccgtctactactgcgcccgcaacctggggcccagcttctacttcgactactggggccaggggaccctggtgaccgtgtccagcgcctccacgaagggccccagcgtcttccccctcgccccgtccagcaagtccaccagcgggggcaccgcggccctgggctgcctggtgaaggactacttccccgagcccgtgaccgtctcctggaacagcggggccctcacgtccggcgtgcacaccttccccgccgtgctgcagagctccgggctgtacagcctctccagcgtcgtgaccgtgccgagctccagcctgggcacccagacgtacatctgcaacgtcaaccacaagccctccaacaccaaggtggacaagaaggtggagcccaagagctgcgacaagacccacacgtgcccgccctgccccgcgcccgagctgctcggcgggccctccgtcttcctgttcccgcccaagcccaaggacaccctgatgatcagccggacccccgaggtgacctgcgtggtcgtggacgtgtcccacgaggacccggaggtcaagttcaactggtacgtggacggcgtcgaggtgcacaacgccaagaccaagccccgcgaggagcagtacaacagcacgtaccgggtggtctccgtgctcaccgtgctgcaccaggactggctgaacgggaaggagtacaagtgcaaggtcagcaacaaggccctccccgcccccatcgagaagaccatctccaaggccaagggccagccgcgcgagccccaggtgtacaccctgccgcccagccgggaggagatgacgaagaaccaggtgtccctgacctgcctcgtcaaggggttctaccccagcgacatcgcggtggagtgggagtccaacggccagcccgagaacaactacaagaccacgcccccggtgctggacagcgacggctccttcttcctgtacagcaagctcaccgtcgacaagtcccgctggcagcaggggaacgtgttcagctgcagcgtgatgcacgaggccctgcacaaccactacacccagaagtccctgagcctctcccccggccccaag

SEQ ID NO: 8381 - RNA, 645 nt, synthetic construct
  misc_feature 1..645: note = derived and/or modified sequence opt1 from rhuMab_HER2_LightChain
  source 1..645: mol_type = other RNA
agcgacatccagatgacccagtcccccagctccctgagcgcctccgtgggcgaccgcgtcaccatcacgtgccgggccagccaggacgtgaacaccgcggtggcctggtaccagcagaagccggggaaggcccccaagctcctgatctactccgccagcttcctgtactccggcgtccccagccgcttctccgggagccggtccggcaccgacttcaccctcacgatcagctccctgcagcccgaggacttcgccacctactactgccagcagcactacaccaccccgcccacgttcgggcagggcaccaaggtggagatcaagcgcaccgtggcggcccccagcgtcttcatcttcccgccctccgacgagcagctcaagagcggcaccgcctccgtggtgtgcctgctgaacaacttctacccccgggaggccaaggtccagtggaaggtggacaacgcgctgcagagcgggaacagccaggagtccgtgacggagcaggacagcaaggactccacctacagcctctccagcaccctgaccctgtccaaggccgactacgagaagcacaaggtctacgcctgcgaggtgacgcaccagggcctcagctcccccgtgaccaagagcttcaaccgcggggagtgc

SEQ ID NO: 8382 - RNA, 318 nt, synthetic construct
  misc_feature 1..318: note = derived and/or modified sequence opt1 from rhuMab_HER2_LightChain_variant1
  source 1..318: mol_type = other RNA
accgtggccgcccccagcgtcttcatcttcccgccctccgacgagcagctcaagagcggcaccgcgtccgtggtgtgcctgctgaacaacttctacccccgggaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccagggcctctccagccccgtgaccaagtccttcaaccgcggggagtgc

SEQ ID NO: 8383 - RNA, 642 nt, synthetic construct
  misc_feature 1..642: note = derived and/or modified sequence opt1 from rhuMab_HER2_LightChain_variant2
  source 1..642: mol_type = other RNA
gacatccagatgacccagagcccctccagcctgtccgccagcgtgggcgaccgcgtcaccatcacgtgccgggcctcccaggacgtgaacaccgcggtggcctggtaccagcagaagccggggaaggcccccaagctcctgatctacagcgcctccttcctgtacagcggcgtcccctcccgcttcagcgggtcccggagcggcaccgacttcaccctcacgatctccagcctgcagcccgaggacttcgccacctactactgccagcagcactacaccaccccgcccacgttcgggcagggcaccaaggtggagatcaagcggacctgcgcggccccctccgtgttcatcttcccgcccagcgacgagcagctgaagtccggcaccgccagcgtcgtgtgcctcctgaacaacttctacccccgcgaggccaaggtgcagtggaaggtcgacaacgcgctgcagtccgggaacagccaggagagcgtgacggagcaggactccaaggacagcacctactccctcagctccaccctgaccctgagcaaggccgactacgagaagcacaaggtgtacgcctgcgaggtcacgcaccagggcctctccagccccgtgaccaagtccttcaaccgcggggagtgc

SEQ ID NO: 8384 - RNA, 642 nt, synthetic construct
  misc_feature 1..642: note = derived and/or modified sequence opt1 from rhuMab_HER2_LightChain_variant3
  source 1..642: mol_type = other RNA
gacatccagatgacccagagcccctccagcctgtccgccagcgtgggcgaccgcgtcaccatcacgtgccgggcctcccaggacgtgaacaccgcggtggcctggtaccagcagaagccggggaaggcccccaagctcctgatctacagcgcctccttcctgtacagcggcgtcccctcccgcttcagcgggtcccggagcggcaccgacttcaccctcacgatctccagcctgcagcccgaggacttcgccacctactactgccagcagcactacaccaccccgcccacgttcgggcagggcaccaaggtggagatcaagcgcaccgtggcggccccctccgtcttcatcttcccgcccagcgacgagcagctgaagtccggcaccgccagcgtggtgtgcctcctgaacaacttctacccccgggaggccaaggtccagtggaaggtggacaacgcgctgcagtccgggaacagccaggagagcgtgacggagcaggactccaaggacagcacctactccctcagctccaccctgaccctgagcaaggccgactacgagaagcacaaggtctacgcctgcgaggtgacgcaccagggcctctccagccccgtgaccaagtccttcaaccgcggggagtgc

SEQ ID NO: 8385 - RNA, 645 nt, synthetic construct; identical to SEQ ID NO: 8381
  misc_feature 1..645: note = derived and/or modified sequence opt1 from rhuMab_HER2_LightChain_variant4
  source 1..645: mol_type = other RNA

SEQ ID NO: 8386 - RNA, 321 nt, synthetic construct
  misc_feature 1..321: note = derived and/or modified sequence opt1 from rhuMab_HER2_LightChain_V-Region
  source 1..321: mol_type = other RNA
gacatccagatgacccagagcccctccagcctgtccgccagcgtgggcgaccgcgtcaccatcacgtgccgggcctcccaggacgtgaacaccgcggtggcctggtaccagcagaagccggggaaggcccccaagctcctgatctacagcgcctccttcctgtacagcggcgtcccctcccgcttcagcgggtcccggagcggcaccgacttcaccctcacgatctccagcctgcagcccgaggacttcgccacctactactgccagcagcactacaccaccccgcccacgttcgggcagggcaccaaggtggagatcaag

SEQ ID NO: 8387 - RNA, 1350 nt, synthetic construct
  misc_feature 1..1350: note = derived and/or modified sequence opt1 from rhuMab_HER2_gamma1-Chain
  source 1..1350: mol_type = other RNA
gaggtgcagctggtcgagagcggcgggggcctcgtgcagcccgggggctccctgcgcctgagctgcgccgcctccgggttcaacatcaaggacacctacatccactgggtgcggcaggcgccgggcaagggcctcgagtgggtcgcccgcatctaccccaccaacgggtacacgcggtacgccgacagcgtgaagggccgcttcaccatctccgccgacaccagcaagaacaccgcctacctgcagatgaactccctgcgggcggaggacacggccgtgtactactgcagccgctggggcggggacgggttctacgccatggactactggggccagggcaccctcgtcaccgtgtccagcgcctccaccaaggggcccagcgtgttccccctggcgccgtccagcaagtccacgagcggcgggaccgccgccctgggctgcctcgtcaaggactacttccccgagcccgtgaccgtgtcctggaacagcggcgccctgacctccggggtccacacgttccccgccgtgctgcagagcagcggcctctactccctgagctccgtggtcaccgtgccgagctccagcctggggacccagacctacatctgcaacgtgaaccacaagccctccaacacgaaggtcgacaagaaggtggagcccaagagctgcgacaagacccacacgtgcccgccctgccccgcgcccgagctcctgggcgggccctccgtgttcctgttcccgcccaagcccaaggacaccctcatgatcagccggacccccgaggtgacctgcgtcgtggtcgacgtgtcccacgaggacccggaggtcaagttcaactggtacgtggacggcgtggaggtccacaacgccaagaccaagccccgcgaggagcagtacaacagcacctaccgggtggtgtccgtcctgacggtgctgcaccaggactggctcaacggcaaggagtacaagtgcaaggtgagcaacaaggccctgcccgcccccatcgagaagaccatctccaaggccaaggggcagccgcgcgagccccaggtctacaccctgccgcccagccgggaggagatgaccaagaaccaggtgtccctcacgtgcctggtgaagggcttctaccccagcgacatcgcggtcgagtgggagtccaacgggcagcccgagaacaactacaagaccacgcccccggtgctggacagcgacggcagcttcttcctctactccaagctgaccgtggacaagagccgctggcagcaggggaacgtcttctcctgcagcgtgatgcacgaggccctgcacaaccactacacccagaagtccctcagcctgtcccccggcaag

SEQ ID NO: 8388 - RNA, 1350 nt, synthetic construct
  misc_feature 1..1350: note = derived and/or modified sequence opt1 from rhuMab_HER2__gamma1-Chain
  source 1..1350: mol_type = other RNA
gaggtgcagctggtcgagagcggcgggggcctcgtgcagcccgggggctccctgcgcctgagctgcgccgcctccgggttcaacatcaaggacacctacatccactgggtgcggcaggcgccgggcaagggcctcgagtgggtcgcccgcatctaccccaccaacgggtacacgcggtacgccgacagcgtgaagggccgcttcaccatctccgccgacaccagcaagaacaccgcctacctgcagatgaactccctgcgggcggaggacacggccgtgtactactgcagccgctggggcggggacgggttctacgccatggactactggggccagggcaccctcgtcaccgtgtccagctgctccaccaaggggcccagcgtgttccccctggccccgtccagcaagtccacgagcggcgggaccgcggccctgggctgcctcgtcaaggactacttccccgagcccgtgaccgtgtcctggaacagcggcgccctgacctccggggtccacacgttccccgccgtgctgcagagcagcggcctctactccctgagctccgtggtcaccgtgccgagctccagcctggggacccagacctacatctgcaacgtgaaccacaagccctccaacacgaaggtcgacaagaaggtggagcccaagagctgcgacaagacccacacgtgcccgccctgccccgcccccgagctcctgggcgggccctccgtgttcctgttcccgcccaagcccaaggacaccctcatgatcagccggacccccgaggtgacctgcgtcgtggtcgacgtgtcccacgaggacccggaggtcaagttcaactggtacgtggacggcgtggaggtccacaacgcgaagaccaagccccgcgaggagcagtacaacagcacctaccgggtggtgtccgtcctgacggtgctgcaccaggactggctcaacggcaaggagtacaagtgcaaggtgagcaacaaggccctgcccgcccccatcgagaagaccatctccaaggccaaggggcagccgcgcgagccccaggtctacaccctgccgcccagccgggaggagatgaccaagaaccaggtgtccctcacgtgcctggtgaagggcttctaccccagcgacatcgccgtcgagtgggagtccaacgggcagcccgagaacaactacaagaccacgcccccggtgctggacagcgacggcagcttcttcctctactccaagctgaccgtggacaagagccgctggcagcaggggaacgtcttctcctgcagcgtgatgcacgaggcgctgcacaaccactacacccagaagtccctcagcctgtcccccggcaag

SEQ ID NO: 8389 - RNA, 729 nt, synthetic construct
  misc_feature 1..729: note = derived and/or modified sequence opt1 from rhuMab_HER2_gamma1-Chain__rhuMab_HER2_LightChain_sc4D5
  source 1..729: mol_type = other RNA
gaggtgcagctggtcgagagcggcgggggcctcgtgcagcccgggggctccctgcgcctgagctgcgccgcctccgggttcaacatcaaggacacctacatccactgggtgcggcaggcgccgggcaagggcctcgagtgggtcgcccgcatctaccccaccaacgggtacacgcggtacgccgacagcgtgaagggccgcttcaccatctccgccgacaccagcaagaacaccgcctacctgcagatgaactccctgcgggcggaggacacggccgtgtactactgcagccgctggggcggggacgggttctacgccatggactactggggccagggcaccctcgtcaccgtgtccagcgggggcgggggctccggcgggggcgggagcggcgggggcggctccgacatccagatgacccagagcccctccagcctgtccgccagcgtgggggaccgggtcacgatcacgtgccgcgcgtcccaggacgtgaacaccgccgtggcctggtaccagcagaagcccggcaaggccccgaagctgctcatctacagcgccagcttcctgtactccggggtccccagccggttctccggcagccgctccgggaccgacttcaccctgaccatcagctccctccagcccgaggacttcgcgacctactactgccagcagcactacaccacgcccccgaccttcggccagggcaccaaggtggagatcaagcgg

SEQ ID NO: 8390 - RNA, 1350 nt, synthetic construct; identical to SEQ ID NO: 8387
  misc_feature 1..1350: note = derived and/or modified sequence opt1 from rhuMab_HER2_gamma1-Chain_variant1
  source 1..1350: mol_type = other RNA

SEQ ID NO: 8391 - RNA, 1350 nt, synthetic construct; identical to SEQ ID NO: 8388
  misc_feature 1..1350: note = derived and/or modified sequence opt1 from rhuMab_HER2_gamma1-Chain_variant2
  source 1..1350: mol_type = other RNA

SEQ ID NO: 8392 - RNA, 1350 nt, synthetic construct
  misc_feature 1..1350: note = derived and/or modified sequence opt1 from rhuMab_HER2_gamma1-Chain_variant3
  source 1..1350: mol_type = other RNA
gaggtgcagctggtcgagagcggcgggggcctcgtgcagcccgggggctccctgcgcctgagctgcgccgcctccgggttcaacatcaaggacacctacatccactgggtgcggcaggcgccgggcaagggcctcgagtgggtcgcccgcatctaccccaccaacgggtacacgcggtacgccgacagcgtgaagggccgcttcaccatctccgccgacaccagcaagaacaccgcctacctgcagatgaactccctgcggtgcgaggacacggcggtgtactactgcagccgctggggcggggacgggttctacgccatggactactggggccagggcaccctcgtcaccgtgtccagcgcctccaccaaggggcccagcgtgttccccctggccccgtccagcaagtccacgagcggcgggaccgcggccctgggctgcctcgtcaaggactacttccccgagcccgtgaccgtgtcctggaacagcggcgccctgacctccggggtccacacgttccccgccgtgctgcagagcagcggcctctactccctgagctccgtggtcaccgtgccgagctccagcctggggacccagacctacatctgcaacgtgaaccacaagccctccaacacgaaggtcgacaagaaggtggagcccaagagctgcgacaagacccacacgtgcccgccctgccccgcccccgagctcctgggcgggccctccgtgttcctgttcccgcccaagcccaaggacaccctcatgatcagccggacccccgaggtgacctgcgtcgtggtcgacgtgtcccacgaggacccggaggtcaagttcaactggtacgtggacggcgtggaggtccacaacgcgaagaccaagccccgcgaggagcagtacaacagcacctaccgggtggtgtccgtcctgacggtgctgcaccaggactggctcaacggcaaggagtacaagtgcaaggtgagcaacaaggccctgcccgcccccatcgagaagaccatctccaaggccaaggggcagccgcgcgagccccaggtctacaccctgccgcccagccgggaggagatgaccaagaaccaggtgtccctcacgtgcctggtgaagggcttctaccccagcgacatcgccgtcgagtgggagtccaacgggcagcccgagaacaactacaagaccacgcccccggtgctggacagcgacggcagcttcttcctctactccaagctgaccgtggacaagagccgctggcagcaggggaacgtcttctcctgcagcgtgatgcacgaggcgctgcacaaccactacacccagaagtccctcagcctgtcccccggcaag

SEQ ID NO: 8393 - RNA, 360 nt, synthetic construct
  misc_feature 1..360: note = derived and/or modified sequence opt1 from rhuMab_HER2_gamma1-Chain_V-Region
  source 1..360: mol_type = other RNA
gaggtgcagctggtcgagagcggcgggggcctcgtgcagcccgggggctccctgcgcctgagctgcgccgcctccgggttcaacatcaaggacacctacatccactgggtgcggcaggcgccgggcaagggcctcgagtgggtcgcccgcatctaccccaccaacgggtacacgcggtacgccgacagcgtgaagggccgcttcaccatctccgccgacaccagcaagaacaccgcctacctgcagatgaactccctgcgggcggaggacacggccgtgtactactgcagccgctggggcggggacgggttctacgccatggactactggggccagggcaccctcgtcaccgtgtccagc

SEQ ID NO: 8394 - RNA, 1359 nt, synthetic construct; identical to SEQ ID NO: 7725
  misc_feature 1..1359: note = derived and/or modified sequence opt1 from rhuMAb-VEGF_HeavyChain1
  source 1..1359: mol_type = other RNA

SEQ ID NO: 8395 - RNA, 642 nt, synthetic construct; identical to SEQ ID NO: 7726
  misc_feature 1..642: note = derived and/or modified sequence opt1 from rhuMAb-VEGF_LightChain1
  source 1..642: mol_type = other RNA

SEQ ID NO: 8396 - RNA, 642 nt, synthetic construct; identical to SEQ ID NO: 7726
  misc_feature 1..642: note = derived and/or modified sequence opt1 from rhuMAb-VEGF_LightChain
  source 1..642: mol_type = other RNA

SEQ ID NO: 8397 - RNA, 321 nt, synthetic construct; identical to SEQ ID NO: 7735
  misc_feature 1..321: note = derived and/or modified sequence opt1 from rhuMAb-VEGF_LightChain__VG-Region
  source 1..321: mol_type = other RNA

SEQ ID NO: 8398 - RNA, 1359 nt, synthetic construct; identical to SEQ ID NO: 7725
  misc_feature 1..1359: note = derived and/or modified sequence opt1 from rhuMAb-VEGF_gamma1-Chain
  source 1..1359: mol_type = other RNA

SEQ ID NO: 8399 - RNA, 369 nt, synthetic construct; identical to SEQ ID NO: 7730
  misc_feature 1..369: note = derived and/or modified sequence opt1 from rhuMAb-VEGF_gamma1-Chain_VDG-Region
  source 1..369: mol_type = other RNA

SEQ ID NO: 8400 - RNA, 1338 nt, synthetic construct
  misc_feature 1..1338: note = derived and/or modified sequence opt1 from Rilotumumab_HeavyChain1
  source 1..1338: mol_type = other RNA
caggtgcagctgcaggagagcggccccgggctcgtcaagccctccgagaccctgagcctgacctgcacggtgtccggcgggagcatctccatctactactggagctggatccgccagccgcccggcaaggggctcgagtggatcggctacgtgtactactccggcagcaccaactacaacccctccctcaagagccgggtcaccatctccgtggacaccagcaagaaccagttctccctgaagctcaacagcgtgacggccgccgacaccgcggtctactactgcgcccgcgggggctacgacttctggtccgggtacttcgactactggggccaggggaccctggtgaccgtgagctccgccagcacgaagggcccctccgtcttccccctggccccctgcagccggagcacctccgagagcaccgccgcgctcggctgcctggtgaaggactacttccccgagccggtgaccgtctcctggaacagcggggccctgacgtccggcgtgcacaccttccccgccgtgctccagagctccgggctgtacagcctgtccagcgtcgtgaccgtgccctccagcaacttcggcacccagacgtacacgtgcaacgtcgaccacaagccctccaacaccaaggtggacaagaccgtggagcgcaagtgctgcgtcgagtgcccgccctgccccgcgcccccggtggccggccccagcgtgttcctcttcccgcccaagcccaaggacaccctgatgatctcccggacccccgaggtgacctgcgtcgtcgtggacgtgagccacgaggaccccgaggtccagttcaactggtacgtggacggggtggaggtccacaacgccaagaccaagccccgcgaggagcagttcaactccacgttccgggtggtgagcgtcctgaccgtggtgcaccaggactggctcaacggcaaggagtacaagtgcaaggtctccaacaaggggctgccggcccccatcgagaagaccatcagcaagaccaagggccagccccgcgagccccaggtgtacacgctgccgcccagccgggaggagatgaccaagaaccaggtgtccctgacctgcctggtcaaggggttctaccccagcgacatcgccgtggagtgggagtccaacggccagccggagaacaactacaagaccacgccgcccatgctggacagcgacggctccttcttcctctacagcaagctgaccgtggacaagtcccgctggcagcaggggaacgtcttcagctgctccgtgatgcacgaggccctgcacaaccactacacccagaagtccctcagcctgagccccggcaag

SEQ ID NO: 8401 - RNA, 645 nt, synthetic construct
  misc_feature 1..645: note = derived and/or modified sequence opt1 from Rilotumumab_LightChain1
  source 1..645: mol_type = other RNA
gagatcgtgatgacccagagccccgccaccctgtccgtcagcccgggcgagcgggccacgctctcctgccgggcgagccagtccgtggacagcaacctggcctggtaccgccagaagcccgggcaggcgccccggctgctcatctacggcgcctccacccgcgccaccgggatccccgcccggttcagcggctccgggagcggcaccgagttcacgctgaccatctccagcctgcagtccgaggacttcgccgtgtactactgccagcagtacatcaactggccgcccatcaccttcggccaggggacccgcctcgagatcaagcggacggtcgccgcccccagcgtgttcatcttcccgccctccgacgagcagctcaagagcggcaccgcgtccgtggtctgcctgctgaacaacttctacccccgcgaggccaaggtgcagtggaaggtggacaacgccctgcagagcgggaactcccaggagagcgtcaccgagcaggacagcaaggactccacctacagcctgtccagcacgctcaccctgtccaaggccgactacgagaagcacaaggtgtacgcctgcgaggtgacccaccagggcctgagctcccccgtcaccaagagcttcaaccgcggggagtgc

SEQ ID NO: 8402 - RNA, 1071 nt, synthetic construct; identical to SEQ ID NO: 8359
  misc_feature 1..1071: note = derived and/or modified sequence opt1 from Rilotumumab_scFv-CH_chain
  source 1..1071: mol_type = other RNA

SEQ ID NO: 8403 - RNA, 1347 nt, synthetic construct
  misc_feature 1..1347: note = derived and/or modified sequence opt1 from Rinucumab_HeavyChain1
  source 1..1347: mol_type = other RNA
cagctgcagctccaggagagcggccccgggctggtgaagccgtccgagaccctgagcctgacctgcacggtctccggcgggagcatcacctccagctcctactactggggctggatccgccagccgcccgggaagggcctcgagtggatcggcagcatctactaccgggggtccaccaactacaaccccagcctgaagtcccgcgtgaccatcagcgtggactccagcaagaaccagttctacctcaaggtctccagcgtgacggccgtggacaccgccgtctactactgcgcgcggcagaacggcgccgcccgcccctcctggttcgacccctgggggcagggcaccctggtgaccgtgagctccgccagcacgaaggggcccagcgtcttccccctggccccgtgctcccggagcacctccgagagcaccgcggccctcggctgcctggtgaaggactacttccccgagcccgtgaccgtctcctggaacagcggcgccctgacgtccggggtgcacaccttccccgccgtgctccagagctccggcctgtacagcctgtccagcgtcgtgaccgtgccgtccagctccctcgggaccaagacgtacacgtgcaacgtcgaccacaagcccagcaacaccaaggtggacaagcgcgtggagtccaagtacggcccgccctgcccgccctgccccgcgcccgagttcctgggcgggcccagcgtcttcctgttcccgcccaagcccaaggacaccctcatgatctcccggacccccgaggtgacctgcgtggtcgtggacgtcagccaggaggaccccgaggtgcagttcaactggtacgtggacggcgtcgaggtgcacaacgccaagaccaagccccgcgaggagcagttcaacagcacctaccgggtggtctccgtgctgacggtgctgcaccaggactggctcaacgggaaggagtacaagtgcaaggtcagcaacaagggcctgccctccagcatcgagaagaccatctccaaggccaaggggcagccgcgcgagccccaggtgtacaccctgcccccgagccaggaggagatgaccaagaaccaggtgtccctcacgtgcctggtcaagggcttctaccccagcgacatcgccgtggagtgggagtccaacggccagcccgagaacaactacaagaccacgcccccggtgctggacagcgacgggtccttcttcctctacagccggctgaccgtcgacaagtcccgctggcaggagggcaacgtgttcagctgctccgtgatgcacgaggccctgcacaaccactacacccagaagtccctcagcctgagcctggggaag

SEQ ID NO: 8404 - RNA, 1344 nt, synthetic construct
  misc_feature 1..1344: note = derived and/or modified sequence opt1 from Rinucumab_HeavyChain
  source 1..1344: mol_type = other RNA
cagctgcagctccaggagagcggccccgggctggtgaagccgtccgagaccctgagcctgacctgcacggtctccggcgggagcatcacctccagctcctactactggggctggatccgccagccgcccgggaagggcctcgagtggatcggcagcatctactaccgggggtccaccaactacaaccccagcctgaagtcccgcgtgaccatcagcgtggactccagcaagaaccagttctacctcaaggtctccagcgtgacggccgtggacaccgccgtctactactgcgcgcggcagaacggcgccgcccgcccctcctggttcgacccctgggggcagggcaccctggtgaccgtgagctccgccagcacgaaggggcccagcgtcttccccctggccccgtgctcccggagcacctccgagagcaccgcggccctcggctgcctggtgaaggactacttccccgagcccgtgaccgtctcctggaacagcggcgccctgacgtccggggtgcacaccttccccgccgtgctccagagctccggcctgtacagcctgtccagcgtcgtgaccgtgccgtccagctccctcgggaccaagacgtacacgtgcaacgtcgaccacaagcccagcaacaccaaggtggacaagcgcgtggagtccaagtacggcccgccctgcccgccctgccccgcgcccgagttcctgggcgggcccagcgtcttcctgttcccgcccaagcccaaggacaccctcatgatctcccggacccccgaggtgacctgcgtggtcgtggacgtcagccaggaggaccccgaggtgcagttcaactggtacgtggacggcgtcgaggtgcacaacgccaagaccaagccccgcgaggagcagttcaacagcacctaccgggtggtctccgtgctgacggtgctgcaccaggactggctcaacgggaaggagtacaagtgcaaggtcagcaacaagggcctgccctccagcatcgagaagaccatctccaaggccaaggggcagccgcgcgagccccaggtgtacaccctgcccccgagccaggaggagatgaccaagaaccaggtgtccctcacgtgcctggtcaagggcttctaccccagcgacatcgccgtggagtgggagtccaacggccagcccgagaacaactacaagaccacgcccccggtgctggacagcgacgggtccttcttcctctacagccggctgaccgtcgacaagtcccgctggcaggagggcaacgtgttcagctgctccgtgatgcacgaggccctgcacaaccactacacccagaagtccctcagcctgagcctgggg

SEQ ID NO: 8405 - RNA, 645 nt, synthetic construct
  misc_feature 1..645: note = derived and/or modified sequence opt1 from Rinucumab_LightChain1
  source 1..645: mol_type = other RNA
gagatcgtgctgacccagagccccgacaccatctccctcagcccgggcgagcgggccacgctgtcctgccgggccagccagtccatcagctccatctacctggcgtggtaccagcagaagcccgggcaggcgccccgcctcctgatctacggcgccagctcccgggtcaccgggatccccgaccgcttcagcgtgtccggcagcgggaccgacttcaccctgacgatctcccggctcgagccggaggacttcgccgtgtactactgccagcactacggcatcagccccttcaccttcggccccgggaccaaggtcgacatccgccggaccgtggccgccccctccgtgttcatcttcccgcccagcgacgagcagctgaagtccggcacggccagcgtcgtgtgcctgctcaacaacttctacccccgcgaggccaaggtgcagtggaaggtcgacaacgccctgcagtccgggaacagccaggagagcgtgaccgagcaggactccaaggacagcacctactccctgagctccaccctcacgctgagcaaggcggactacgagaagcacaaggtgtacgcctgcgaggtcacccaccagggcctgtccagccccgtgaccaagtccttcaaccgcggggagtgc

SEQ ID NO: 8406 - RNA, 1347 nt, synthetic construct
  misc_feature 1..1347: note = derived and/or modified sequence opt1 from Risankizumab_HeavyChain1
  source 1..1347: mol_type = other RNA
caggtgcagctggtccagagcggcgccgaggtgaagaagcccgggtccagcgtgaaggtctcctgcaaggccagcggctacaccttcaccgaccagacgatccactggatgcgccaggcgcccgggcagggcctcgagtggatcgggtacatctacccccgggacgactcccccaagtacaacgagaacttcaagggcaaggtgaccatcaccgccgacaagagcacctccacggcctacatggagctgagctccctgcgcagcgaggacaccgccgtgtactactgcgccatccccgaccggtccggctacgcgtggttcatctactgggggcagggcaccctcgtcaccgtgagctccgccagcacgaaggggccgtccgtgttccccctggcccccagctccaagagcacctccggcgggaccgccgcgctgggctgcctcgtcaaggactacttccccgagccggtgaccgtgagctggaacagcggcgccctgacgtccggggtccacaccttccccgccgtgctgcagagctccggcctctacagcctgtccagcgtggtcaccgtgccctccagctccctggggacccagacgtacatctgcaacgtgaaccacaagcccagcaacaccaaggtcgacaagcgcgtggagccgaagtcctgcgacaagacccacacgtgcccgccctgccccgcccccgaggccgcgggcggccccagcgtgttcctcttcccgcccaagcccaaggacaccctgatgatctcccggacccccgaggtgacctgcgtcgtggtcgacgtgagccacgaggaccccgaggtcaagttcaactggtacgtggacggggtggaggtccacaacgccaagaccaagccccgcgaggagcagtacaactccacgtaccgggtggtgagcgtcctgaccgtgctccaccaggactggctgaacggcaaggagtacaagtgcaaggtgtccaacaaggccctgccggcccccatcgagaagaccatcagcaaggccaaggggcagccccgcgagccccaggtctacaccctcccgccctcccgggaggagatgacgaagaaccaggtgagcctgacctgcctggtgaagggcttctaccccagcgacatcgcggtcgagtgggagtccaacgggcagccggagaacaactacaagaccaccccgcccgtgctcgacagcgacggctccttcttcctgtacagcaagctgacggtggacaagtcccgctggcagcagggcaacgtcttcagctgctccgtgatgcacgaggccctccacaaccactacacccagaagtccctgagcctgagccccggg

SEQ ID NO: 8407 - RNA, 642 nt, synthetic construct
  misc_feature 1..642: note = derived and/or modified sequence opt1 from Risankizumab_LightChain1
  source 1..642: mol_type = other RNA
gacatccagatgacccagagcccctccagcctgtccgccagcgtgggcgaccgggtcaccatcacgtgcaaggcctcccgggacgtggcgatcgccgtggcctggtaccagcagaagccggggaaggtccccaagctcctgatctactgggccagcacccgccacaccggcgtgccctcccggttcagcgggtccggcagccgcaccgacttcacgctgaccatctccagcctccagcccgaggacgtggccgactacttctgccaccagtactccagctacccgttcaccttcgggtccggcaccaagctggagatcaagcggacggtcgcggcccccagcgtgttcatcttcccgccctccgacgagcagctcaagagcggcaccgcctccgtggtctgcctgctgaacaacttctacccccgcgaggccaaggtgcagtggaaggtggacaacgcgctgcagagcgggaacagccaggagtccgtcaccgagcaggacagcaaggactccacctacagcctctccagcacgctgaccctgtccaaggccgactacgagaagcacaaggtgtacgcctgcgaggtgacccaccagggcctcagctcccccgtcaccaagagcttcaaccgcggggagtgc

SEQ ID NO: 8408 - RNA, 1353 nt, synthetic construct
  misc_feature 1..1353: note = derived and/or modified sequence opt1 from Rituximab_HeavyChain
  source 1..1353: mol_type = other RNA
caggtgcagctgcagcagcccggcgccgagctcgtcaagccgggggccagcgtgaagatgtcctgcaaggcgagcggctacaccttcacctcctacaacatgcactgggtgaagcagacgcccgggcgcggcctggagtggatcggggccatctaccccggcaacggcgacaccagctacaaccagaagttcaaggggaaggccaccctgaccgccgacaagtccagctccacggcctacatgcagctcagctccctgaccagcgaggactccgcggtctactactgcgcccggagcacctactacggcggggactggtacttcaacgtgtggggcgccgggaccacggtgaccgtctccgccgcgagcaccaagggcccctccgtgttcccgctggcccccagctccaagagcacctccggcgggacggccgccctcggctgcctggtgaaggactacttccccgagcccgtcaccgtgagctggaacagcggggccctgacctccggcgtgcacaccttcccggcggtcctccagagctccggcctgtacagcctgtccagcgtggtgacggtcccctccagctccctcgggacccagacctacatctgcaacgtgaaccacaagcccagcaacaccaaggtggacaagaaggtcgagcccaagtcctgcgacaagacgcacacgtgcccgccctgccccgcccccgagctgctgggcgggccgagcgtgttcctcttcccgcccaagcccaaggacaccctgatgatctcccgcacccccgaggtgacctgcgtcgtggtggacgtcagccacgaggaccccgaggtgaagttcaactggtacgtcgacggcgtggaggtgcacaacgccaagaccaagccccgggaggagcagtacaactccacctaccgcgtcgtgagcgtgctgaccgtcctccaccaggactggctgaacgggaaggagtacaagtgcaaggtgtccaacaaggccctgcccgccccgatcgagaagacgatcagcaaggcgaagggccagccccgggagccccaggtgtacaccctgcccccgtcccgcgacgagctcaccaagaaccaggtcagcctgacctgcctcgtgaagggcttctaccccagcgacatcgccgtggagtgggagtccaacgggcagcccgagaacaactacaagacgaccccgcccgtcctggacagcgacggctccttcttcctgtacagcaagctcaccgtggacaagtcccggtggcagcaggggaacgtgttcagctgctccgtcatgcacgaggccctgcacaaccactacacccagaagtccctgagcctcagccccggcaag

SEQ ID NO: 8409 - RNA, 1353 nt, synthetic construct
  misc_feature 1..1353: note = derived and/or modified sequence opt1 from Rituximab_HeavyChain_variant
  source 1..1353: mol_type = other RNA
caggtgcagctgcagcagcccggcgccgagctcgtcaagccgggggccagcgtgaagatgtcctgcaaggcgagcggctacaccttcacctcctacaacatgcactgggtgaagcagacgcccgggcgcggcctggagtggatcggggccatctaccccggcaacggcgacaccagctacaaccagaagttcaaggggaaggccaccctgaccgccgacaagtccagctccacggcctacatgcagctcagctccctgaccagcgaggactccgcggtctactactgcgcccggagcacctactacggcggggactggtacttcaacgtgtggggcgccgggaccacggtgaccgtctccgccgcgagcaccaagggcccctccgtgttcccgctggcccccagctccaagagcacctccggcgggacggccgccctcggctgcctggtgaaggactacttccccgagcccgtcaccgtgagctggaacagcggggccctgacctccggcgtgcacaccttcccggcggtcctccagagctccggcctgtacagcctgtccagcgtggtgacggtcccctccagctccctcgggacccagacctacatctgcaacgtgaaccacaagcccagcaacaccaaggtggacaagaaggccgagcccaagtcctgcgacaagacgcacacgtgcccgccctgccccgcccccgagctgctgggcgggccgagcgtcttcctcttcccgcccaagcccaaggacaccctgatgatctcccgcacccccgaggtgacctgcgtggtcgtggacgtgagccacgaggaccccgaggtcaagttcaactggtacgtggacggcgtcgaggtgcacaacgccaagaccaagccccgggaggagcagtacaactccacctaccgcgtggtcagcgtgctgaccgtgctccaccaggactggctgaacgggaaggagtacaagtgcaaggtctccaacaaggccctgcccgcgccgatcgagaagacgatcagcaaggccaagggccagccccgggagccccaggtgtacaccctgcccccgtcccgcgacgagctcaccaagaaccaggtgagcctgacctgcctcgtcaagggcttctaccccagcgacatcgccgtggagtgggagtccaacgggcagcccgagaacaactacaagacgaccccgcccgtgctggacagcgacggctccttcttcctgtacagcaagctcaccgtcgacaagtcccggtggcagcaggggaacgtgttcagctgctccgtgatgcacgaggccctgcacaaccactacacccagaagtccctgagcctcagccccggcaag

SEQ ID NO: 8410 - RNA, 639 nt, synthetic construct
  misc_feature 1..639: note = derived and/or modified sequence opt1 from Rituximab_LightChain
  source 1..639: mol_type = other RNA
cagatcgtgctgagccagtcccccgccatcctcagcgcctcccccggcgagaaggtcaccatgacctgccgggcgagctccagcgtgtcctacatccactggttccagcagaagcccgggagctcccccaagccctggatctacgccacgagcaacctggcctccggcgtgccggtccggttcagcgggtccggcagcgggacctcctacagcctgaccatctcccgcgtggaggccgaggacgccgcgacctactactgccagcagtggacgagcaacccgcccaccttcggcggcgggaccaagctcgagatcaagcggaccgtggccgccccctccgtcttcatcttcccgcccagcgacgagcagctcaagagcggcacggcctccgtggtgtgcctgctgaacaacttctacccccgcgaggcgaaggtccagtggaaggtggacaacgccctgcagagcgggaactcccaggagagcgtgaccgagcaggactccaaggacagcacctactccctgagctccaccctcacgctgagcaaggccgactacgagaagcacaaggtctacgcctgcgaggtgacccaccagggcctgtccagccccgtgaccaagtccttcaaccgcggggagtgc

SEQ ID NO: 8411 - RNA, 714 nt, synthetic construct
  misc_feature 1..714: note = derived and/or modified sequence opt1 from Rivabazumab_pegol_HeavyChain1
  source 1..714: mol_type = other RNA
gaggtgcagctggtcgagagcggcgggggcgtggtgcagcccgggcgctccctccggctgagctgcgccgcctccggcttcaccttcagcaactacccgatgcactgggtccgccaggcgcccgggaagggcctggagtgggtggccgtgatctcctacgacggcagcgagaagtggtacgccgactccgtcaaggggcggttcaccatcagccgcgacaactccaagaacaccctctacctggagatgaacagcctgcggcccgaggacaccgccgtgtactactgcgcccgcaaccggggcgacatctactacgacttcacctacgcgatggacatctgggggcagggcaccacggtgaccgtctccagcgcctccaccaaggggcccagcgtgttcccgctcgccccctccagcaagtccaccagcggcggcacggccgcgctggggtgcctggtgaaggactacttccccgagcccgtcaccgtgtcctggaacagcggcgccctcaccagcggggtgcacaccttcccggccgtcctgcagtccagcggcctgtactccctcagctccgtggtgacggtccccagctccagcctgggcacccagacctacatctgcaacgtgaaccacaagccctccaacaccaaggtggacaagaaggtcgagcccaagagctccgacaagacgcacacgtgcccgccctgccccgcc

SEQ ID NO: 8412 - RNA, 642 nt, synthetic construct
  misc_feature 1..642: note = derived and/or modified sequence opt1 from Rivabazumab_pegol_LightChain1
  source 1..642: mol_type = other RNA
gacatccagctgacccagagcccctccaccctcagcgcctccgtgggcgacagcgtcacgatcacgtgccgcgcctccgagggggtggaccggtggctggcgtggtaccagcagaagccgggccgcgcccccaagctgctcatctacgacgccagcaccctgcagtccggggtgcccagccggttctccggcagcgggtccggcaccgagttcagcctgaccatctccagcctccagcccgacgacgtcgccacctactactgccagcacttctggggcaccccgtacaccttcgggcagggcacgaagctggagatcaagcgcaccgtggccgcgccctccgtgttcatcttcccgcccagcgacgagcagctgaagtccgggaccgccagcgtcgtgtgcctcctgaacaacttctacccccgggaggccaaggtgcagtggaaggtcgacaacgccctgcagtccggcaacagccaggagagcgtgaccgagcaggactccaaggacagcacgtactccctcagctccaccctgaccctgagcaaggcggactacgagaagcacaaggtgtacgcctgcgaggtcacccaccaggggctctccagccccgtgacgaagtccttcaaccgcggcgagagc

SEQ ID NO: 8413 - RNA, 1344 nt, synthetic construct
  misc_feature 1..1344: note = derived and/or modified sequence opt1 from Robatumumab_HeavyChain1
  source 1..1344: mol_type = other RNA
gaggtgcagctggtccagagcggcgggggcctcgtgaagcccgggggctccctgcgcctgagctgcgccgcctccgggttcaccttcagctccttcgcgatgcactgggtgcggcaggccccgggcaagggcctcgagtggatcagcgtcatcgacacccgcggggccacgtactacgccgactccgtgaagggccggttcaccatcagccgcgacaacgccaagaactccctgtacctgcagatgaacagcctccgggcggaggacaccgccgtgtactactgcgcccgcctggggaacttctactacggcatggacgtctgggggcagggcaccacggtgaccgtgtccagcgcctccaccaagggccccagcgtcttccccctggcgccctccagcaagtccaccagcgggggcacggccgccctcgggtgcctggtgaaggactacttcccggagcccgtgaccgtctcctggaacagcggcgccctgaccagcggcgtgcacaccttccccgccgtgctccagtccagcgggctgtactccctgagctccgtcgtgacggtgcccagctccagcctcggcacccagacctacatctgcaacgtcaaccacaagccgtccaacaccaaggtggacaagaaggtggagcccaagagctgcgacaagacgcacacgtgcccgccctgcccggcgcccgagctgctcgggggcccctccgtcttcctgttcccgcccaagcccaaggacaccctgatgatcagccggacccccgaggtgacctgcgtggtcgtggacgtctcccacgaggaccccgaggtgaagttcaactggtacgtggacggggtcgaggtgcacaacgccaagaccaagccgcgcgaggagcagtacaacagcacctaccgggtggtctccgtgctgaccgtgctccaccaggactggctgaacggcaaggagtacaagtgcaaggtcagcaacaaggccctgcccgcccccatcgagaagacgatctccaaggccaagggccagccccgcgagccccaggtgtacaccctcccgcccagccgggacgagctgaccaagaaccaggtgtccctgacctgcctcgtcaaggggttctaccccagcgacatcgcggtggagtgggagagcaacggccagcccgagaacaactacaagacgaccccgcccgtgctggactccgacgggagcttcttcctgtactccaagctcaccgtcgacaagagccgctggcagcagggcaacgtgttctcctgcagcgtgatgcacgaggccctgcacaaccactacacccagaagtccctgagcctctcccccgggaag

SEQ ID NO: 8414 - RNA, 642 nt, synthetic construct
  misc_feature 1..642: note = derived and/or modified sequence opt1 from Robatumumab_LightChain1
  source 1..642: mol_type = other RNA
gagatcgtgctgacccagagccccggcaccctctccgtcagcccgggggagcgcgccacgctgtcctgccgggccagccagtccatcggcagctccctgcactggtaccagcagaagcccgggcaggcgccccgcctcctgatcaagtacgccagccagtccctgagcggcatccccgaccggttctccgggagcggctccggcaccgacttcaccctcaccatcagccgcctggagccggaggacttcgccgtgtactactgccaccagtccagccggctgccccacacgttcgggcagggcaccaaggtggagatcaagcgcaccgtcgccgccccctccgtgttcatcttcccgcccagcgacgagcagctcaagtccgggaccgcgagcgtggtctgcctgctgaacaacttctacccccgggaggccaaggtgcagtggaaggtggacaacgccctccagagcggcaactcccaggagagcgtcacggagcaggactccaaggacagcacctactccctgagctccaccctgaccctcagcaaggccgactacgagaagcacaaggtgtacgcgtgcgaggtgacgcaccaggggctgtccagccccgtcaccaagtccttcaaccgcggcgagtgc

SEQ ID NO: 8415 - RNA, 1368 nt, synthetic construct
  misc_feature 1..1368: note = derived and/or modified sequence opt1 from Roledumab_HeavyChain1
  source 1..1368: mol_type = other RNA
caggtgcagctggtcgagagcggcgggggcgtggtgcagcccgggcgctccctccggctgagctgcaccgcctccggcttcaccttcaagaactacgccatgcactgggtccgccaggcgccggccaaggggctggagtgggtggccacgatcagctacgacggccggaacatccagtacgccgactccgtgaagggccgcttcaccttcagccgggacaactcccaggacaccctctacctgcagctgaacagcctccgccccgaggacaccgccgtctactactgcgcgcggcccgtgcgctcccggtggctgcagctggggctcgaggacgccttccacatctggggccaggggacgatggtgaccgtcagctccgccagcaccaagggcccctccgtgttcccgctggcccccagctccaagagcacctccgggggcacggcggccctgggctgcctcgtgaaggactacttccccgagcccgtcaccgtgagctggaactccggggccctgaccagcggcgtgcacaccttcccggccgtcctgcagagctccgggctctacagcctgtccagcgtggtgacggtcccctccagctccctgggcacccagacctacatctgcaacgtgaaccacaagcccagcaacaccaaggtggacaagaaggtcgagcccaagtcctgcgacaagacgcacacgtgcccgccctgccccgcccccgagctcctgggcgggccgagcgtgttcctgttcccgcccaagcccaaggacaccctcatgatctcccgcacccccgaggtgacctgcgtcgtggtcgacgtgagccacgaggaccccgaggtgaagttcaactggtacgtcgacggcgtggaggtgcacaacgcgaagaccaagccccgggaggagcagtacaactccacctaccgcgtcgtgagcgtgctgaccgtcctgcaccaggactggctcaacgggaaggagtacaagtgcaaggtgtccaacaaggccctgcccgccccgatcgagaagacgatcagcaaggccaagggccagccccgggagccccaggtgtacaccctgcccccgtcccgcgacgagctcaccaagaaccaggtcagcctgacctgcctggtgaaggggttctacccctccgacatcgccgtggagtgggagagcaacggccagcccgagaacaactacaagacgaccccgcccgtcctcgacagcgacggctccttcttcctgtacagcaagctgaccgtggacaagtcccggtggcagcaggggaacgtgttcagctgctccgtcatgcacgaggcgctccacaaccactacacccagaagtccctgagcctgagccccggcaag

SEQ ID NO: 8416 - RNA, 642 nt, synthetic construct
  misc_feature 1..642: note = derived and/or modified sequence opt1 from Roledumab_LightChain1
  source 1..642: mol_type = other RNA
gccatccgcatgacccagagcccctccagcttctccgccagcaccggcgaccgggtgacgatcacgtgccgcgcgtcccaggacatccggaactacgtcgcctggtaccagcagaagtccgggaaggccccgaagttcctgatctacgccgccagcaccctccagagcggcgtgccctcccgcttcagcgggtccggcagcgggaccgacttcaccctgaccatcaactccctgcagagcgaggacttcgcgacctactactgccagcagtactacaactccccgcccaccttcggccagggcacgcgggtggagatcacccgcaccgtcgccgcccccagcgtgttcatcttcccgccctccgacgagcagctcaagagcgggaccgcctccgtggtctgcctgctgaacaacttctacccccgggaggcgaaggtgcagtggaaggtggacaacgccctccagagcggcaacagccaggagtccgtcacggagcaggacagcaaggactccacctacagcctgtccagcaccctgaccctctccaaggccgactacgagaagcacaaggtgtacgcctgcgaggtgacgcaccaggggctgagctcccccgtcaccaagagcttcaaccgcggcgagtgc

SEQ ID NO: 8417 - RNA, 639 nt, synthetic construct; identical to SEQ ID NO: 8371
  misc_feature 1..639: note = derived and/or modified sequence opt1 from Romosozumab_fab_fragment
  source 1..639: mol_type = other RNA

SEQ ID NO: 8418 - RNA, 1347 nt, synthetic construct
  misc_feature 1..1347: note = derived and/or modified sequence opt1 from Romosozumab_HeavyChain1
  source 1..1347: mol_type = other RNA
gaggtgcagctggtccagagcggcgccgaggtgaagaagcccggggcctccgtgaaggtcagctgcaaggcgtccggctacaccttcaccgactacaacatgcactgggtgcgccaggccccggggcagggcctcgagtggatgggggagatcaaccccaacagcggcggcgccgggtacaaccagaagttcaagggccgggtgacgatgaccaccgacacctccacgagcaccgcctacatggagctgcgctccctgcggagcgacgacaccgccgtctactactgcgcgcgcctcgggtacgacgacatctacgacgactggtacttcgacgtgtggggccaggggaccacggtgaccgtctccagcgcctccaccaagggccccagcgtgttccccctggccccgtgctcccggagcacctccgagagcacggccgcgctgggctgcctcgtgaaggactacttccccgagcccgtcaccgtgtcctggaacagcggggccctgacctccggcgtgcacaccttccccgccgtcctgcagagcagcgggctctactccctgagctccgtggtgacggtcccgagctccaacttcggcacccagacctacacgtgcaacgtggaccacaagcccagcaacaccaaggtggacaagaccgtcgagcgcaagtgctgcgtggagtgcccgccctgccccgccccgcccgtggccggcccctccgtcttcctgttcccgcccaagcccaaggacaccctcatgatcagccggacccccgaggtgacgtgcgtcgtggtggacgtctcccacgaggaccccgaggtgcagttcaactggtacgtggacggggtcgaggtgcacaacgcgaagaccaagccccgcgaggagcagttcaacagcaccttccgggtggtctccgtgctgaccgtggtccaccaggactggctgaacggcaaggagtacaagtgcaaggtgagcaacaaggggctccccgcccccatcgagaagacgatctccaagaccaagggccagccgcgcgagccccaggtgtacaccctgccgcccagccgggaggagatgaccaagaaccaggtctccctgacgtgcctcgtgaaggggttctaccccagcgacatcgccgtggagtgggagtccaacggccagcccgagaacaactacaagaccacgcccccgatgctggacagcgacggctccttcttcctgtacagcaagctcaccgtcgacaagagccgctggcagcaggggaacgtgttctcctgcagcgtgatgcacgaggccctgcacaaccactacacccagaagtccctgagcctctcccccggcaag

SEQ ID NO: 8419 - RNA, 642 nt, synthetic construct
  misc_feature 1..642: note = derived and/or modified sequence opt1 from Romosozumab_LightChain1
  source 1..642: mol_type = other RNA
gacatccagatgacccagagcccctccagcctgtccgccagcgtgggcgaccgcgtcaccatcacgtgccgggcctcccaggacatcagcaactacctcaactggtaccagcagaagccggggaaggcgcccaagctgctgatctactacacctcccgcctcctgagcggcgtgccctcccggttcagcgggtccggcagcgggaccgacttcaccctgacgatctccagcctccagcccgaggacttcgccacctactactgccagcagggcgacaccctgccgtacaccttcggcgggggcacgaaggtggagatcaagcgcaccgtcgccgccccctccgtgttcatcttcccgcccagcgacgagcagctgaagtccgggaccgccagcgtggtctgcctcctgaacaacttctacccccgggaggcgaaggtgcagtggaaggtggacaacgccctgcagtccggcaacagccaggagagcgtcaccgagcaggactccaaggacagcacgtactccctcagctccaccctgaccctgagcaaggccgactacgagaagcacaaggtgtacgcctgcgaggtgacccaccaggggctctccagccccgtcacgaagtccttcaaccgcggcgagtgc

SEQ ID NO: 8420 - RNA, 1326 nt, synthetic construct
  misc_feature 1..1326: note = derived and/or modified sequence opt1 from Rontalizuab_HeavyChain1
  source 1..1326: mol_type = other RNA
gaggtgcagctggtcgagagcggcgggggcctcgtgcagcccgggggctccctgcgcctgagctgcgccacctccgggtacaccttcacggagtacatcatccactgggtgcggcaggccccgggcaagggcctcgagtgggtcgcgagcatcaaccccgactacgacatcaccaactacaaccagcgcttcaaggggcggttcaccatctccctggacaagagcaagcgcaccgcctacctgcagaactccctccgggccgaggacacggccgtgtactactgcgccagctggatctccgacttcttcgactactggggccaggggaccctggtgaccgtcagctccgcgagcaccaagggcccctccgtgttccccctggccccgagctccaagagcacgtccgggggcaccgccgccctcggctgcctggtgaaggactacttccccgagcccgtcaccgtgagctggaactccggggcgctgaccagcggcgtgcacacgttccccgccgtcctccagagctccgggctgtacagcctgtccagcgtggtgaccgtcccgtccagctccctcggcacccagacctacatctgcaacgtgaaccacaagcccagcaacacgaaggtggacaagaaggtcgagcccaagtcctgcgacaagacccacacgtgcccgccctgccccgcccccgagctgctgggcgggcccagcgtgttcctcttcccgcccaagcccaaggacaccctgatctcccgcacccccgaggtgacctgcgtcgtggtggacgtcagccacgaggacccggaggtgaagttcaactggtacgtcgacggcgtggaggtgcacaacgccaagaccaagccccgggaggagcagtacaactccacctaccgcgtcgtgagcgtgctgacggtcctccaccaggactggctgaacgggaaggagtacaagtgcaaggtgtccaacaaggccctgcccgcgcccatcgagaagaccatcagcaaggccaagggccagccgcgggagccccaggtgtacaccctcccgccctcccgcgaggagaccaagaaccaggtcagcctgacgtgcctggtgaaggggttctacccctccgacatcgccgtggagtgggagagcaacggccagcccgagaacaactacaagaccacgcccccggtcctcgacagcgacggctccttcttcctgtacagcaagctgaccgtggacaagtcccggtggcagcaggggaacgtgttcagctgctccgtccacgaggccctccacaaccactacacccagaagtccctgagcctgagccccggc

SEQ ID NO: 8421 - RNA, 648 nt, synthetic construct
  misc_feature 1..648: note = derived and/or modified sequence opt1 from Rontalizuab_LightChain1
  source 1..648: mol_type = other RNA
gacatccagacccagagcccctccagcctgtccgccagcgtgggcgaccgcgtcaccatcacgtgccgggcctcccagagcgtgtccaccagctcctacagctaccactggtaccagcagaagccggggaaggcgcccaaggtgctcatctcctacgccagcaacctggagtccggcgtccccagccgcttctccgggagcggctccgggaccgacttcaccctgacgatcagctccctccagcccgaggacttcgccacctactactgccagcacagctggggcatcccgcggaccttcggccaggggaccaaggtggagatcaagcgcacggtggccgcccccagcgtcttcatcttcccgccctccgacgagcagctcaagagcggcaccgcgtccgtggtgtgcctgctgaacaacttctacccccgggaggccaaggtccagtggaaggtggacaacgccctgcagagcgggaactcccaggagagcgtgaccgagcaggactccaaggacagcacctactccctgagctccacgctcaccctgagcaaggccgactacgagaagcacaaggtctacgcgtgcgaggtgacccaccagggcctgtccagccccgtgaccaagtccttcaaccgcggggagtgc

SEQ ID NO: 8422 - RNA, 1341 nt, synthetic construct
  misc_feature 1..1341: note = derived and/or modified sequence opt1 from Rontalizumab_HeavyChain1
  source 1..1341: mol_type = other RNA
gaggtgcagctggtcgagagcggcgggggcctcgtgcagcccgggggctccctgcgcctgagctgcgccacctccgggtacaccttcacggagtacatcatccactgggtgcggcaggccccgggcaagggcctcgagtgggtcgcgagcatcaaccccgactacgacatcaccaactacaaccagcgcttcaaggggcggttcaccatctccctggacaagagcaagcgcaccgcctacctgcagatgaactccctccgggccgaggacacggccgtgtactactgcgccagctggatctccgacttcttcgactactggggccaggggaccctggtgaccgtcagctccgcgagcaccaagggcccctccgtgttccccctggccccgagctccaagagcacgtccgggggcaccgccgccctcggctgcctggtgaaggactacttccccgagcccgtcaccgtgagctggaactccggggcgctgaccagcggcgtgcacacgttccccgccgtcctccagagctccgggctgtacagcctgtccagcgtggtgaccgtcccgtccagctccctcggcacccagacctacatctgcaacgtgaaccacaagcccagcaacacgaaggtggacaagaaggtcgagcccaagtcctgcgacaagacccacacgtgcccgccctgccccgcccccgagctgctgggcgggcccagcgtgttcctcttcccgcccaagcccaaggacaccctgatgatctcccgcacccccgaggtgacctgcgtcgtggtggacgtcagccacgaggacccggaggtgaagttcaactggtacgtcgacggcgtggaggtgcacaacgccaagaccaagccccgggaggagcagtacaactccacctaccgcgtcgtgagcgtgctgacggtcctccaccaggactggctgaacgggaaggagtacaagtgcaaggtgtccaacaaggccctgcccgcgcccatcgagaagaccatcagcaaggccaagggccagccgcgggagccccaggtgtacaccctcccgccctcccgcgaggagatgaccaagaaccaggtcagcctgacgtgcctggtgaaggggttctacccctccgacatcgccgtggagtgggagagcaacggccagcccgagaacaactacaagaccacgcccccggtcctcgacagcgacggctccttcttcctgtacagcaagctgaccgtggacaagtcccggtggcagcaggggaacgtgttcagctgctccgtcatgcacgaggccctccacaaccactacacccagaagtccctgagcctgagccccggcaag

SEQ ID NO: 8423 - RNA, 654 nt, synthetic construct
  misc_feature 1..654: note = derived and/or modified sequence opt1 from Rontalizumab_LightChain1
  source 1..654: mol_type = other RNA
gacatccagatgacccagagcccctccagcctgtccgccagcgtgggcgaccgcgtcaccatcacgtgccgggcctcccagagcgtgtccaccagctcctacagctacatgcactggtaccagcagaagccggggaaggcgcccaaggtgctcatctcctacgccagcaacctggagtccggcgtccccagccgcttctccgggagcggctccgggaccgacttcaccctgacgatcagctccctccagcccgaggacttcgccacctactactgccagcacagctggggcatcccgcggaccttcggccaggggaccaaggtggagatcaagcgcacggtggccgcccccagcgtcttcatcttcccgccctccgacgagcagctcaagagcggcaccgcgtccgtggtgtgcctgctgaacaacttctacccccgggaggccaaggtccagtggaaggtggacaacgccctgcagagcgggaactcccaggagagcgtgaccgagcaggactccaaggacagcacctactccctgagctccacgctcaccctgagcaaggccgactacgagaagcacaaggtctacgcgtgcgaggtgacccaccagggcctgtccagccccgtgaccaagtccttcaaccgcggggagtgc

SEQ ID NO: 8424 - RNA, 1341 nt, synthetic construct
  misc_feature 1..1341: note = derived and/or modified sequence opt1 from Rovalpituzumab_tesirine_HeavyChain1
  source 1..1341: mol_type = other RNA
caggtgcagctggtccagagcggcgccgaggtgaagaagcccggggcctccgtgaaggtcagctgcaaggcgtccggctacaccttcaccaactacgggatgaactgggtgcgccaggccccgggccaggggctcgagtggatgggctggatcaacacgtacaccggcgagcccacctacgccgacgacttcaaggggcgggtgaccatgacgaccgacaccagcacctccacggcctacatggagctgcgcagcctgcggtccgacgacaccgccgtctactactgcgcgcgcatcggcgacagctcccccagcgactactgggggcagggcaccctcgtgaccgtgtccagcgcctccacgaaggggcccagcgtcttcccgctggccccctccagcaagtccaccagcggcggcaccgccgcgctggggtgcctcgtgaaggactacttccccgagcccgtgaccgtctcctggaacagcggcgccctgacgagcggggtgcacaccttcccggccgtgctgcagtccagcggcctctactccctgagctccgtcgtgaccgtgcccagctccagcctgggcacccagacgtacatctgcaacgtcaaccacaagccctccaacaccaaggtggacaagaaggtggagcccaagagctgcgacaagacccacacgtgcccgccctgccccgcccccgagctcctcgggggcccgtccgtcttcctgttcccgcccaagcccaaggacaccctgatgatcagccggacccccgaggtgacctgcgtggtcgtggacgtctcccacgaggaccccgaggtgaagttcaactggtacgtggacggggtcgaggtgcacaacgccaagaccaagccccgcgaggagcagtacaacagcacgtaccgggtggtctccgtgctgaccgtgctgcaccaggactggctcaacggcaaggagtacaagtgcaaggtcagcaacaaggcgctgcccgccccgatcgagaagaccatctccaaggccaaggggcagccccgcgagccccaggtgtacaccctgcccccgagccgggacgagctcacgaagaaccaggtgtccctgacctgcctggtcaagggcttctaccccagcgacatcgccgtggagtgggagagcaacggccagcccgagaacaactacaagaccaccccgcccgtgctcgactccgacgggagcttcttcctgtactccaagctgacggtcgacaagagccgctggcagcagggcaacgtgttctcctgcagcgtgatgcacgaggccctccacaaccactacacccagaagtccctgagcctgtcccccggg

SEQ ID NO: 8425 - RNA, 642 nt, synthetic construct
  misc_feature 1..642: note = derived and/or modified sequence opt1 from Rovalpituzumab_tesirine_LightChain1
  source 1..642: mol_type = other RNA
gagatcgtgatgacccagagccccgccaccctgtccgtcagcccgggcgagcgcgccacgctctcctgcaaggcgagccagtccgtgagcaacgacgtggtctggtaccagcagaagcccgggcaggcgccccggctgctgatctactacgcctccaaccgctacaccggcatccccgcccggttcagcgggtccggcagcgggaccgagttcaccctcacgatctccagcctgcagtccgaggacttcgccgtgtactactgccagcaggactacaccagcccgtggaccttcggccagggcaccaagctggagatcaagcgcacggtggccgccccctccgtcttcatcttcccgcccagcgacgagcagctcaagtccgggaccgccagcgtggtgtgcctgctgaacaacttctacccccgggaggccaaggtccagtggaaggtggacaacgcgctccagtccggcaacagccaggagagcgtgaccgagcaggactccaaggacagcacctactccctgagctccacgctgaccctcagcaaggccgactacgagaagcacaaggtctacgcctgcgaggtgacccaccaggggctgtccagccccgtgaccaagtccttcaaccgcggcgagtgc

SEQ ID NO: 8426 - RNA, 1341 nt, synthetic construct
  misc_feature 1..1341: note = derived and/or modified sequence opt1 from Rovelizumab_HeavyChain1
  source 1..1341: mol_type = other RNA
caggtgcagctggtccagagcggcgccgaggtgaagaagcccggggcctccgtgaaggtcagctgcaaggcgtccggctacaccttcaccaacaactggatgcagtgggtgcgccaggccccggggcagggcctcgagtggatgggggccatcttccccggcgacgacgagacgcggtacacccagaagttccgcggcaaggccaccatcaccgccgacacgagcacctccaccgcgtacatggagctgagctccctgcggagcgaggacaccgccgtgtactactgcgggcgcggcgggaagctccggcccttcgccctggactactggggccaggggacgctggtcaccgtgtccagcgcctccaccaagggccccagcgtgttcccgctcgcgccctgctcccgcagcacctccgagagcacggccgccctgggctgcctggtcaaggactacttccccgagcccgtgaccgtgtcctggaacagcggggccctcacctccggcgtccacaccttcccggccgtgctgcagagcagcgggctgtactccctcagctccgtggtcacggtgcccagctccagcctgggcaccaagacctacacgtgcaacgtggaccacaagccctccaacaccaaggtcgacaagcgggtggagagcaagtacgggcccccgtgcccctcctgccccgcgcccgagttcctgggcggcccgagcgtgttcctcttcccgcccaagcccaaggacaccctgatgatctcccgcacccccgaggtgacctgcgtcgtggtcgacgtgagccaggaggaccccgaggtccagttcaactggtacgtggacggggtggaggtccacaacgccaagacgaagccccgggaggagcagttcaactccacctaccgcgtggtgagcgtcctgaccgtgctccaccaggactggctgaacggcaaggagtacaagtgcaaggtgtccaacaaggggctgcccagctccatcgagaagaccatcagcaaggccaagggccagccgcgggagccccaggtctacacgctcccgccctcccaggaggagatgaccaagaaccaggtgagcctgacctgcctggtgaagggcttctaccccagcgacatcgccgtcgagtgggagtccaacgggcagcccgagaacaactacaagaccacgcccccggtgctcgacagcgacggctccttcttcctgtacagccgcctgaccgtggacaagtcccggtggcaggaggggaacgtcttcagctgctccgtgatgcacgaggccctccacaaccactacacccagaagtccctgagcctgagcctcggcaag

SEQ ID NO: 8427 - RNA, 654 nt, synthetic construct
  misc_feature 1..654: note = derived and/or modified sequence opt1 from Rovelizumab_LightChain1
  source 1..654: mol_type = other RNA
gacatccagatgacccagagcccctccagcctgtccgccagcgtgggcgaccgggtcaccatcacgtgccgggcctccgagagcgtggagtcctacgggaacaacttcatgtactggtaccagcagaagccgggcaaggcgcccaagctcctgatctacctggccagcaacctcgagtccggggtgcccagccgcttctccggcagcgggtccggcaccgacttcaccctgaccatcagctccctgcagcccgaggacttcgccacgtactactgccaccaggacaacgaggacccgcccaccttcggccaggggaccaagctcgagatcaagcggaccgtcgccgcccccagcgtgttcatcttcccgccctccgacgagcagctcaagagcggcacggcgtccgtggtctgcctgctgaacaacttctacccccgcgaggccaaggtgcagtggaaggtggacaacgccctgcagagcgggaacagccaggagtccgtcaccgagcaggacagcaaggactccacctacagcctgtccagcaccctcacgctgtccaaggccgactacgagaagcacaaggtgtacgcgtgcgaggtgacccaccagggcctgagctcccccgtcaccaagagcttcaaccgcggggagtgc

SEQ ID NO: 8428 - RNA, 1341 nt, synthetic construct
  misc_feature 1..1341: note = derived and/or modified sequence opt1 from Ruplizumab_HeavyChain1
  source 1..1341: mol_type = other RNA
caggtgcagctggtccagagcggcgccgaggtggtgaagcccggggcctccgtcaagctcagctgcaaggcgtccggctacatcttcaccagctactacatgtactgggtgaagcaggccccggggcagggcctggagtggatcggggagatcaacccctccaacggcgacaccaacttcaacgagaagttcaagagcaaggccacgctgaccgtggacaagtccgccagcaccgcctacatggagctctccagcctgcgctccgaggacaccgcggtctactactgcacgcggagcgacggccgcaacgacatggactcctgggggcagggcaccctggtgaccgtgagctccgccagcaccaaggggccctccgtcttccccctcgccccgagctccaagagcacgagcggcgggaccgccgcgctgggctgcctggtgaaggactacttccccgagcccgtgaccgtctcctggaacagcggcgccctcacctccggggtgcacacgttccccgccgtgctgcagagctccggcctgtacagcctctccagcgtcgtgaccgtgccgtccagctccctggggacccagacctacatctgcaacgtcaaccacaagcccagcaacacgaaggtggacaagaaggtggagcccaagtcctgcgacaagacccacacgtgcccgccctgccccgcccccgagctgctcggcggccccagcgtcttcctgttcccgcccaagcccaaggacaccctgatgatctcccggacccccgaggtgacctgcgtggtcgtggacgtcagccacgaggacccggaggtgaagttcaactggtacgtggacggggtcgaggtgcacaacgccaagaccaagccccgcgaggagcagtacaactccacctaccgggtggtcagcgtgctcacggtgctgcaccaggactggctgaacggcaaggagtacaagtgcaaggtctccaacaaggcgctccccgcccccatcgagaagaccatcagcaaggccaaggggcagccgcgcgagccccaggtgtacaccctgccgcccagccgggacgagctgaccaagaaccaggtgtccctcacgtgcctggtcaagggcttctaccccagcgacatcgccgtggagtgggagtccaacgggcagcccgagaacaactacaagaccacgcccccggtgctggacagcgacggctccttcttcctctacagcaagctgaccgtcgacaagtcccgctggcagcagggcaacgtgttcagctgctccgtgatgcacgaggccctgcacaaccactacacccagaagtccctcagcctgagccccggg

SEQ ID NO: 8429 - RNA, 654 nt, synthetic construct
  misc_feature 1..654: note = derived and/or modified sequence opt1 from Ruplizumab_LightChain1
  source 1..654: mol_type = other RNA
gacatcgtgctgacccagagccccgccaccctctccgtcagcccgggcgagcgcgccacgatctcctgccgggcgagccagcgcgtgtccagctccacctacagctacatgcactggtaccagcagaagcccgggcagccgcccaagctgctgatcaagtacgcctccaacctcgagagcggcgtgcccgcccggttctccgggagcggctccgggaccgacttcaccctgacgatcagctccgtcgagcccgaggacttcgccacctactactgccagcacagctgggagatcccgcccaccttcggcggcgggaccaagctggagatcaagcgcacggtggccgcgccctccgtgttcatcttcccgcccagcgacgagcagctcaagtccggcaccgccagcgtcgtgtgcctgctgaacaacttctacccccgggaggccaaggtgcagtggaaggtcgacaacgccctccagagcgggaactcccaggagagcgtgaccgagcaggactccaaggacagcacctactccctgagctccacgctgaccctcagcaaggcggactacgagaagcacaaggtgtacgcctgcgaggtcacccaccagggcctgtccagccccgtgaccaagtccttcaaccgcggggagtgc

SEQ ID NO: 8430 - RNA, 1353 nt, synthetic construct
  misc_feature 1..1353: note = derived and/or modified sequence opt1 from Sacituzumab_govitecan_HeavyChain1
  source 1..1353: mol_type = other RNA
caggtgcagctgcagcagagcggctccgagctcaagaagcccggggccagcgtcaaggtgtcctgcaaggccagcggctacaccttcaccaactacgggatgaactgggtgaagcaggcgccgggccaggggctgaagtggatgggctggatcaacacgtacaccggcgagcccacctacaccgacgacttcaaggggcgcttcgccttctccctggacacgagcgtctccaccgcctacctccagatcagctccctgaaggccgacgacaccgccgtgtacttctgcgcgcggggcgggttcggcagctcctactggtacttcgacgtgtgggggcagggcagcctggtcaccgtgtccagcgcctccacgaagggccccagcgtgttccccctcgccccgtccagcaagtccaccagcgggggcaccgccgcgctggggtgcctggtcaaggactacttccccgagcccgtgaccgtgagctggaactccggcgccctcacgagcggcgtccacaccttccccgccgtgctgcagtccagcgggctgtactccctcagctccgtggtcaccgtgccgagctccagcctgggcacccagacgtacatctgcaacgtgaaccacaagccctccaacaccaaggtcgacaagcgcgtggagcccaagagctgcgacaagacccacacgtgcccgccctgccccgcccccgagctgctcgggggcccctccgtgttcctgttcccgcccaagcccaaggacaccctgatgatcagccggacccccgaggtgacctgcgtcgtggtcgacgtgtcccacgaggacccggaggtcaagttcaactggtacgtggacggggtggaggtccacaacgccaagaccaagccccgcgaggagcagtacaacagcacgtaccgggtggtgtccgtcctcaccgtgctgcaccaggactggctgaacggcaaggagtacaagtgcaaggtgagcaacaaggcgctccccgcccccatcgagaagaccatctccaaggccaagggccagccgcgcgagccccaggtctacaccctgccgcccagccgggaggagatgacgaagaaccaggtgagcctgacctgcctcgtgaaggggttctacccctccgacatcgccgtcgagtgggagagcaacggccagcccgagaacaactacaagaccacgcccccggtgctggactccgacgggagcttcttcctgtactccaagctcaccgtggacaagagccgctggcagcagggcaacgtcttctcctgcagcgtgatgcacgaggccctgcacaaccactacacccagaagtccctgagcctctcccccgggaag

SEQ ID NO: 8431 - RNA, 642 nt, synthetic construct
  misc_feature 1..642: note = derived and/or modified sequence opt1 from Sacituzumab_govitecan_LightChain1
  source 1..642: mol_type = other RNA
gacatccagctgacccagagcccctccagcctctccgccagcgtgggcgaccgcgtctccatcacgtgcaaggccagccaggacgtgtccatcgcggtggcctggtaccagcagaagccggggaaggcccccaagctgctgatctacagcgcctcctaccggtacaccggcgtccccgaccgcttcagcgggtccggcagcgggaccgacttcaccctcaccatctccagcctgcagcccgaggacttcgccgtgtactactgccagcagcactacatcacgccgctgaccttcggcgcgggcaccaaggtggagatcaagcggaccgtcgccgccccctccgtgttcatcttcccgcccagcgacgagcagctcaagtccgggacggccagcgtggtctgcctgctgaacaacttctacccccgcgaggcgaaggtgcagtggaaggtggacaacgccctccagtccggcaacagccaggagagcgtcaccgagcaggactccaaggacagcacctactccctgagctccaccctgacgctcagcaaggccgactacgagaagcacaaggtgtacgcctgcgaggtgacccaccaggggctgtccagccccgtcaccaagtccttcaaccggggcgagtgc

SEQ ID NO: 8432 - RNA, 1326 nt, synthetic construct
  misc_feature 1..1326: note = derived and/or modified sequence opt1 from Samalizumab_HeavyChain1
  source 1..1326: mol_type = other RNA
caggtgcagctgcagcagagcggctccgagctcaagaagcccggggccagcgtcaagatctcctgcaaggccagcggctactccttcaccgactacatcatcctgtgggtgcgccagaaccccgggaagggcctggagtggatcgggcacatcgacccctactacggcagctccaactacaacctcaagttcaagggccgggtgaccatcacggcggaccagagcaccaccaccgcctacatggagctgtccagcctgcgctccgaggacacggccgtctactactgcgggcggagcaagcgcgactacttcgactactggggccaggggaccaccctcaccgtgtccagcgcctccacgaagggccccagcgtgttccccctggccccgtgctcccggagcacctccgagagcaccgcggccctggggtgcctcgtcaaggactacttccccgagcccgtgaccgtgagctggaactccggcgccctgacgagcggcgtccacaccttccccgccgtgctgcagtccagcgggctctactccctgagctccgtggtcaccgtgccgagctccaacttcggcacccagacgtacacgtgcaacgtggaccacaagcccagcaacaccaaggtcgacaagaccgtggagcgcaagtgctgcgtggagtgcccgccctgcccggcgccgcccgtcgccgggccctccgtgttcctgttcccgcccaagcccaaggacaccctcatgatcagccggacccccgaggtgacctgcgtcgtggtggacgtctcccaggaggaccccgaggtgcagttcaactggtacgtcgacggcgtggaggtgcacaacgccaagaccaagccccgcgaggagcagttcaacagcacgtaccgggtcgtgtccgtgctgaccgtcctgcaccaggactggctcaacggcaaggagtacaagtgcaaggtgagcaacaaggggctgccctccagcatcgagaagaccatctccaaggccaagggccagccccgcgagccccaggtgtacaccctgccgcccagccaggaggagatgacgaagaaccaggtcagcctgacctgcctcgtgaaggggttctacccctccgacatcgccgtggagtgggagagcaacggccagcccgagaacaactacaagaccaccccgcccgtcctggactccgacgggagcttcttcctctactcccggctgacggtggacaagagccgctggcaggagggcaacgtgttctcctgcagcgtcatgcacgaggcgctgcacaaccactacacccagaagtccctcagcctgtccctgggc

SEQ ID NO: 8433 - RNA, 642 nt, synthetic construct
  misc_feature 1..642: note = derived and/or modified sequence opt1 from Samalizumab_LightChain1
  source 1..642: mol_type = other RNA
gacatccagatgacccagagcccctccagcctgtccgccagcatcggcgaccgcgtgaccatcacgtgcaaggcctcccaggacatcaacagctacctctcctggttccagcagaagccggggaaggcgcccaagctgctgatctaccgggccaaccgcctcgtcgacggcgtgcccagccggttctccgggagcggctccgggaccgactacaccctgaccatcagctccctgcagcccgaggacttcgccgtgtactactgcctccagtacgacgagttcccgtacacgttcggcggcgggaccaagctggagatcaagcgcaccgtcgccgcccccagcgtgttcatcttcccgccctccgacgagcagctcaagagcggcaccgcgtccgtggtctgcctgctgaacaacttctacccccgggaggccaaggtgcagtggaaggtggacaacgccctgcagagcgggaactcccaggagagcgtcacggagcaggacagcaaggactccacctacagcctctccagcaccctgaccctgtccaaggccgactacgagaagcacaaggtgtacgcgtgcgaggtgacgcaccagggcctcagctcccccgtcaccaagagcttcaaccgcggggagtgc

SEQ ID NO: 8434 - RNA, 1338 nt, synthetic construct
  misc_feature 1..1338: note = derived and/or modified sequence opt1 from Sarilumab_HeavyChain1
  source 1..1338: mol_type = other RNA
gaggtgcagctggtcgagagcggcgggggcctcgtgcagcccgggcgctccctgcggctgagctgcgccgcctcccgcttcaccttcgacgactacgcgatgcactgggtgcggcaggccccgggcaaggggctcgagtgggtcagcggcatctcctggaacagcggccgcatcgggtacgccgactccgtgaagggccggttcaccatcagccgcgacaacgccgagaactccctgttcctgcagatgaacgggctccgggccgaggacacggcgctgtactactgcgccaagggccgcgacagcttcgacatctgggggcagggcaccatggtgaccgtctccagcgcctccaccaagggccccagcgtgttccccctggccccctccagcaagtccacgagcgggggcaccgcggccctcgggtgcctggtgaaggactacttcccggagcccgtcaccgtgtcctggaacagcggcgccctgaccagcggcgtgcacacgttccccgccgtcctccagtccagcgggctgtactccctgagctccgtggtgaccgtccccagctccagcctcggcacccagacctacatctgcaacgtgaaccacaagccgtccaacacgaaggtggacaagaaggtcgagcccaagagctgcgacaagacccacacgtgcccgccctgcccggcccccgagctgctcgggggcccctccgtgttcctgttcccgcccaagcccaaggacaccctgatgatcagccggacccccgaggtgacctgcgtcgtggtggacgtctcccacgaggaccccgaggtgaagttcaactggtacgtcgacggggtggaggtgcacaacgcgaagaccaagccgcgcgaggagcagtacaacagcacctaccgggtcgtgtccgtgctgacggtcctccaccaggactggctgaacggcaaggagtacaagtgcaaggtgagcaacaaggccctgcccgcccccatcgagaagaccatctccaaggccaagggccagccccgcgagccccaggtgtacaccctcccgcccagccgggacgagctgaccaagaaccaggtctccctgacgtgcctcgtgaaggggttctaccccagcgacatcgccgtggagtgggagagcaacggccagcccgagaacaactacaagaccaccccgcccgtcctggactccgacgggagcttcttcctgtactccaagctcaccgtggacaagagccgctggcagcagggcaacgtgttctcctgcagcgtcatgcacgaggcgctgcacaaccactacacgcagaagtccctgagcctctcccccgggaag

SEQ ID NO: 8435 - RNA, 642 nt, synthetic construct
  misc_feature 1..642: note = derived and/or modified sequence opt1 from Sarilumab_LightChain1
  source 1..642: mol_type = other RNA
gacatccagatgacccagagcccctccagcgtgtccgccagcgtcggcgaccgcgtgaccatcacgtgccgggcctcccaggggatcagctcctggctggcgtggtaccagcagaagccgggcaaggcccccaagctcctgatctacggggccagctccctggagagcggcgtgccctcccgcttcagcgggtccggcagcggcaccgacttcaccctcaccatctccagcctgcagcccgaggacttcgcctcctactactgccagcaggccaacagcttcccgtacacgttcgggcagggcaccaagctggagatcaagcggaccgtcgcggccccctccgtgttcatcttcccgcccagcgacgagcagctcaagagcgggaccgcctccgtggtctgcctgctgaacaacttctacccccgcgaggccaaggtgcagtggaaggtggacaacgcgctccagagcggcaactcccaggagagcgtcacggagcaggactccaaggacagcacctactccctgagctccaccctgaccctcagcaaggccgactacgagaagcacaaggtgtacgcctgcgaggtgacgcaccaggggctgtccagccccgtcaccaagtccttcaaccggggcgagtgc

SEQ ID NO: 8436 - RNA, 1296 nt, synthetic construct
  misc_feature 1..1296: note = derived and/or modified sequence opt1 from Satumomab_pendetide_HeavyChain
  source 1..1296: mol_type = other RNA
caggtgcagctgcagcagagcgacgccgagctcgtcaagcccggcgcctccgtgaagatcagctgcaaggcctccgggtacacgttcaccgaccacgccatccactgggccaagcagaagccggagcagggcctggagtggatcgggtacatcagccccggcaacgacgacatcaagtacaacgagaagttcaaggggaaggccacgctgaccgccgacaagtccagctccaccgcgtacatgcagctcaacagcctgacctccgaggacagcgccgtgtacttctgcaagcgctcctactacggccactggggccaggggacgaccctgaccgtcagctccgccagcaccaagggcccctccgtgttccccctcgccccgtgcagccggtccacgagcgagtccaccgcggccctggggtgcctggtgaaggactacttccccgagcccgtcaccgtgagctggaacagcggcgccctcacctccggggtgcacacgttccccgccgtcctgcagagctccggcctgtacagcctctccagcgtggtgaccgtcccgtccagctccctgggcaccaagacctacacgtgcaacgtggaccacaagcccagcaacaccaaggtggacaagcgcgtctgcccgccctgcaagtgccccgcccccaacctgctcgggggcccctccgtgttcatcttcccgcccaagatcaaggacgtgctgatgatcagcctgtcccccatcgtgacctgcgtggtggtcgacgtgagcgaggacgaccccgacgtgcagatctcctggttcgtcaacaacgtggaggtccacaccgcgcagacgcagacccaccgggaggactacaacagcaccctccgcgtggtgtccgccctgcccatccagcaccaggactggatgagcgggaaggagttcaagtgcaaggtcaacaacaaggacctgccggcccccatcgagcggaccatctccaagcccaagggcagcgtgcgcgcgccccaggtgtacgtcctcccgccgcccgaggaggagatgacgaagaagcaggtcaccctgacctgcatggtgaccgacttcatgcccgaggacatctacgtcgagtggacgaacaacggcaagaccgagctgaactacaagaacaccgagcccgtgctcgacagcgacgggtcctacttcatgtacagcaagctgcgggtggagaagaagaactgggtcgagcgcaactcctacagctgctccgtggtgcacgagggcctgcacaaccaccacaccaccaagagcttctcccgg

SEQ ID NO: 8437 - RNA, 630 nt, synthetic construct
  misc_feature 1..630: note = derived and/or modified sequence opt1 from Satumomab_pendetide_LightChain
  source 1..630: mol_type = other RNA
gacatccagatgacccagagccccgcctccctgagcgtgtccgtcggcgagaccgtgacgatcacgtgccgcgccagcgagaacatctactccaacctcgcgtggtaccagcagaagcagggcaagagcccgcagctgctggtgtacgccgccaccaacctcgccgacggggtcccctcccggttcagcgggtccggcagcgggacccagtactccctgaagatcaacagcctgcagtccgaggacttcggcagctactactgccagcacttctggggcaccccctacaccttcgggggcgggacccgcctcgagatcaagcgggccgacgcggcccccaccgtgttcatcttcccgccctccgacgagcagctcaagagcggcacggcctccgtggtctgcctgctgaacaacttctacccccgcgaggccaaggtgcagtggaaggtggacaacgcgctgcagagcgggaactcccaggagagcgtcaccgagcaggacagcaaggactccacctacagcctgtccagcaccctcacgctgtccaaggccgactacgagaagcacaaggtgtacgcctgcgaggtgacccaccagggcctgagctcccccgtcaccaagagcttcaac

SEQ ID NO: 8438 - RNA, 1371 nt, synthetic construct
  misc_feature 1..1371: note = derived and/or modified sequence opt1 from Secukinumab_HeavyChain1
  source 1..1371: mol_type = other RNA
gaggtgcagctggtcgagagcggcgggggcctcgtgcagcccgggggctccctgcgcctgagctgcgccgcctccgggttcaccttcagcaactactggatgaactgggtgcggcaggcgccgggcaagggcctcgagtgggtcgccgccatcaaccaggacgggtccgagaagtactacgtgggcagcgtgaaggggcgcttcaccatctcccgggacaacgccaagaacagcctgtacctgcagatgaactccctccgcgtcgaggacacggccgtgtactactgcgtgcgggactactacgacatcctgaccgactactacatccactactggtacttcgacctgtggggccgcgggaccctcgtcaccgtgagctccgcgagcacgaagggcccctccgtgttccccctggcccccagctccaagagcacctccggcgggaccgccgccctgggctgcctcgtcaaggactacttcccggagcccgtgaccgtgagctggaactccggggcgctgacgagcggcgtccacaccttccccgccgtgctgcagagctccggcctctacagcctgtccagcgtggtcaccgtgccctccagctccctggggacccagacgtacatctgcaacgtgaaccacaagccgagcaacaccaaggtcgacaagcgggtggagcccaagtcctgcgacaagacccacacgtgcccgccctgccccgcccccgagctcctgggcgggcccagcgtgttcctgttcccgcccaagcccaaggacaccctcatgatctcccgcacccccgaggtgacctgcgtcgtcgtggacgtgagccacgaggaccccgaggtcaagttcaactggtacgtggacggcgtggaggtccacaacgccaagaccaagccgcgggaggagcagtacaactccacgtaccgcgtggtgagcgtcctgaccgtgctgcaccaggactggctcaacgggaaggagtacaagtgcaaggtgtccaacaaggccctgcccgcgcccatcgagaagaccatcagcaaggccaagggccagccccgggagccgcaggtctacaccctgccgccctcccgcgaggagatgacgaagaaccaggtgagcctgacctgcctcgtgaagggcttctacccctccgacatcgccgtcgagtgggagagcaacgggcagcccgagaacaactacaagaccaccccgcccgtgctggacagcgacggctccttcttcctctacagcaagctgacggtggacaagtcccggtggcagcaggggaacgtcttcagctgctccgtgatgcacgaggccctgcacaaccactacacccagaagtccctcagcctgagccccggcaag

SEQ ID NO: 8439 - RNA, 645 nt, synthetic construct
  misc_feature 1..645: note = derived and/or modified sequence opt1 from Secukinumab_LightChain1
  source 1..645: mol_type = other RNA
gagatcgtgctgacccagagccccggcaccctctccctgagcccgggggagcgcgccacgctgtcctgccgggccagccagtccgtcagctccagctacctcgcgtggtaccagcagaagcccggccaggcgccccgcctgctgatctacggggcctccagccgggccaccggcatccccgaccgcttctccgggagcggctccggcaccgacttcaccctcacgatcagccggctggagccggaggacttcgccgtgtactactgccagcagtacgggtccagcccctgcaccttcggccaggggacccgcctggagatcaagcggaccgtggccgccccctccgtcttcatcttcccgcccagcgacgagcagctcaagtccggcacggccagcgtggtgtgcctgctgaacaacttctacccccgcgaggccaaggtccagtggaaggtggacaacgcgctccagagcgggaactcccaggagagcgtgaccgagcaggactccaaggacagcacctactccctgagctccaccctgacgctcagcaaggccgactacgagaagcacaaggtctacgcctgcgaggtgacccaccagggcctgtccagccccgtgaccaagtccttcaaccggggcgagtgc

SEQ ID NO: 8440 - RNA, 1335 nt, synthetic construct
  misc_feature 1..1335: note = derived and/or modified sequence opt1 from Seribantumab_HeavyChain1
  source 1..1335: mol_type = other RNA
gaggtgcagctgctcgagagcggcgggggcctggtccagcccgggggctccctgcgcctcagctgcgccgcctccgggttcaccttcagccactacgtgatggcgtgggtgcggcaggccccgggcaagggcctggagtgggtctccagcatctccagctccgggggctggaccctgtacgccgacagcgtgaaggggcgcttcacgatctcccgggacaacagcaagaacaccctctacctgcagatgaactccctgcgcgccgaggacaccgccgtgtactactgcacccggggcctcaagatggcgacgatcttcgactactgggggcagggcaccctggtcaccgtgagctccgccagcaccaagggcccctccgtgttccccctggccccctgcagccgctccacgagcgagagcaccgccgcgctcgggtgcctggtcaaggactacttcccggagcccgtgaccgtgtcctggaacagcggcgccctgacctccggggtccacacgttccccgccgtgctccagagctccggcctgtacagcctgtccagcgtggtcaccgtgccctccagcaacttcggcacccagacctacacgtgcaacgtggaccacaagccgtccaacaccaaggtcgacaagaccgtggagcggaagtgctgcgtggagtgcccgccctgccccgccccgcccgtcgccgggcccagcgtgttcctcttcccgcccaagcccaaggacaccctgatgatctcccgcacgcccgaggtgacctgcgtcgtggtcgacgtgagccacgaggaccccgaggtgcagttcaactggtacgtcgacggcgtggaggtgcacaacgcgaagaccaagccccgggaggagcagttcaactccaccttccgcgtcgtgagcgtgctgacggtcgtgcaccaggactggctcaacgggaaggagtacaagtgcaaggtgtccaacaagggcctgcccgcccccatcgagaagaccatcagcaagaccaaggggcagccccgggagccgcaggtctacaccctgccgccctcccgcgaggagatgacgaagaaccaggtgagcctgacctgcctcgtgaagggcttctaccccagcgacatcgccgtcgagtgggagtccaacggccagcccgagaacaactacaagaccaccccgcccatgctggacagcgacgggtccttcttcctctacagcaagctgacggtggacaagtcccggtggcagcagggcaacgtgttcagctgctccgtcatgcacgaggccctgcacaaccactacacccagaagtccctcagcctgagccccgggaag

SEQ ID NO: 8441 - RNA, 651 nt, synthetic construct
  misc_feature 1..651: note = derived and/or modified sequence opt1 from Seribantumab_LightChain1
  source 1..651: mol_type = other RNA
cagagcgccctgacccagcccgcctccgtgagcggctccccggggcagagcatcaccatctcctgcacgggcaccagctccgacgtcgggagctacaacgtggtgtcctggtaccagcagcaccccggcaaggcgcccaagctcatcatctacgaggtcagccagcgcccctccggggtgagcaaccggttctccggcagcaagtccggcaacaccgccagcctgaccatctccgggctgcagacggaggacgaggccgactactactgctgcagctacgccggctccagcatcttcgtgatcttcgggggcgggaccaaggtcaccgtgctcggccagccgaaggccgcgcccagcgtgaccctgttcccgccctccagcgaggagctgcaggccaacaaggccacgctcgtctgcctggtgtccgacttctaccccggcgccgtgaccgtcgcgtggaaggccgacgggagccccgtgaaggtgggcgtcgagaccaccaagccctccaagcagagcaacaacaagtacgccgcctccagctacctgtccctcacgcccgagcagtggaagtcccaccgcagctacagctgccgggtgacccacgaggggtccaccgtggagaagaccgtcgccccggcggagtgcagc

SEQ ID NO: 8442 - RNA, 1353 nt, synthetic construct
  misc_feature 1..1353: note = derived and/or modified sequence opt1 from Setoxaximab_HeavyChain1
  source 1..1353: mol_type = other RNA
gaggtgcagctgcagcagcccggccccgagctcgagaagcccggggccagcgtcaagctgtcctgcaaggccagcggctactccttcaccgactacaacatgaactgggtgaagcagaacaacggggagagcctggagtggatcggcaagatcgacccctactacgggggcccctcctacaaccagaagttcaaggacaaggcgaccctcacggtggacaagagctccagcaccgcctacatgcagctgaagtccctgaccagcgaggactccgccgtctactactgcacccgcggcgggaaccgggactggtacttcgacgtgtggggcgccgggacgaccctcaccgtgagcgccgagttcgcgtccaccaagggcccgagcgtcttccccctggccccctccagcaagtccacgagcgggggcaccgccgccctgggctgcctcgtgaaggactacttccccgagccggtgaccgtctcctggaacagcggggcgctgaccagcggcgtgcacacgttccccgccgtgctgcagtccagcgggctctactccctgagctccgtcgtgaccgtgcccagctccagcctgggcacccagacctacatctgcaacgtcaaccacaagccctccaacacgaaggtggacaagaaggtggagcccaagagctgcgacaagacccacacgtgcccgccctgccccgccccggagctcctgggcgggccctccgtcttcctgttcccgcccaagcccaaggacaccctcatgatcagccgcacccccgaggtgacctgcgtggtcgtggacgtgtcccacgaggaccccgaggtcaagttcaactggtacgtggacggcgtcgaggtgcacaacgccaagaccaagccccgggaggagcagtacaacagcacctaccgcgtggtctccgtgctgacggtgctgcaccaggactggctcaacgggaaggagtacaagtgcaaggtcagcaacaaggccctgccggcgcccatcgagaagaccatctccaaggccaagggccagccccgggagccccaggtgtacaccctgccgcccagccgcgacgagctcaccaagaaccaggtgtccctgacgtgcctggtcaaggggttctaccccagcgacatcgccgtggagtgggagagcaacggccagccggagaacaactacaagaccaccccgcccgtgctcgactccgacggcagcttcttcctgtactccaagctgaccgtcgacaagagccggtggcagcaggggaacgtgttctcctgcagcgtgatgcacgaggccctccacaaccactacacgcagaagtccctgagcctgtcccccggcaag

SEQ ID NO: 8443 - RNA, 660 nt, synthetic construct
  misc_feature 1..660: note = derived and/or modified sequence opt1 from Setoxaximab_LightChain1
  source 1..660: mol_type = other RNA
gacatcgtgctgagccagtcccccagctccctcgtcgtgagcgtgggcgagaaggtcaccatgtcctgcaagagctcccagagcctgctgtactcccgcaaccagaagaactacctcgcctggtaccagcagaagccggggcagagccccaaggtgctgatctactgggcctccacccgggagagcggcgtgcccgaccgcctgacggggtccggcagcgggaccgacttcaccctcaccatctccagcgtcaaggcggaggacctggccgtgtactactgccagcagtactactcctaccccctgacgttcggcgccggcaccaagctcgagctgaagcggaccgtggccgccccgagcgtcttcatcttcccgccctccgacgagcagctcaagagcgggaccgcgagcgtggtgtgcctgctgaacaacttctacccccgcgaggccaaggtccagtggaaggtggacaacgccctgcagtccggcaacagccaggagtccgtgacggagcaggacagcaaggactccacctacagcctctccagcaccctgaccctgtccaaggccgactacgagaagcacaaggtctacgcgtgcgaggtgacgcaccaggggctcagctcccccgtgaccaagagcttcaaccggggcgagtgc

SEQ ID NO: 8444 - RNA, 1338 nt, synthetic construct
  misc_feature 1..1338: note = derived and/or modified sequence opt1 from Sifalimumab_HeavyChain1
  source 1..1338: mol_type = other RNA
caggtgcagctggtccagagcggcgccgaggtgaagaagcccggggcctccgtgaaggtcagctgcaaggcgtccggctacaccttcaccagctactccatcagctgggtgcgccaggccccggggcagggcctcgagtggatggggtggatctccgtgtacaacggcaacaccaactacgcccagaagttccagggccgggtcaccatgaccaccgacacgagcacctccaccgcctacctggagctgcgcagcctccggtccgacgacaccgccgtgtactactgcgcgcgcgaccccatcgccgccgggtactggggccaggggacgctggtgaccgtcagctccgccagcaccaagggcccctccgtgttccccctggcgccgagctccaagagcacctccgggggcacggccgccctcggctgcctggtgaaggactacttccccgagcccgtcaccgtgagctggaacagcggggccctgacctccggcgtgcacaccttccccgccgtcctccagagctccgggctgtacagcctgtccagcgtggtgacggtcccgtccagctccctcggcacccagacctacatctgcaacgtgaaccacaagcccagcaacaccaaggtggacaagaaggtcgagcccaagtcctgcgacaagacgcacacgtgcccgccctgccccgcgcccgagctgctgggcgggcccagcgtgttcctcttcccgcccaagcccaaggacaccctgatgatctcccggacccccgaggtgacctgcgtcgtggtcgacgtgagccacgaggacccggaggtgaagttcaactggtacgtcgacggcgtggaggtgcacaacgccaagaccaagccccgcgaggagcagtacaactccacctaccgggtcgtgagcgtgctgaccgtcctccaccaggactggctgaacgggaaggagtacaagtgcaaggtgtccaacaaggccctgcccgcccccatcgagaagacgatcagcaaggccaagggccagccgcgcgagccccaggtgtacaccctcccgccctcccgggaggagatgaccaagaaccaggtcagcctgacctgcctggtgaaggggttctaccccagcgacatcgcggtggagtgggagtccaacggccagcccgagaacaactacaagacgacgcccccggtcctcgacagcgacggctccttcttcctgtacagcaagctgaccgtggacaagtcccgctggcagcaggggaacgtgttcagctgctccgtcatgcacgaggccctccacaaccactacacccagaagtccctgagcctgagccccggcaag

SEQ ID NO: 8445 - RNA, 645 nt, synthetic construct
  misc_feature 1..645: note = derived and/or modified sequence opt1 from Sifalimumab_LightChain1
  source 1..645: mol_type = other RNA
gagatcgtgctgacccagagccccggcaccctctccctgagcccgggggagcgcgccacgctgtcctgccgggccagccagtccgtcagctccacctacctcgcgtggtaccagcagaagcccggccaggcgccccgcctgctgatctacggggccagctcccgggccaccggcatccccgaccgcttcagcgggtccggcagcggcaccgacttcacgctcaccatctcccggctggagccggaggacttcgccgtgtactactgccagcagtacgggagcagcccccgcaccttcggccaggggaccaaggtggagatcaagcggacggtcgccgcccccagcgtgttcatcttcccgccctccgacgagcagctgaagtccggcaccgcctccgtggtctgcctcctgaacaacttctacccccgcgaggccaaggtgcagtggaaggtggacaacgcgctgcagagcgggaacagccaggagtccgtcaccgagcaggacagcaaggactccacctacagcctctccagcacgctgaccctgtccaaggccgactacgagaagcacaaggtgtacgcctgcgaggtgacccaccagggcctcagctcccccgtcaccaagagcttcaaccggggcgagtgc

SEQ ID NO: 8446 - RNA, 1347 nt, synthetic construct
  misc_feature 1..1347: note = derived and/or modified sequence opt1 from Siltuximab_HeavyChain1
  source 1..1347: mol_type = other RNA
gaggtgcagctggtcgagagcggcgggaagctcctgaagcccggcgggtccctgaagctcagctgcgccgcctccggcttcaccttcagctccttcgcgatgagctggttccgccagtccccggagaagcggctggagtgggtggccgagatcagctccgggggcagctacacctactaccccgacacggtgaccggccgcttcaccatctcccgggacaacgccaagaacaccctgtacctcgagatgagctccctgcgcagcgaggacacggccatgtactactgcgcccgggggctgtggggctactacgcgctcgactactgggggcagggcacctccgtcaccgtgagctccgccagcaccaaggggccctccgtgttccccctggccccgagcagcaagtccacgagcggcggcaccgccgcgctggggtgcctcgtcaaggactacttccccgagcccgtgaccgtgtcctggaacagcggcgccctgacctccggggtccacacgttccccgccgtgctgcagagctccggcctctacagcctgtccagcgtggtcaccgtgccgtccagctccctgggcacccagacctacatctgcaacgtgaaccacaagcccagcaacacgaaggtcgacaagaaggtggagcccaagtcctgcgacaagacccacacgtgcccgccctgccccgcccccgagctcctcgggggccccagcgtgttcctgttcccgcccaagcccaaggacaccctgatgatctcccgcacccccgaggtgacctgcgtcgtggtcgacgtgagccacgaggacccggaggtgaagttcaactggtacgtcgacggggtggaggtccacaacgccaagaccaagccccgggaggagcagtacaactccacctaccgcgtggtgagcgtcctgacggtgctgcaccaggactggctcaacggcaaggagtacaagtgcaaggtgagcaacaaggcgctgcccgcccccatcgagaagaccatctccaaggccaaggggcagccgcgggagccccaggtctacaccctgccgcccagccgcgacgagctcaccaagaaccaggtgtccctgacgtgcctggtgaagggcttctaccccagcgacatcgccgtcgagtgggagtccaacggccagcccgagaacaactacaagaccacgcccccggtgctcgacagcgacgggtccttcttcctgtacagcaagctgaccgtggacaagtcccggtggcagcagggcaacgtcttcagctgctccgtgatgcacgaggccctccacaaccactacacccagaagtccctgagcctgagccccgggaag

SEQ ID NO: 8447 - RNA, 639 nt, synthetic construct
  misc_feature 1..639: note = derived and/or modified sequence opt1 from Siltuximab_LightChain1
  source 1..639: mol_type = other RNA
cagatcgtgctgatccagagccccgccatcatgtccgccagcccgggcgagaaggtcaccatgacctgctccgcgagctccagcgtgtcctacatgtactggtaccagcagaagcccgggagcagcccccgcctcctgatctacgacacgagcaacctggcctccggcgtgcccgtccggttcagcgggtccggcagcgggacctcctacagcctcaccatctcccgcatggaggccgaggacgccgccacctactactgccagcagtggagcggctacccgtacacgttcggcgggggcaccaagctggagatcaagcggaccgtggcggccccctccgtgttcatcttcccgcccagcgacgagcagctgaagtccgggaccgcctccgtcgtgtgcctcctgaacaacttctacccccgcgaggccaaggtgcagtggaaggtcgacaacgcgctgcagagcggcaactcccaggagagcgtgacggagcaggactccaaggacagcacctactccctcagctccaccctgaccctgagcaaggccgactacgagaagcacaaggtgtacgcctgcgaggtcacgcaccaggggctctccagccccgtgaccaagtccttcaaccggggcgagtgc

SEQ ID NO: 8448 - RNA, 1329 nt, synthetic construct
  misc_feature 1..1329: note = derived and/or modified sequence opt1 from Simtuzumab_HeavyChain1
  source 1..1329: mol_type = other RNA
caggtgcagctggtccagagcggcgccgaggtgaagaagcccggggcctccgtgaaggtcagctgcaaggcgtccggctacgccttcacctactacctcatcgagtgggtgcgccaggcccccgggcagggcctggagtggatcggggtgatcaaccccggcagcggcgggaccaactacaacgagaagttcaagggccgggccacgatcaccgccgacaagtccaccagcaccgcgtacatggagctgtccagcctccgctccgaggacacggccgtctacttctgcgcccggaactggatgaacttcgactactgggggcagggcaccaccgtgaccgtgagctccgccagcacgaaggggccctccgtcttccccctggcgccgtgcagccgctccaccagcgagtccaccgccgccctgggctgcctcgtgaaggactacttccccgagcccgtgaccgtcagctggaactccggcgccctgacgagcggggtgcacaccttccccgccgtgctgcagagctccggcctctacagcctgtccagcgtcgtgaccgtgccgtccagctccctggggaccaagacgtacacgtgcaacgtcgaccacaagcccagcaacaccaaggtggacaagcgggtggagtccaagtacggcccgccctgcccgccctgccccgcgcccgagttcctcggcgggccgagcgtcttcctgttcccgcccaagcccaaggacaccctgatgatctcccgcacccccgaggtgacctgcgtggtcgtggacgtcagccaggaggaccccgaggtgcagttcaactggtacgtggacggcgtcgaggtgcacaacgccaagaccaagccccgggaggagcagttcaactccacctaccgcgtggtcagcgtgctcacggtgctgcaccaggactggctgaacgggaaggagtacaagtgcaaggtctccaacaagggcctccccagctccatcgagaagaccatcagcaaggccaaggggcagccgcgggagccccaggtgtacaccctgccgccctcccaggaggagatgaccaagaaccaggtgagcctgacgtgcctcgtcaagggcttctaccccagcgacatcgccgtggagtgggagtccaacggccagcccgagaacaactacaagaccaccccgcccgtgctggacagcgacgggtccttcttcctgtacagccgcctcaccgtcgacaagtcccggtggcaggagggcaacgtgttcagctgctccgtgatgcacgaggccctgcacaaccactacacgcagaagtccctgagcctcagcctggggaag

SEQ ID NO: 8449 - RNA, 657 nt, synthetic construct
  misc_feature 1..657: note = derived and/or modified sequence opt1 from Simtuzumab_LightChain1
  source 1..657: mol_type = other RNA
gacatcgtgatgacccagacgcccctgagcctctccgtcaccccgggccagcccgccagcatctcctgccgcagctccaagagcctgctgcactccaacgggaacacctacctctactggttcctgcagaagcccggccagagcccccagttcctgatctaccggatgtccaacctcgccagcggggtgccggaccgcttctccggcagcgggtccggcaccgacttcaccctgaagatcagccgggtggaggcggaggacgtcggcgtgtactactgcatgcagcacctggagtacccctacacgttcgggggcgggaccaaggtggagatcaagcgcaccgtcgccgccccctccgtgttcatcttcccgcccagcgacgagcagctcaagtccggcaccgccagcgtggtctgcctgctgaacaacttctacccccgggaggccaaggtgcagtggaaggtggacaacgcgctccagtccgggaacagccaggagagcgtcacggagcaggactccaaggacagcacctactccctgagctccaccctgaccctcagcaaggccgactacgagaagcacaaggtgtacgcctgcgaggtgacgcaccagggcctgtccagccccgtcaccaagtccttcaaccgcggcgagtgc

SEQ ID NO: 8450 - RNA, 1347 nt, synthetic construct
  misc_feature 1..1347: note = derived and/or modified sequence opt1 from Sirukumab_HeavyChain1
  source 1..1347: mol_type = other RNA
gaggtgcagctggtcgagagcggcgggggcctcgtgcagcccgggggctccctgcgcctgagctgcgccgcctccgggttcaccttcagcccgttcgcgatgtcctgggtgcggcaggcccccggcaagggcctcgagtgggtcgccaagatcagccccgggggctcctggacctactacagcgacacggtgaccgggcgcttcaccatctcccgggacaacgccaagaacagcctgtacctgcagatgaactccctccgcgccgaggacaccgcggtgtactactgcgcccggcagctgtggggctactacgccctggacatctgggggcagggcacgaccgtcaccgtgagctccgccagcaccaagggcccctccgtgttcccgctcgcgcccagctccaagagcacgtccgggggcaccgccgccctggggtgcctggtcaaggactacttccccgagcccgtgaccgtgagctggaacagcggcgccctcacctccggcgtccacacgttcccggccgtgctgcagagctccgggctgtacagcctctccagcgtggtcaccgtgccctccagctccctgggcacccagacctacatctgcaacgtgaaccacaagcccagcaacacgaaggtcgacaagaaggtggagcccaagtcctgcgacaagacccacacgtgcccgccctgccccgcgcccgagctgctcgggggcccgagcgtgttcctgttcccgcccaagcccaaggacaccctgatgatctcccgcacccccgaggtgacctgcgtcgtggtcgacgtgagccacgaggaccccgaggtcaagttcaactggtacgtggacggggtggaggtccacaacgccaagaccaagccccgggaggagcagtacaactccacctaccgcgtggtgagcgtcctcacggtgctgcaccaggactggctgaacggcaaggagtacaagtgcaaggtgtccaacaaggccctccccgccccgatcgagaagaccatcagcaaggccaagggccagccccgggagccccaggtctacaccctgcccccgtcccgcgacgagctgaccaagaaccaggtgagcctcacgtgcctggtgaaggggttctaccccagcgacatcgcggtcgagtgggagtccaacggccagcccgagaacaactacaagaccaccccgcccgtgctggacagcgacgggtccttcttcctctacagcaagctgaccgtggacaagtcccggtggcagcagggcaacgtcttcagctgctccgtgatgcacgaggccctgcacaaccactacacgcagaagtccctcagcctgagccccgggaag

SEQ ID NO: 8451 - RNA, 639 nt, synthetic construct
  misc_feature 1..639: note = derived and/or modified sequence opt1 from Sirukumab_LightChain1
  source 1..639: mol_type = other RNA
gagatcgtgctgacccagagccccgccaccctctccctgagcccgggcgagcgcgccacgctgtcctgcagcgcgtccatcagcgtctcctacatgtactggtaccagcagaagcccgggcaggcgccccggctcctgatctacgacatgagcaacctggcctccggcatccccgcccgcttcagcgggtccggcagcgggaccgacttcaccctcaccatctccagcctggagccggaggacttcgccgtgtactactgcatgcagtggtccggctacccctacacgttcggcgggggcaccaaggtggagatcaagcggaccgtcgccgcccccagcgtgttcatcttcccgccctccgacgagcagctcaagagcgggaccgcctccgtggtctgcctgctgaacaacttctacccccgcgaggccaaggtgcagtggaaggtggacaacgcgctgcagagcggcaacagccaggagtccgtcacggagcaggacagcaaggactccacctacagcctctccagcaccctgaccctgtccaaggccgactacgagaagcacaaggtgtacgcctgcgaggtgacgcaccaggggctcagctcccccgtcaccaagagcttcaaccggggcgagtgc

SEQ ID NO: 8452 - RNA, 1338 nt, synthetic construct
  misc_feature 1..1338: note = derived and/or modified sequence opt1 from Sofituzumab_vedotin_HeavyChain1
  source 1..1338: mol_type = other RNA
gaggtgcagctggtcgagagcggcgggggcctcgtgcagcccgggggctccctgcgcctgagctgcgccgcctccgggtacagcatcaccaacgactacgcgtggaactgggtgcggcaggccccgggcaagggcctcgagtgggtcgggtacatctcctacagcggctacaccacgtacaacccctccctcaagagccgcttcaccatctcccgggacaccagcaagaacaccctgtacctccagatgaactccctgcgcgccgaggacacggccgtgtactactgcgcccggtggaccagcgggctggactactggggccaggggaccctcgtgaccgtctccagcgcgtccacgaagggccccagcgtgttccccctggccccgtccagcaagtccaccagcggcgggaccgccgccctgggctgcctcgtgaaggactacttccccgagcccgtcaccgtgagctggaactccggggcgctgacgagcggcgtgcacaccttccccgccgtcctgcagtccagcggcctctactccctgagctccgtggtgaccgtcccgagctccagcctggggacccagacgtacatctgcaacgtgaaccacaagccctccaacaccaaggtggacaagaaggtcgagcccaagagctgcgacaagacccacacgtgcccgccctgccccgcccccgagctcctgggcgggccctccgtgttcctgttcccgcccaagcccaaggacaccctcatgatcagccgcacccccgaggtgacctgcgtcgtggtggacgtctcccacgaggacccggaggtgaagttcaactggtacgtcgacggcgtggaggtgcacaacgccaagaccaagccccgggaggagcagtacaacagcacgtaccgcgtcgtgtccgtgctgaccgtcctgcaccaggactggctcaacgggaaggagtacaagtgcaaggtgagcaacaaggccctgcccgcgcccatcgagaagaccatctccaaggccaagggccagccgcgggagccccaggtgtacaccctgccgcccagccgcgaggagatgacgaagaaccaggtcagcctgacctgcctggtgaagggcttctacccctccgacatcgccgtggagtgggagagcaacgggcagcccgagaacaactacaagaccacgcccccggtcctggactccgacggcagcttcttcctctactccaagctgaccgtggacaagagccggtggcagcaggggaacgtgttctcctgcagcgtcatgcacgaggccctgcacaaccactacacccagaagtccctcagcctgtcccccggcaag

SEQ ID NO: 8453 - RNA, 642 nt, synthetic construct
  misc_feature 1..642: note = derived and/or modified sequence opt1 from Sofituzumab_vedotin_LightChain1
  source 1..642: mol_type = other RNA
gacatccagatgacccagagcccctccagcctgtccgccagcgtgggcgaccgcgtcaccatcacgtgcaaggcctccgacctcatccacaactggctggcgtggtaccagcagaagccggggaaggcccccaagctgctcatctacggcgccaccagcctggagaccggggtgccctcccggttcagcggctccgggagcggcaccgacttcacgctgaccatctccagcctccagcccgaggacttcgccacctactactgccagcagtactggaccacgccgttcaccttcggccaggggaccaaggtggagatcaagcgcaccgtcgccgcgccctccgtgttcatcttcccgcccagcgacgagcagctgaagtccggcacggccagcgtggtctgcctgctcaacaacttctacccccgggaggccaaggtgcagtggaaggtggacaacgccctgcagtccgggaacagccaggagtccgtcaccgagcaggacagcaaggacagcacctactccctgagctccaccctcacgctgagcaaggcggactacgagaagcacaaggtgtacgcctgcgaggtgacccaccagggcctgtccagccccgtcaccaagtccttcaaccgcggggagtgc

SEQ ID NO: 8454 - RNA, 1323 nt, synthetic construct
  misc_feature 1..1323: note = derived and/or modified sequence opt1 from Solanezumab_HeavyChain1
  source 1..1323: mol_type = other RNA
gaggtgcagctggtcgagagcggcgggggcctcgtgcagcccgggggctccctgcgcctgagctgcgccgcctccgggttcaccttcagccggtactccatgagctgggtgcgccaggcgccgggcaagggcctcgagctggtcgcccagatcaactccgtggggaacagcacctactaccccgacaccgtgaagggccggttcaccatctcccgcgacaacgccaagaacaccctgtacctccagatgaacagcctgcgggccgaggacaccgccgtctactactgcgcgtccggggactactggggccaggggacgctggtgaccgtgagctccgccagcaccaagggcccctccgtcttccccctcgccccgagctccaagagcacctccggcgggacggccgcgctgggctgcctggtgaaggactacttccccgagcccgtgaccgtcagctggaacagcggggccctcacctccggcgtgcacaccttccccgccgtgctgcagagctccggcctgtacagcctctccagcgtcgtgacggtgccgtccagctccctggggacccagacctacatctgcaacgtcaaccacaagcccagcaacaccaaggtggacaagaaggtggagcccaagtcctgcgacaagacgcacacgtgcccgccctgccccgcccccgagctgctcggcgggcccagcgtcttcctgttcccgcccaagcccaaggacaccctgatgatctcccgcacccccgaggtgacctgcgtggtcgtggacgtcagccacgaggacccggaggtgaagttcaactggtacgtggacggcgtcgaggtgcacaacgccaagaccaagccccgggaggagcagtacaactccacctaccgcgtggtcagcgtgctcaccgtgctgcaccaggactggctgaacgggaaggagtacaagtgcaaggtctccaacaaggcgctccccgcccccatcgagaagacgatcagcaaggccaagggccagccgcgggagccccaggtgtacaccctgccgccctcccgcgacgagctgaccaagaaccaggtgagcctgacctgcctcgtcaagggcttctaccccagcgacatcgccgtggagtgggagtccaacgggcagcccgagaacaactacaagacgacgcccccggtgctggacagcgacggctccttcttcctctacagcaagctgaccgtcgacaagtcccggtggcagcaggggaacgtgttcagctgctccgtgatgcacgaggccctgcacaaccactacacccagaagtccctcagcctgagccccggc

SEQ ID NO: 8455 - RNA, 1326 nt, synthetic construct
  misc_feature 1..1326: note = derived and/or modified sequence opt1 from Solanezumab_HeavyChain
  source 1..1326: mol_type = other RNA
gaggtgcagctggtcgagagcggcgggggcctcgtgcagcccgggggctccctgcgcctgagctgcgccgcctccgggttcaccttcagccggtactccatgagctgggtgcgccaggcgccgggcaagggcctcgagctggtcgcccagatcaactccgtggggaacagcacctactaccccgacaccgtgaagggccggttcaccatctcccgcgacaacgccaagaacaccctgtacctccagatgaacagcctgcgggccgaggacaccgccgtctactactgcgcgtccggggactactggggccaggggacgctggtgaccgtgagctccgccagcaccaagggcccctccgtcttccccctcgccccgagctccaagagcacctccggcgggacggccgcgctgggctgcctggtgaaggactacttccccgagcccgtgaccgtcagctggaacagcggggccctcacctccggcgtgcacaccttccccgccgtgctgcagagctccggcctgtacagcctctccagcgtcgtgacggtgccgtccagctccctggggacccagacctacatctgcaacgtcaaccacaagcccagcaacaccaaggtggacaagaaggtggagcccaagtcctgcgacaagacgcacacgtgcccgccctgccccgcccccgagctgctcggcgggcccagcgtcttcctgttcccgcccaagcccaaggacaccctgatgatctcccgcacccccgaggtgacctgcgtggtcgtggacgtcagccacgaggacccggaggtgaagttcaactggtacgtggacggcgtcgaggtgcacaacgccaagaccaagccccgggaggagcagtacaactccacctaccgcgtggtcagcgtgctcaccgtgctgcaccaggactggctgaacgggaaggagtacaagtgcaaggtctccaacaaggcgctccccgcccccatcgagaagacgatcagcaaggccaagggccagccgcgggagccccaggtgtacaccctgccgccctcccgcgacgagctgaccaagaaccaggtgagcctgacctgcctcgtcaagggcttctaccccagcgacatcgccgtggagtgggagtccaacgggcagcccgagaacaactacaagacgacgcccccggtgctggacagcgacggctccttcttcctctacagcaagctgaccgtcgacaagtcccggtggcagcaggggaacgtgttcagctgctccgtgatgcacgaggccctgcacaaccactacacccagaagtccctcagcctgagccccggcaag

SEQ ID NO: 8456 - RNA, 657 nt, synthetic construct
  misc_feature 1..657: note = derived and/or modified sequence opt1 from Solanezumab_LightChain1
  source 1..657: mol_type = other RNA
gacgtggtcatgacccagagccccctgtccctcccggtgaccctgggccagcccgccagcatctcctgccgcagctcccagagcctgatctactccgacgggaacgcctacctccactggttcctgcagaagcccggccagagcccccggctgctcatctacaaggtgtccaaccgcttcagcggggtcccggaccggttctccggcagcgggtccggcacggacttcaccctgaagatcagccgcgtggaggcggaggacgtgggcgtctactactgctcccagagcacccacgtgccctggaccttcgggcagggcacgaaggtggagatcaagcggaccgtcgccgccccctccgtgttcatcttcccgcccagcgacgagcagctgaagtccgggaccgccagcgtggtctgcctcctgaacaacttctacccccgcgaggccaaggtgcagtggaaggtggacaacgcgctgcagagcggcaactcccaggagagcgtcaccgagcaggactccaaggacagcacgtactccctcagctccaccctgaccctgagcaaggccgactacgagaagcacaaggtgtacgcctgcgaggtgacccaccaggggctctccagccccgtcacgaagtccttcaaccggggcgagtgc

SEQ ID NO: 8457 - RNA, 1506 nt, synthetic construct
  misc_feature 1..1506: note = derived and/or modified sequence opt1 from Solitomab_HeavyChain1
  source 1..1506: mol_type = other RNA
gagctggtgatgacccagagcccctccagcctcaccgtcacggccggcgagaaggtgaccatgtcctgcaagagctcccagagcctgctgaactccgggaaccagaagaactacctcacctggtaccagcagaagccgggccagccgcccaagctgctgatctactgggccagcacccgcgagtccggggtgcccgaccggttcacgggcagcgggtccggcaccgacttcaccctcaccatcagctccgtccaggcggaggacctggccgtgtactactgccagaacgactacagctaccccctgacgttcggcgccgggaccaagctcgagatcaagggcgggggcgggtccggcggcgggggcagcgggggcggcgggtccgaggtgcagctgctggagcagagcggcgccgagctcgtccgccccgggacctccgtgaagatcagctgcaaggccagcggctacgcgttcaccaactactggctggggtgggtgaagcagcggcccggccacggcctggagtggatcggggacatcttccccggctccgggaacatccactacaacgagaagttcaagggcaaggccacgctcaccgccgacaagagctccagcaccgcctacatgcagctgtccagcctgaccttcgaggactccgcggtctacttctgcgcccgcctccggaactgggacgagccgatggactactgggggcagggcacgaccgtgaccgtgagctccggcgggggcgggagcgacgtccagctggtgcagtccggcgccgaggtgaagaagcccggggccagcgtcaaggtgtcctgcaaggccagcggctacaccttcacgcgctacaccatgcactgggtgcggcaggcgcccggccaggggctggagtggatcggctacatcaacccctcccgcgggtacaccaactacgccgacagcgtcaagggccggttcaccatcacgaccgacaagtccaccagcaccgcctacatggagctctccagcctgcgcagcgaggacacggccacctactactgcgcccggtactacgacgaccactactgcctggactactggggccaggggaccaccgtgacggtgtccagcggcgaggggacctccaccggcagcgggggctccggcgggagcggcggggcggacgacatcgtcctcacccagtccccggccacgctgagcctgtcccccggcgagcgcgccaccctcagctgccgggcctcccagagcgtgtcctacatgaactggtaccagcagaagcccgggaaggcccccaagcgctggatctacgacaccagcaaggtggcgtccggcgtcccggcccggttcagcggctccgggagcggcaccgactacagcctgaccatcaactccctggaggccgaggacgccgccacgtactactgccagcagtggagctccaaccccctcaccttcgggggcgggaccaaggtggagatcaagcaccaccaccaccaccac

SEQ ID NO: 8458 - RNA, 1506 nt, synthetic construct; identical to SEQ ID NO: 8457
  misc_feature 1..1506: note = derived and/or modified sequence opt1 from Solitomab_SingleChain
  source 1..1506: mol_type = other RNA

SEQ ID NO: 8459 - RNA, 702 nt, synthetic construct
  misc_feature 1..702: note = derived and/or modified sequence opt1 from Sonepcizumab_LightChain_Precursor
  source 1..702: mol_type = other RNA
atgagcgtgcccacccaggtcctgggcctcctgctgctctggctgaccgacgcccgctgcgagacgaccgtgacccagtccccgagcttcctgtccgccagcgtgggggaccgggtcaccatcacgtgcatcaccaccaccgacatcgacgacgacatgaactggttccagcaggagcccggcaaggcgcccaagctcctgatctccgaggggaacatcctgcgccccggcgtgccgagccggttctccagctccgggtacggcacggacttcaccctcaccatcagcaagctgcagcccgaggacttcgccacctactactgcctgcagtccgacaacctccccttcacgttcggccaggggaccaagctggagatcaagcgcaccgtggccgcccccagcgtcttcatcttcccgccctccgacgagcagctcaagagcggcaccgcctccgtggtgtgcctgctgaacaacttctacccccgggaggcgaaggtccagtggaaggtggacaacgccctgcagagcgggaactcccaggagagcgtgacggagcaggactccaaggacagcacctacagcctctccagcaccctgaccctgtccaaggccgactacgagaagcacaaggtctacgcctgcgaggtgacgcaccagggcctcagctcccccgtgaccaagagcttcaaccgcggggagtgc

SEQ ID NO: 8460 - RNA, 1365 nt, synthetic construct
  misc_feature 1..1365: note = derived and/or modified sequence opt1 from Sonepcizumab_gamma1-Chain_Precursor
  source 1..1365: mol_type = other RNA
atggagtggagctgggtgttcctgttcttcctctccgtcaccaccggcgtgcacagcgaggtgcagctggtccagtccggggccgaggtgaagaagcccggcgagagcctgaagatctcctgccagagcttcgggtacatcttcatcgaccacacgatccactggatgcgccagatgccgggccaggggctcgagtggatgggcgccatcagcccccggcacgacatcaccaagtacaacgagatgttccgcggccaggtgaccatctccgcggacaagtccagctccaccgcctacctgcagtggagctccctgaaggccagcgacacggccatgtacttctgcgcccgcgggggcttctacgggtccaccatctggttcgacttctggggccaggggaccatggtcaccgtgagctccgcgagcacgaagggcccctccgtgttccccctcgccccgagcagcaagtccaccagcggcgggaccgccgccctgggctgcctggtcaaggactacttccccgagcccgtgaccgtgtcctggaacagcggggcgctcacgtccggcgtccacaccttccccgccgtgctgcagagctccggcctgtacagcctctccagcgtggtcaccgtgccgtccagctccctggggacccagacgtacatctgcaacgtgaaccacaagcccagcaacaccaaggtcgacaagcgggtggcccccgagctgctcggcgggccctccgtgttcctgttcccgcccaagcccaaggacaccctgatgatcagccggacccccgaggtcacgtgcgtggtggtcgacgtgtcccacgaggacccggaggtcaagttcaactggtacgtggacggcgtggaggtccacaacgccaagaccaagccccgcgaggagcagtacaacagcacctaccgggtggtgtccgtcctcaccgtgctgcaccaggactggctgaacgggaaggagtacaagtgcaaggtgagcaacaaggccctccccgcgcccatcgagaagacgatcagcaaggccaagggccagccgcgcgagccccaggtctacaccctgccgccctcccgggaggagatgaccaagaaccaggtgagcctgacctgcctcgtgaagggcttctacccctccgacatcgccgtcgagtgggagagcaacgggcagcccgagaacaactacaagacgaccccgcccgtgctggactccgacggcagcttcttcctgtactccaagctcaccgtggacaagagccgctggcagcaggggaacgtcttctcctgcagcgtgatgcacgaggccctgcacaaccactacacccagaagtccctgagcctctcccccggcaag

SEQ ID NO: 8461 - RNA, 1338 nt, synthetic construct
  misc_feature 1..1338: note = derived and/or modified sequence opt1 from Stamulumab_HeavyChain1
  source 1..1338: mol_type = other RNA
gtgcagctggtccagagcggcgccgaggtgaagaagcccggggcctccgtgaaggtcagctgcaaggcgtccggctacaccttcaccagctactacatgcactgggtgcgccaggccccggggcagggcctcgagtggatggggatcatcaacccctccggcggcagcacgtcctacgcccagaagttccaggggcgggtgaccatgacccgcgacaccagcacgtccaccgtctacatggagctgagctccctgcggagcgaggacaccgccgtgtactactgcgcccgcgacgagaactggggcttcgacccctgggggcagggcaccctcgtgacggtctccagcgcgtccaccaaggggcccagcgtgttcccgctggccccctccagcaagtccaccagcggcggcaccgccgccctggggtgcctcgtgaaggactacttccccgagcccgtcacggtgagctggaactccggcgcgctgaccagcggggtgcacaccttcccggccgtcctgcagtccagcggcctctactccctgagctccgtggtgaccgtccccagctccagcctgggcacgcagacctacatctgcaacgtgaaccacaagccctccaacaccaaggtggacaagaaggtcgagcccaagagctgcgacaagacccacacgtgcccgccctgccccgcccccgagctcctcgggggcccgtccgtgttcctgttcccgcccaagcccaaggacaccctcatgatcagccggacccccgaggtgacctgcgtcgtggtcgacgtgtcccacgaggaccccgaggtgaagttcaactggtacgtcgacggggtggaggtgcacaacgccaagacgaagccccgcgaggagcagtacaacagcacctaccgggtcgtgtccgtgctgaccgtcctgcaccaggactggctcaacggcaaggagtacaagtgcaaggtgagcaacaaggccctgcccgcgccgatcgagaagaccatctccaaggccaaggggcagccccgcgagccccaggtgtacacgctgcccccgagccgggaggagatgaccaagaaccaggtcagcctgacctgcctggtgaagggcttctacccctccgacatcgccgtggagtgggagagcaacggccagcccgagaacaactacaagaccacgccgcccgtcctggactccgacgggagcttcttcctctactccaagctgaccgtggacaagagccgctggcagcagggcaacgtgttctcctgcagcgtcatgcacgaggccctgcacaaccactacacccagaagtccctcagcctgtcccccgggaag

SEQ ID NO: 8462 - RNA, 633 nt, synthetic construct
  misc_feature 1..633: note = derived and/or modified sequence opt1 from Stamulumab_LightChain1
  source 1..633: mol_type = other RNA
agctacgagctgacccagcccccgtccgtgagcgtctcccccggccagaccgccagcatcacgtgctccgggcacgccctcggcgacaagttcgtgagctggtaccagcagaagcccgggcagtcccccgtgctggtcatctacgacgacacccagcgcccgagcggcatccccgagcggttctccgggagcaactccggcaacaccgcgaccctgacgatcagcggcacccaggccatggacgaggccgactactactgccaggcctgggactccagcttcgtgttcgggggcgggaccaaggtgaccgtcctcggccagcccaaggccgcgccctccgtgacgctgttcccgcccagctccgaggagctgcaggccaacaaggccaccctcgtgtgcctgatcagcgacttctaccccggggccgtcaccgtggcgtggaaggccgactccagccccgtgaaggccggcgtcgagaccacgaccccgagcaagcagtccaacaacaagtacgccgccagctcctacctgagcctcacccccgagcagtggaagtcccaccgcagctactcctgccaggtgacccacgagggcagcacggtggagaagaccgtcgcgcccaccgagtgctcc

SEQ ID NO: 8463 - RNA, 1356 nt, synthetic construct
  misc_feature 1..1356: note = derived and/or modified sequence opt1 from Suptavumab_HeavyChain1
  source 1..1356: mol_type = other RNA
gaggtgcagctggtcgagagcggcggggacctcgtgcagcccggccgctccctgcggctgagctgcgtggcctccgggttcaccttcgacgactacgccatgcactgggtccgccaggcgccgggcaaggggctcgagtgggtgagcggcgtgtcctggagcggctccaccgtcgggtacgccgacagcgtgaagggccggttcacggtgtcccgcgacaacgcccagaagtccctgtacctgcagatgaacagcctccgggccgaggacaccgccctgtactactgcgtcaaggacgcgtacaagttcaactactactactacgggctggacgtgtggggccaggggaccaccgtgacggtcagctccgccagcaccaagggcccctccgtgttccccctcgcccccagctccaagagcacctccggcgggaccgccgcgctgggctgcctggtgaaggactacttcccggagcccgtcacggtgagctggaacagcggggccctcacctccggcgtgcacaccttccccgccgtcctgcagagctccggcctgtacagcctctccagcgtggtgaccgtcccctccagctccctggggacgcagacctacatctgcaacgtgaaccacaagccgagcaacaccaaggtggacaagaaggtcgagcccaagtcctgcgacaagacccacacgtgcccgccctgcccggcccccgagctgctcggcgggcccagcgtgttcctgttcccgcccaagcccaaggacaccctgatgatctcccgcacccccgaggtgacctgcgtcgtggtcgacgtgagccacgaggaccccgaggtgaagttcaactggtacgtcgacggcgtggaggtgcacaacgccaagacgaagccgcgggaggagcagtacaactccacctaccgcgtcgtgagcgtgctcaccgtcctgcaccaggactggctgaacgggaaggagtacaagtgcaaggtgtccaacaaggcgctccccgcccccatcgagaagaccatcagcaaggccaagggccagccccgggagccccaggtgtacacgctgccgccctcccgcgacgagctgaccaagaaccaggtcagcctgacctgcctcgtgaagggcttctaccccagcgacatcgccgtggagtgggagtccaacgggcagcccgagaacaactacaagaccacgccgcccgtcctggacagcgacggctccttcttcctctacagcaagctgaccgtggacaagtcccggtggcagcaggggaacgtgttcagctgctccgtcatgcacgaggccctgcacaaccactacacccagaagtccctcagcctgagccccggc

SEQ ID NO: 8464 - RNA, 642 nt, synthetic construct
  misc_feature 1..642: note = derived and/or modified sequence opt1 from Suptavumab_LightChain1
  source 1..642: mol_type = other RNA
gagatcgtgatgacccagagccccgccaccctgtccgtcagcccgggcgagcgcgccacgctctcctgccgggcgagccagaccatcctgtccaacctggcctggtacctccagaagcccgggcaggcgccccgcctgctgatctacggcgccagcacccgggccaccgggctccccgcccgcttctccggcagcgggtccggcacggagttcaccctgaccatcagctccctgcagagcgaggacttcgccgtgtactactgccagcagtacaacaactggccgctcaccttcggcgggggcacgaaggtggagatcaagcggaccgtcgccgccccctccgtgttcatcttcccgcccagcgacgagcagctgaagtccgggaccgcgagcgtggtctgcctgctcaacaacttctacccccgcgaggccaaggtgcagtggaaggtggacaacgccctgcagtccggcaacagccaggagtccgtcaccgagcaggacagcaaggacagcacgtactccctgagctccaccctcaccctgagcaaggccgactacgagaagcacaaggtgtacgcctgcgaggtgacccaccaggggctgtccagccccgtcacgaagtccttcaaccggggcgagtgc

SEQ ID NO: 8465 - RNA, 1344 nt, synthetic construct
  misc_feature 1..1344: note = derived and/or modified sequence opt1 from Suvizumab_HeavyChain1
  source 1..1344: mol_type = other RNA
caggtgcagctggtccagagcggcgccgaggtgaagaagcccggggcctccgtgaaggtcagctgcaaggcgtccggctacaccttcaccaacagctggatcgggtggttccgccaggccccgggccaggggctcgagtggatcggcgacatctaccccggcgggggctacacgaactacaacgagatcttcaaggggaaggccaccatgaccgccgacacctccacgaacaccgcctacatggagctgagctccctgcggagcgaggacaccgcggtgtactactgctcccgcggcatccccgggtacgccatggactactggggccagggcaccctcgtgacggtcagctccgccagcaccaaggggccctccgtgttcccgctggcccccagctccaagagcacctccggcgggaccgcggccctgggctgcctcgtgaaggactacttccccgagcccgtcacggtgagctggaactccggcgccctgaccagcggggtgcacaccttcccggccgtcctgcagagctccggcctctacagcctgtccagcgtggtgaccgtcccctccagctccctggggacgcagacctacatctgcaacgtgaaccacaagcccagcaacaccaaggtggacaagaaggtcgagcccaagtcctgcgacaagacccacacgtgcccgccctgccccgcccccgagctcctgggcgggccgagcgtgttcctgttcccgcccaagcccaaggacaccctcatgatctcccggacccccgaggtgacctgcgtcgtggtggacgtcagccacgaggaccccgaggtgaagttcaactggtacgtcgacggcgtggaggtgcacaacgcgaagacgaagccccgcgaggagcagtacaactccacctaccgggtcgtgagcgtgctgaccgtcctgcaccaggactggctcaacggcaaggagtacaagtgcaaggtgtccaacaaggccctgcccgccccgatcgagaagaccatcagcaaggccaaggggcagccccgcgagccccaggtgtacacgctgcccccgtcccgggacgagctcaccaagaaccaggtcagcctgacctgcctggtgaagggcttctacccctccgacatcgccgtggagtgggagagcaacgggcagcccgagaacaactacaagaccacgccgcccgtcctcgacagcgacggctccttcttcctgtacagcaagctgaccgtggacaagtcccgctggcagcaggggaacgtgttcagctgctccgtcatgcacgaggcgctccacaaccactacacccagaagtccctgagcctgagccccggcaag

SEQ ID NO: 8466 - RNA, 660 nt, synthetic construct
  misc_feature 1..660: note = derived and/or modified sequence opt1 from Suvizumab_LightChain1
  source 1..660: mol_type = other RNA
gacatccagatgacccagcgccccgacagcctgtccgccagcgtgggcgaccgggtcaccatgtcctgcaagagctcccagagcctcctgaactccggggaccagaagaactacctgacgtggtaccagcagaagccgggccagccgcccaagctcctgatctactgggccagcaccggggagtccggcgtgcccgaccgcttcagcgggtccggcagcggcaccgacttcaccttcacgatctccagcctgcagcccgaggacatcgcgacctactactgccagaacgactactcctacccctggaccttcgggcagggcaccaaggtggagatcaagcggacggtcgccgcccccagcgtgttcatcttcccgccctccgacgagcagctcaagagcgggaccgcctccgtggtctgcctgctgaacaacttctacccccgcgaggccaaggtgcagtggaaggtggacaacgcgctccagagcggcaacagccaggagtccgtcaccgagcaggacagcaaggactccacctacagcctgtccagcacgctgaccctctccaaggccgactacgagaagcacaaggtgtacgcctgcgaggtgacccaccaggggctgagctcccccgtcaccaagagcttcaaccggggcgagtgc

SEQ ID NO: 8467 - RNA, 1350 nt, synthetic construct
  misc_feature 1..1350: note = derived and/or modified sequence opt1 from Tabalumab_HeavyChain1
  source 1..1350: mol_type = other RNA
caggtgcagctgcagcagtggggcgccgggctcctgaagcccagcgagaccctgtccctgacctgcgccgtctacggcgggagcttctccggctactactggagctggatccgccagccgcccgggaagggcctggagtggatcggcgagatcaaccactccgggagcacgaactacaacccctccctcaagagccgggtgaccatctccgtggacaccagcaagaaccagttctccctcaagctgagctccgtcaccgcggccgacacggccgtgtactactgcgcccgcggctactacgacatcctgaccgggtactactactacttcgactactggggccaggggaccctcgtgaccgtcagctccgccagcacgaagggcccctccgtgttcccgctggcgccctgcagccggtccaccagcgagagcaccgccgccctgggctgcctcgtgaaggactacttccccgagcccgtcaccgtgtcctggaacagcggggccctgacgtccggcgtgcacaccttcccggcggtcctgcagagctccgggctctacagcctgtccagcgtggtgaccgtcccctccagctccctgggcaccaagacgtacacgtgcaacgtggaccacaagcccagcaacaccaaggtggacaagcgcgtcgagtccaagtacgggcccccgtgcccgccctgccccgcccccgagttcctcggcggccccagcgtgttcctgttcccgcccaagcccaaggacaccctgatgatctcccggacccccgaggtgacctgcgtcgtggtggacgtcagccaggaggaccccgaggtgcagttcaactggtacgtcgacggggtggaggtgcacaacgccaagaccaagccccgcgaggagcagttcaactccacctaccgggtcgtgagcgtgctcacggtcctgcaccaggactggctgaacggcaaggagtacaagtgcaaggtgtccaacaaggggctcccgagcagcatcgagaagaccatctccaaggccaagggccagccccgcgagccccaggtgtacaccctgcccccgagccaggaggagatgaccaagaaccaggtctccctgacgtgcctcgtgaagggcttctaccccagcgacatcgccgtggagtgggagtccaacgggcagcccgagaacaactacaagaccaccccgcccgtcctggacagcgacggctccttcttcctgtacagccggctcaccgtggacaagtcccgctggcaggaggggaacgtgttcagctgctccgtcatgcacgaggcgctgcacaaccactacacgcagaagtccctgagcctcagcctgggcaag

SEQ ID NO: 8468 - RNA, 642 nt, synthetic construct
  misc_feature 1..642: note = derived and/or modified sequence opt1 from Tabalumab_LightChain1
  source 1..642: mol_type = other RNA
gagatcgtgctgacccagagccccgccaccctctccctgagcccgggcgagcgcgccacgctgtcctgccgggcgagccagtccgtcagccgctacctcgcctggtaccagcagaagcccgggcaggcgccccggctgctgatctacgacgcctccaaccgcgccaccggcatccccgcccggttcagcgggtccggcagcgggaccgactccaccctcacgatcagctccctggagccggaggacttcgccgtgtactactgccagcagcgcagcaactggccccggaccttcggccagggcaccaaggtggagatcaagcgcaccgtcgccgccccctccgtgttcatcttcccgcccagcgacgagcagctgaagtccgggacggcgagcgtggtctgcctcctgaacaacttctacccccgggaggccaaggtgcagtggaaggtggacaacgccctgcagtccggcaacagccaggagagcgtcaccgagcaggactccaaggacagcacctactccctcagcaacaccctgacgctgtccaaggccgactacgagaagcacaaggtgtacgcctgcgaggtgacccaccaggggctcagctcccccgtcaccaagagcttcaaccgcggcgagtgc

SEQ ID NO: 8469 - RNA, 1332 nt, synthetic construct
  misc_feature 1..1332: note = derived and/or modified sequence opt1 from Tacatuzuab_HeavyChain1
  source 1..1332: mol_type = other RNA
caggtgcagctgcagcagagcggcgccgaggtcaagaagcccgggtccagcgtgaaggtgtcctgcaaggccagcggctacgcgttcacctcctacgtcatccactgggtgcgccaggccccggggcagggcctctactggatcgggtacatccacccctacaacggcggcaccaagtacaacgagaagttcaaggggaaggccacgatcaccgccgacgagagcaccaacaccgcctacgagctgtccagcctgcggtccgaggacacggcgttctacttctgcgcccgcagcggcgggggcgaccccttcgcctactgggggcagggctccctcgtgaccgtcagctccgccagcaccaagggcccctccgtgttcccgctggcgcccagctccaagagcacctccgggggcacggccgccctggggtgcctcgtgaaggactacttccccgagcccgtcaccgtgagctggaacagcggcgccctgacctccggcgtgcacaccttcccggccgtcctgcagagctccgggctctacagcctgtccagcgtggtgacggtcccctccagctccctgggcacccagacctacatctgcaacgtgaaccacaagcccagcaacaccaaggtggacaagcgggtcgagcccaagtcctgcgacaagacgcacacgtgcccgccctgccccgcgcccgagctcctcgggggcccgagcgtgttcctgttcccgcccaagcccaaggacaccctcatctcccgcacccccgaggtgacctgcgtcgtggtggacgtcagccacgaggaccccgaggtgaagttcaactggtacgtcgacggggtggaggtgcacaacgccaagaccaagccccgggaggagcagtacaactccacctaccgcgtcgtgagcgtgctgaccgtcctgcaccaggactggctcaacggcaaggagtacaagtgcaaggtgtccaacaaggccctgcccgccccgatcgagaagacgatcagcaaggccaagggccagccccgggagccccaggtgtacaccctgcccccgtcccgcgaggagaccaagaaccaggtcagcctgacctgcctggtgaaggggttctaccccagcgacatcgcggtggagtgggagtccaacggccagcccgagaacaactacaagacgaccccgcccgtcctggacagcgacgggtccttcttcctctacagcaagctgaccgtggacaagtcccggtggcagcagggcaacgtgttcagctgctccgtccacgaggccctgcacaaccactacacccagaagtccctcagcctgagccccgggaag

SEQ ID NO: 8470 - RNA, 636 nt, synthetic construct
  misc_feature 1..636: note = derived and/or modified sequence opt1 from Tacatuzuab_LightChain1
  source 1..636: mol_type = other RNA
gacatccagctgacccagagcccctccagcctctccgccagcgtgggcgaccgcgtcaccatcacgtgcaaggcctcccaggacatcaacaagtacatcgggtggtaccagcagaagccgggcaaggcgcccaagctgctgcactacaccagcgccctcctgcccgggatcccctcccggttcagcggctccgggagcggccgcgactacaccttcaccatctccagcctgcagccggaggacatcgccacgtactactgcctccagtacgacgacctgtggaccttcggcgggggcaccaagctgcagatcaagcggaccgtggccgccccctccgtgttcatcttcccgcccagcgacgagcagctcaagtccgggacggcgagcgtcgtgtgcctgctgaacaacttctacccccgcgaggccaaggtgcagtggaaggtcgacaacgccctccagtccggcaacagccaggagtccgtgaccgagcaggacagcaaggacagcacctactccctgagctccaccctgacgctcagcaaggccgactacgagaagcacaaggtgtacgcgtgcgaggtcacccaccaggggctgtccagccccgtgaccaagtccttcaaccggggcgagtgc

SEQ ID NO: 8471 - RNA, 678 nt, synthetic construct
  misc_feature 1..678: note = derived and/or modified sequence opt1 from Tadocizumab_fab_fragment_HeavyChain
  source 1..678: mol_type = other RNA
caggtgcagctggtccagagcggcgccgaggtgaagaagcccgggtccagcgtgaaggtctcctgcaaggccagcggctacgcgttcaccaactacctcatcgagtgggtgcgccaggccccggggcagggcctggagtggatcggggtgatctaccccggctccggcgggaccaactacaacgagaagttcaagggccgggtcacgctgaccgtggacgagagcaccaacaccgcctacatggagctctccagcctgcgctccgaggacacggccgtgtacttctgcgcccggcgcgacgggaactacggctggttcgcgtactgggggcagggcaccctggtcaccgtgagctccgccagcaccaagggcccctccgtgttccccctcgccccgagctccaagagcacgtccgggggcaccgccgcgctggggtgcctggtcaaggactacttccccgagcccgtgaccgtgagctggaactccggcgccctcaccagcggcgtccacacgttccccgccgtgctgcagagctccgggctgtacagcctctccagcgtggtcaccgtgccgtccagctccctgggcacccagacctacatctgcaacgtgaaccacaagcccagcaacacgaaggtcgacaagaaggtggagcccaagtcctgcgacaagacccac

SEQ ID NO: 8472 - RNA, 582 nt, synthetic construct
  misc_feature 1..582: note = derived and/or modified sequence opt1 from Tadocizumab_fab_fragment_LightChain
  source 1..582: mol_type = other RNA
gacatccagatgacccagacccccagcacgctgtccgccagcgtgggcgaccgcgtcaccatctcctgccgggccagccaggacatcaacaactacctcaactggtaccagcagaagccggggaaggcgcccaagctgctgatctactacacctccaccctccacagcggcgtgccctcccgcttcagcgggtccggcagcgggacggactacaccctgaccatctccagcctgcagcccgacgacttcgccacctacttctgccagcagggcaacacgctcccgtggaccttcggccaggggaccaaggtggaggtcaagcggaccgtggccgccccctccgtgttcatcttcccgcccagcgacgagcagctgaagtccggcacggccagcgtcgtgtgcctgctcaacaacttctacgagtccgtgaccgagcaggacagcaaggactccacctacagcctgagctccaccctgacgctcagcaaggcggactacgagaagcacaaggtctacgcctgcgaggtgacccaccaggggctgtccagccccgtgaccaagtccttcaaccgcggcgagtgc

SEQ ID NO: 8473 - RNA, 1359 nt, synthetic construct
  misc_feature 1..1359: note = derived and/or modified sequence opt1 from Talizumab_HeavyChain1
  source 1..1359: mol_type = other RNA
caggtgcagctggtccagagcggcgccgaggtgaagaagcccggggcctccgtgaaggtcagctgcaaggcgtccggctacaccttcagcatgtactggctcgagtgggtgcgccaggccccggggcacggcctggagtgggtgggggagatctcccccggcaccttcaccaccaactacaacgagaagttcaaggcccgggccaccttcaccgccgacacgagcaccaacaccgcgtacatggagctgtccagcctccgctccgaggacaccgccgtctactactgcgcccggttcagccacttctccggcagcaactacgactacttcgactactgggggcagggcacgctggtgaccgtgtccagcgcctccaccaaggggcccagcgtcttccccctggcgccgtccagcaagtccaccagcggcgggacggccgccctcggctgcctggtgaaggactacttccccgagcccgtgaccgtcagctggaactccggcgccctgaccagcggggtgcacaccttccccgccgtgctccagtccagcggcctgtactccctgagctccgtcgtgacggtgccgagctccagcctcgggacccagacctacatctgcaacgtcaaccacaagccctccaacaccaaggtggacaagaaggtggagcccaagagctgcgacaagacgcacacgtgcccgccctgccccgcgcccgagctgctgggcggcccctccgtcttcctcttcccgcccaagcccaaggacaccctgatgatcagccgcacccccgaggtgacctgcgtggtcgtggacgtctcccacgaggacccggaggtgaagttcaactggtacgtggacggggtcgaggtgcacaacgccaagaccaagccccgggaggagcagtacaacagcacctaccgcgtggtctccgtgctgaccgtgctccaccaggactggctgaacggcaaggagtacaagtgcaaggtcagcaacaaggccctgcccgcccccatcgagaagacgatctccaaggccaaggggcagccgcgggagccccaggtgtacaccctcccgcccagccgcgacgagctgaccaagaaccaggtgagcctgacctgcctcgtcaagggcttctacccctccgacatcgcggtggagtgggagagcaacgggcagcccgagaacaactacaagacgacgcccccggtgctggactccgacggcagcttcttcctgtactccaagctcaccgtcgacaagagccggtggcagcagggcaacgtgttctcctgcagcgtgatgcacgaggccctgcacaaccactacacccagaagtccctgagcctctcccccgggaag

SEQ ID NO: 8474 - RNA, 642 nt, synthetic construct
  misc_feature 1..642: note = derived and/or modified sequence opt1 from Talizumab_LightChain1
  source 1..642: mol_type = other RNA
gacatcctgctcacccagagccccggcaccctgtccctgagcccgggggagcgcgccacgctctcctgccgggccagccagtccatcggcaccaacatccactggtaccagcagaagcccgggcaggcgccccgcctgctgatcaagtacgccagcgagtccatcagcggcatcccctcccggttcagcgggtccggcagcggcaccgacttcaccctcacgatctcccgcctggagccggaggacttcgccatgtactactgccagcagagcgactcctggcccaccaccttcgggcagggcaccaaggtggagatcaagcggacggtcgccgcccccagcgtgttcatcttcccgccctccgacgagcagctcaagagcgggaccgcgtccgtggtctgcctgctgaacaacttctacccccgcgaggccaaggtgcagtggaaggtggacaacgccctgcagagcggcaacagccaggagtccgtcaccgagcaggacagcaaggactccacctacagcctctccagcacgctgaccctgtccaaggccgactacgagaagcacaaggtgtacgcgtgcgaggtgacccaccaggggctcagctcccccgtcaccaagagcttcaaccggggcgagtgc

SEQ ID NO: 8475 - RNA, 1368 nt, synthetic construct
  misc_feature 1..1368: note = derived and/or modified sequence opt1 from Tamtuvetmab_HeavyChain1
  source 1..1368: mol_type = other RNA
gaggtgaagctgctcgagagcggcgggggcctggtccagcccgggggctccatgcgcctgagctgcgccgggtccggcttcaccttcaccgacttctacatgaactggatccggcagcccgccggcaaggcgcccgagtggctcgggttcatccgcgacaaggccaagggctacacgaccgagtacaaccccagcgtgaaggggcggttcaccatctcccgcgacaacacccagaacatgctgtacctgcagatgaacacgctccgggccgaggacaccgccacctactactgcgcccgcgagggccacaccgcggcccccttcgactactgggggcagggcacgctggtgaccgtcagctccgccagcaccaccgccccgtccgtgttccccctggcgcccagctgcggctccacgagcgggtccaccgtggccctcgcctgcctggtcagcggctacttccccgagccggtgaccgtgtcctggaacagcgggtccctgaccagcggcgtccacacgttcccctccgtgctccagagcagcggcctgtactccctgagctccatggtgaccgtccccagctcccggtggcccagcgagaccttcacgtgcaacgtggcccacccggcctccaagaccaaggtggacaagcccgtccccaagcgcgagaacgggcgggtgccccgcccgcccgactgccccaagtgccccgcgccggagatgctcggcgggcccagcgtgttcatcttcccgcccaagcccaaggacaccctgctgatcgcccggacccccgaggtgacctgcgtcgtggtcgacctcgaccccgaggaccccgaggtgcagatctcctggttcgtggacggcaagcagatgcagacggccaagacccagccgcgcgaggagcagttcaacgggacctaccgggtcgtgagcgtcctgcccatcggccaccaggactggctgaagggcaagcagttcacgtgcaaggtgaacaacaaggccctcccctccccgatcgagcgcaccatcagcaaggcccgggggcaggcgcaccagccctccgtgtacgtcctgccgcccagccgcgaggagctgtccaagaacaccgtgagcctgacctgcctcatcaaggacttcttcccgcccgacatcgacgtggagtggcagtccaacggccagcaggagcccgagagcaagtaccggaccacgccgccccagctggacgaggacgggtcctacttcctctacagcaagctgagcgtcgacaagtcccgctggcagcggggcgacaccttcatctgcgccgtgatgcacgaggccctgcacaaccactacacccagaagtccctcagccacagccccgggaag

SEQ ID NO: 8476 - RNA, 639 nt, synthetic construct
  misc_feature 1..639: note = derived and/or modified sequence opt1 from Tamtuvetmab_LightChain1
  source 1..639: mol_type = other RNA
gacatcaagatgacccagagcccctccttcctgagcgcctccgtgggcgaccgcgtcaccctcaactgcaaggccagccagaacatcgacaagtacctgaactggtaccagcagaagctgggggagtccccgaagctcctgatctacaacacgaacaacctgcagaccggcatccccagccggttctccgggagcggctccgggaccgacttcaccctcacgatcagctccctgcagcccgaggacgtggcgacctacttctgcctgcagcacatcagccgcccccggaccttcggcggcgggacccacctcacggtgctgggccagccgaaggcctcccccagcgtcaccctgttcccgccctccagcgaggagctcggggccaacaaggccaccctggtgtgcctgatctccgacttctaccccagcggcgtgaccgtcgcctggaaggcggacgggtcccccatcacgcagggcgtggagaccaccaagcccagcaagcagagcaacaacaagtacgccgcctccagctacctctccctgacccccgacaagtggaagtcccacagcagcttctcctgcctggtgacgcacgagggcagcaccgtcgagaagaaggtggccccggcggagtgctcc

SEQ ID NO: 8477 - RNA, 360 nt, synthetic construct
  misc_feature 1..360: note = derived and/or modified sequence opt1 from Tanezumab_HeavyChain
  source 1..360: mol_type = other RNA
caggtgcagctgcaggagagcggccccgggctcgtcaagccctccgagaccctgagcctgacctgcacggtgtccggcttcagcctcatcgggtacgacctgaactggatccgccagccgcccggcaaggggctggagtggatcggcatcatctggggcgacgggaccaccgactacaactccgccgtcaagagccgggtgaccatctccaaggacacgagcaagaaccagttctccctcaagctgagctccgtgaccgccgcggacaccgccgtgtactactgcgcccgcggcgggtactggtacgccaccagctactacttcgactactggggccaggggacgctggtcaccgtgtcc

SEQ ID NO: 8478 - RNA, 327 nt, synthetic construct
  misc_feature 1..327: note = derived and/or modified sequence opt1 from Tanezumab_LightChain
  source 1..327: mol_type = other RNA
gacatccagatgacccagagcccctccagcctgtccgccagcgtgggcgaccgcgtcaccatcacgtgccgggcctcccagagcatctccaacaacctcaactggtaccagcagaagccggggaaggcgcccaagctgctgatctactacaccagccgcttccactccggcgtgcccagccggttctccgggagcggctccgggaccgacttcaccttcacgatcagctccctccagcccgaggacatcgccacctactactgccagcaggagcacaccctgccgtacaccttcggccagggcacgaagctggagatcaagcgcacc

SEQ ID NO: 8479 - RNA, 1323 nt, synthetic construct
  misc_feature 1..1323: note = derived and/or modified sequence opt1 from Tarextumab_HeavyChain1
  source 1..1323: mol_type = other RNA
gaggtgcagctggtcgagagcggcgggggcctcgtgcagcccgggggctccctgcgcctgagctgcgccgcctccgggttcaccttcagctccagcggcatgtcctgggtgcggcaggcgccgggcaaggggctcgagtgggtcagcgtgatcgcctccagcggctccaacacctactacgccgacagcgtgaaggggcgcttcacgatctcccgggacaacagcaagaacaccctgtacctgcagatgaactccctccgcgccgaggacaccgccgtctactactgcgcgcggagcatcttctacaccacgtggggccaggggaccctggtgaccgtgtccagcgcctccaccaagggccccagcgtcttccccctggccccctgcagccgctccacgagcgagtccaccgccgcgctcggctgcctggtgaaggactacttcccggagcccgtgaccgtcagctggaactccggggccctgaccagcggcgtgcacacgttccccgccgtgctccagtccagcgggctgtactccctgagctccgtcgtgaccgtgcccagctccaacttcggcacccagacctacacgtgcaacgtcgaccacaagccgagcaacaccaaggtggacaagaccgtggagcggaagtgctgcgtcgagtgcccgccctgccccgccccgcccgtggccggcccctccgtgttcctcttcccgcccaagcccaaggacaccctgatgatcagccgcacgcccgaggtgacctgcgtcgtcgtggacgtgtcccacgaggaccccgaggtccagttcaactggtacgtggacggggtggaggtccacaacgcgaagaccaagccgcgggaggagcagttcaacagcaccttccgcgtggtgtccgtcctgacggtggtgcaccaggactggctcaacggcaaggagtacaagtgcaaggtcagcaacaaggggctgcccgcccccatcgagaagaccatcagcaagaccaagggccagccccgggagccccaggtgtacaccctgccgccctcccgcgaggagatgacgaagaaccaggtgagcctgacctgcctcgtcaaggggttctacccctccgacatcgccgtggagtgggagagcaacggccagcccgagaacaactacaagaccaccccgcccatgctggactccgacggcagcttcttcctctactccaagctgacggtggacaagagccggtggcagcaggggaacgtcttctcctgcagcgtgatgcacgaggccctgcacaaccactacacccagaagtccctcagcctgtcccccggcaag

SEQ ID NO: 8480 - RNA, 645 nt, synthetic construct
  misc_feature 1..645: note = derived and/or modified sequence opt1 from Tarextumab_LightChain1
  source 1..645: mol_type = other RNA
gacatcgtgctgacccagagccccgccaccctctccctgagcccgggcgagcgcgccacgctgtcctgccgggcgagccagtccgtccgcagcaactacctcgcctggtaccagcagaagcccgggcaggcgccccggctgctgatctacggcgcctccagccgcgccaccggggtgcccgcccggttctccggcagcgggtccggcaccgacttcaccctcacgatcagctccctggagccggaggacttcgccgtgtactactgccagcagtacagcaacttccccatcaccttcggccaggggaccaaggtcgagatcaagcgcaccgtggccgccccctccgtgttcatcttcccgcccagcgacgagcagctgaagtccggcacggcgagcgtcgtgtgcctcctgaacaacttctacccccgggaggccaaggtgcagtggaaggtcgacaacgccctgcagtccgggaacagccaggagagcgtgaccgagcaggactccaaggacagcacctactccctcagctccaccctgacgctgagcaaggccgactacgagaagcacaaggtgtacgcctgcgaggtcacccaccagggcctctccagccccgtgaccaagtccttcaaccgcggggagtgc

SEQ ID NO: 8481 - RNA, 363 nt, synthetic construct
  misc_feature 1..363: note = derived and/or modified sequence opt1 from Tefibazumab_HeavyChain1
  source 1..363: mol_type = other RNA
caggtgcagctgaaggagagcggccccgggctcgtcaagccctcccagaccctgagcatcacgtgcaccatctccggcttcagcctgtcccgctacagcgtgcactgggtgcggcagccgcccgggaagggcctcgagtggctggggatgatctggggcggcgggaacaccgactacaactccgccctcaagagccgcctgtccatcagcaaggacaactccaagaaccaggtcttcctgaagatgaacagcctgaccgccgcggacaccgccgtgtactactgcgcccggaagggcgagttctactacgggtacgacggcttcgtgtactgggggcagggcacgctcgtcaccgtgtccagc

SEQ ID NO: 8482 - RNA, 336 nt, synthetic construct
  misc_feature 1..336: note = derived and/or modified sequence opt1 from Tefibazumab_LightChain1
  source 1..336: mol_type = other RNA
gacatcgtgatgacccagagccccgactccctggccgtcagcctcggcgagcgcgtgaccatgaactgcaagtccagccagtccgtgctgtacagctccaaccagaagaactacctggcctggtaccagcagaagccggggcagagccccaagctcctgatctactgggcgtccacgcgggagagcggcgtccccgaccgcttctccgggagcggctccgggaccgacttcaccctgaccatcagctccgtgcaggccgaggacctcgccgtgtactactgccaccagtacctgagctcctacacgttcggcggcgggaccaagctggagatcaag

SEQ ID NO: 8483 - RNA, 1368 nt, synthetic construct
  misc_feature 1..1368: note = derived and/or modified sequence opt1 from Tenatumomab_HeavyChain1
  source 1..1368: mol_type = other RNA
gagatccagctgcagcagagcggccccgagctcgtgaagccgggggcctccgtcaaggtgagctgcaaggcctccggctacgcgttcaccagctacaacatgtactgggtgaagcagtcccacggcaagagcctggagtggatcgggtacatcgacccctacaacggggtcacctcctacaaccagaagttcaagggcaaggccacgctgaccgtggacaagagctccagcaccgcctacatgcacctcaactccctgaccagcgaggactccgccgtgtactactgcgcccgcggcgggggcagcatctactacgcgatggactactgggggcagggcacgtccgtcaccgtgagctccgccaagaccaccccgcccagcgtgtaccccctggcccccgggtgcggcgacacgaccggctccagcgtcaccctcgggtgcctggtgaagggctacttccccgagagcgtgaccgtcacgtggaactccgggagcctgtccagctccgtgcacaccttccccgccctcctgcagagcggcctgtacaccatgtccagctccgtgaccgtcccgagctccacgtggcccagccagaccgtgacctgctccgtggcgcaccccgccagctccaccacggtcgacaagaagctcgagcccagcggcccgatctccaccatcaacccctgcccgccctgcaaggagtgccacaagtgccccgcccccaacctggagggcgggcccagcgtgttcatcttcccgcccaacatcaaggacgtgctgatgatctccctcacccccaaggtgacctgcgtcgtggtcgacgtgagcgaggacgaccccgacgtccagatcagctggttcgtgaacaacgtggaggtccacacggcccagacccagacccaccgggaggactacaactccaccatccgcgtggtgagcacgctgcccatccagcaccaggactggatgtccgggaaggagttcaagtgcaaggtcaacaacaaggacctgccgagccccatcgagcggaccatctccaagatcaagggcctcgtgcgcgcgccccaggtgtacatcctgcccccgcccgccgagcagctgagccggaaggacgtctccctgacctgcctcgtggtggggttcaaccccggcgacatcagcgtcgagtggacctccaacggccacacggaggagaactacaaggacaccgccccggtgctggacagcgacgggtcctacttcatctacagcaagctcaacatgaagacctccaagtgggagaagaccgacagcttctcctgcaacgtgcgccacgagggcctgaagaactactacctgaagaagacgatcagccggtcccccgggaag

SEQ ID NO: 8484 - RNA, 657 nt, synthetic construct
  misc_feature 1..657: note = derived and/or modified sequence opt1 from Tenatumomab_LightChain1
  source 1..657: mol_type = other RNA
gacatcgtgatgacccaggccgcccccagcgtcccggtgacccccggcgagtccgtgagcatctcctgccgcagctccaagagcctgctccactccaacgggaacacgtacctgtactggttcctgcagcggcccggccagagcccccagctcctgatctaccgcatgtccaacctggcgagcggggtcccggaccggttctccggcagcgggtccggcaccgccttcaccctccgcatcagccgggtggaggccgaggacgtgggcgtctactactgcatgcagcacctggagtaccccctgaccttcggggccggcacgaagctcgagctgaagcgcgccgacgcggcccccaccgtgtccatcttcccgcccagctccgagcagctgaccagcgggggcgcctccgtggtctgcttcctcaacaacttctaccccaaggacatcaacgtgaagtggaagatcgacgggagcgagcggcagaacggcgtgctgaacagctggaccgaccaggactccaaggacagcacgtactccatgagctccaccctgaccctcaccaaggacgagtacgagcgccacaacagctacacgtgcgaggccacccacaagacctccaccagccccatcgtcaagtccttcaaccggaacgagtgc

SEQ ID NO: 8485 - RNA, 1356 nt, synthetic construct
  misc_feature 1..1356: note = derived and/or modified sequence opt1 from Teneliximab_HeavyChain1
  source 1..1356: mol_type = other RNA
cagatccagctggtgcagagcggccccgagctcaagaagccgggggagaccgtccgcatctcctgcaaggccagcggctacgccttcaccacgaccgggatgcagtgggtgcaggagatgcccggcaaggggctgaagtggatcggctggatcaacacccactccggcgtgcccaagtacgtcgaggacttcaaggggcggttcgcgttcagcctggagacctccgccaacacggcctacctccagatcagcaacctgaagaacgaggacaccgccacctacttctgcgtgcgctccggcaacgggaactacgacctggcctacttcgcgtactggggccaggggaccctcgtgacggtcagcgccgcctccaccaagggccccagcgtgttcccgctggccccctccagcaagtccaccagcggcgggaccgcggccctgggctgcctcgtgaaggactacttccccgagcccgtcacggtgtcctggaacagcggggccctgacctccggcgtgcacaccttcccggccgtcctgcagagctccggcctctacagcctgagctccgtggtgaccgtccccagctccagcctggggacgcagacctacatctgcaacgtgaaccacaagccctccaacaccaaggtggacaagaaggtcgagcccaagagctgcgacaagacccacacgtgcccgccctgccccgcccccgagctcctgggcgggccgtccgtgttcctgttcccgcccaagcccaaggacaccctcatgatcagccggacccccgaggtgacctgcgtcgtggtggacgtctcccacgaggaccccgaggtgaagttcaactggtacgtcgacggcgtggaggtgcacaacgcgaagacgaagccccgcgaggagcagtacaacagcacctaccgggtcgtgtccgtgctgaccgtcctgcaccaggactggctcaacgggaaggagtacaagtgcaaggtgagcaacaaggccctgcccgccccgatcgagaagaccatctccaaggccaagggccagccccgcgagccccaggtgtacacgctgcccccgagccgggacgagctcaccaagaaccaggtctccctgacctgcctggtgaagggcttctaccccagcgacatcgccgtggagtgggagtccaacgggcagcccgagaacaactacaagaccacgccgcccgtcctcgacagcgacggctccttcttcctgtacagcaagctgaccgtggacaagagccgctggcagcaggggaacgtgttctcctgcagcgtcatgcacgaggcgctccacaaccactacacccagaagtccctgagcctgtcccccggcaag

SEQ ID NO: 8486 - RNA, 642 nt, synthetic construct
  misc_feature 1..642: note = derived and/or modified sequence opt1 from Teneliximab_LightChain1
  source 1..642: mol_type = other RNA
gacatcgtgctgacccagagccccgccaccctctccgtcacgccgggcgaccgcgtgagcctgtcctgccgggccagccagtccatcagcgactacctgcactggtaccagcagaagtcccacgagagcccccgcctcctgatcaagtacgcgtcccacagcatctccgggatccccagccggttctccggcagcgggtccggcagcgacttcaccctgtccatcaacagcgtggagcccgaggacgtcgggatctactactgccagcacggccactccttcccgtggaccttcggcgggggcaccaagctcgagatcaagcgcacggtggccgcccccagcgtgttcatcttcccgcccagcgacgagcagctgaagtccgggaccgccagcgtcgtgtgcctgctcaacaacttctacccccgggaggccaaggtgcagtggaaggtcgacaacgcgctgcagtccggcaacagccaggagtccgtgaccgagcaggacagcaaggactccacctacagcctgtccagcacgctcaccctgtccaaggccgactacgagaagcacaaggtgtacgcctgcgaggtcacccaccaggggctgagctcccccgtgaccaagagcttcaaccgcggcgagtgc

SEQ ID NO: 8487 - RNA, 1347 nt, synthetic construct
  misc_feature 1..1347: note = derived and/or modified sequence opt1 from Teplizumab_HeavyChain1
  source 1..1347: mol_type = other RNA
caggtgcagctggtccagagcggcgggggcgtggtgcagcccgggcgctccctccggctgagctgcaaggcctccggctacaccttcacccgctacacgatgcactgggtccggcaggcccccgggaagggcctggagtggatcggctacatcaaccccagccgcgggtacaccaactacaaccagaaggtgaaggaccggttcaccatctcccgcgacaacagcaagaacaccgcgttcctccagatggactccctgcggcccgaggacacgggcgtgtacttctgcgcccgctactacgacgaccactactgcctggactactgggggcagggcacccccgtcaccgtgagctccgccagcaccaaggggccgtccgtgttccccctcgcccccagctccaagagcacgtccggcggcaccgccgcgctggggtgcctggtcaaggactacttccccgagccggtgaccgtgagctggaactccggcgccctcaccagcggggtccacacgttccccgccgtgctgcagtccagcggcctgtacagcctctccagcgtggtcaccgtgccctccagctccctgggcacccagacctacatctgcaacgtgaaccacaagcccagcaacacgaaggtcgacaagaaggtggagccgaagtcctgcgacaagacccacacgtgcccgccctgccccgcccccgaggcggccgggggccccagcgtgttcctgttcccgcccaagcccaaggacaccctcatgatctcccggacccccgaggtgacctgcgtcgtggtcgacgtgagccacgaggaccccgaggtcaagttcaactggtacgtggacggggtggaggtccacaacgccaagaccaagccccgcgaggagcagtacaactccacctaccgggtggtgagcgtcctgacggtgctgcaccaggactggctcaacggcaaggagtacaagtgcaaggtgtccaacaaggccctgccggcccccatcgagaagaccatcagcaaggcgaaggggcagccccgcgagccccaggtctacaccctgccgccctcccgggacgagctcaccaagaaccaggtgagcctgacgtgcctggtgaagggcttctacccctccgacatcgccgtcgagtgggagagcaacggccagccggagaacaactacaagaccaccccgcccgtgctcgactccgacgggagcttcttcctgtacagcaagctgaccgtggacaagtcccgctggcagcagggcaacgtcttcagctgctccgtgatgcacgaggccctccacaaccactacacgcagaagtccctgagcctgagccccgggaag

SEQ ID NO: 8488 - RNA, 639 nt, synthetic construct
  misc_feature 1..639: note = derived and/or modified sequence opt1 from Teplizumab_LightChain1
  source 1..639: mol_type = other RNA
gacatccagatgacccagagcccctccagcctgtccgccagcgtgggcgaccgcgtcaccatcacgtgctccgccagctccagcgtgtcctacatgaactggtaccagcagaccccggggaaggcgcccaagcggtggatctacgacaccagcaagctcgcctccggcgtgcccagccgcttctccgggagcggctccgggaccgactacacgttcaccatcagctccctgcagcccgaggacatcgccacctactactgccagcagtggagctccaacccgttcaccttcggccagggcacgaagctgcagatcacccggaccgtcgccgcccccagcgtgttcatcttcccgcccagcgacgagcagctcaagtccgggaccgcgagcgtggtctgcctgctgaacaacttctacccccgcgaggccaaggtgcagtggaaggtggacaacgccctccagtccggcaacagccaggagtccgtcacggagcaggacagcaaggactccacctacagcctgtccagcaccctgaccctctccaaggccgactacgagaagcacaaggtgtacgcgtgcgaggtgacgcaccaggggctgagctcccccgtcaccaagagcttcaaccggggcgagtgc

SEQ ID NO: 8489 - RNA, 1344 nt, synthetic construct
  misc_feature 1..1344: note = derived and/or modified sequence opt1 from Teprotumumab_HeavyChain1
  source 1..1344: mol_type = other RNA
caggtggagctggtcgagagcggcgggggcgtggtgcagcccgggcgctcccagcggctcagctgcgccgcctccggcttcaccttcagctcctacgggatgcactgggtccgccaggcgccgggcaagggcctggagtgggtggccatcatctggttcgacgggagctccacctactacgccgacagcgtgcggggccgcttcacgatctcccgggacaacagcaagaacaccctgtacctccagatgaactccctgcgcgccgaggacaccgccgtctacttctgcgcgcgggagctggggcgccggtacttcgacctctggggccgcgggaccctggtgagcgtgtccagcgcctccacgaagggccccagcgtcttccccctggccccctccagcaagtccaccagcggcgggaccgccgcgctcggctgcctggtgaaggactacttcccggagcccgtgaccgtcagctggaactccggggccctgacgagcggcgtgcacaccttccccgccgtgctccagtccagcggcctgtactccctgagctccgtcgtgaccgtgcccagctccagcctcgggacccagacgtacatctgcaacgtcaaccacaagccgtccaacaccaaggtggacaagaaggtggagcccaagagctgcgacaagacccacacgtgcccgccctgcccggcccccgagctgctgggcgggccctccgtcttcctcttcccgcccaagcccaaggacaccctgatgatcagccggacccccgaggtgacctgcgtggtcgtggacgtctcccacgaggaccccgaggtgaagttcaactggtacgtggacggcgtcgaggtgcacaacgccaagaccaagccgcgcgaggagcagtacaacagcacgtaccgggtggtctccgtgctgaccgtgctccaccaggactggctgaacgggaaggagtacaagtgcaaggtcagcaacaaggcgctgcccgcccccatcgagaagaccatctccaaggccaagggccagccccgcgagccccaggtgtacaccctcccgcccagccgggacgagctgacgaagaaccaggtgagcctgacctgcctcgtcaagggcttctacccctccgacatcgccgtggagtgggagagcaacgggcagcccgagaacaactacaagaccaccccgcccgtgctggactccgacggcagcttcttcctgtactccaagctcacggtcgacaagagccgctggcagcaggggaacgtgttctcctgcagcgtgatgcacgaggccctgcacaaccactacacccagaagtccctgagcctctcccccggcaag

SEQ ID NO: 8490 - RNA, 645 nt, synthetic construct
  misc_feature 1..645: note = derived and/or modified sequence opt1 from Teprotumumab_LightChain1
  source 1..645: mol_type = other RNA
gagatcgtgctgacccagagccccgccaccctctccctgagccccggcgagcgcgccacgctgtcctgccgggcgagccagtccgtcagctcctacctcgcctggtaccagcagaagcccgggcaggcgccccgcctgctgatctacgacgccagcaagcgggccaccggcatccccgcccgcttctccgggagcggctccgggaccgacttcaccctcacgatcagctccctggagccggaggacttcgccgtgtactactgccagcagcggagcaagtggccgccctggaccttcggccagggcaccaaggtggagtccaagcgcaccgtcgccgcccccagcgtgttcatcttcccgccctccgacgagcagctcaagagcgggacggcgtccgtggtctgcctgctgaacaacttctacccccgggaggccaaggtgcagtggaaggtggacaacgccctgcagagcggcaacagccaggagtccgtcaccgagcaggacagcaaggactccacctacagcctctccagcaccctgacgctgtccaaggccgactacgagaagcacaaggtgtacgcctgcgaggtgacccaccaggggctcagctcccccgtcaccaagagcttcaaccgcggcgagtgc

SEQ ID NO: 8491 - RNA, 1338 nt, synthetic construct
  misc_feature 1..1338: note = derived and/or modified sequence opt1 from Tesidolumab_HeavyChain1
  source 1..1338: mol_type = other RNA
gaggtgcagctggtccagagcggcgccgaggtgaagaagcccgggtccagcgtgaaggtctcctgcaaggccagcggcgggaccttctccagctacgcgatctcctgggtgcgccaggccccgggccaggggctcgagtggatgggcggcatcgggcccttcttcggcaccgccaactacgcccagaagttccaggggcgggtgacgatcaccgccgacgagagcacctccaccgcgtacatggagctgagctccctgcgcagcgaggacacggccgtctactactgcgcccgggacaccccctacttcgactactggggccaggggaccctcgtgaccgtgtccagcgcctccacgaagggccccagcgtcttcccgctggcgccctccagcaagtccaccagcggcgggaccgccgccctgggctgcctcgtgaaggactacttccccgagcccgtgaccgtcagctggaactccggggccctgacgagcggcgtgcacaccttcccggccgtgctgcagtccagcggcctctactccctgagctccgtcgtgaccgtgcccagctccagcctggggacccagacgtacatctgcaacgtcaaccacaagccctccaacaccaaggtggacaagcgcgtggagcccaagagctgcgacaagacccacacgtgcccgccctgccccgcgcccgaggccgccggcgggccgtccgtcttcctcttcccgcccaagcccaaggacaccctgatgatcagccggacccccgaggtgacctgcgtggtcgtggacgtctcccacgaggaccccgaggtgaagttcaactggtacgtggacggcgtcgaggtgcacaacgccaagaccaagccccgcgaggagcagtacaacagcacgtaccgggtggtctccgtgctgaccgtgctccaccaggactggctgaacgggaaggagtacaagtgcaaggtcagcaacaaggccctgcccgcgccgatcgagaagaccatctccaaggccaagggccagccccgcgagccccaggtgtacaccctcccgcccagccgggaggagatgacgaagaaccaggtgagcctgacctgcctggtcaagggcttctacccctccgacatcgccgtggagtgggagagcaacgggcagcccgagaacaactacaagaccaccccgcccgtgctcgactccgacggcagcttcttcctgtactccaagctgacggtcgacaagagccgctggcagcaggggaacgtgttctcctgcagcgtgatgcacgaggccctccacaaccactacacccagaagtccctgagcctgtcccccggcaag

SEQ ID NO: 8492 - RNA, 642 nt, synthetic construct
  misc_feature 1..642: note = derived and/or modified sequence opt1 from Tesidolumab_LightChain1
  source 1..642: mol_type = other RNA
agctacgagctgacccagcccctctccgtgagcgtcgccctgggccagaccgcccgcatcacgtgctccggggacagcatcccgaactactacgtgtactggtaccagcagaagcccggccaggcgcccgtgctggtcatctacgacgactccaaccggcccagcgggatcccggagcgcttctccggcagcaactccgggaacaccgccaccctcaccatcagccgggcccaggccggcgacgaggccgactactactgccagtccttcgacagctccctgaacgcggaggtgttcggcgggggcacgaagctgaccgtgctcgggcagcccaaggccgcccccagcgtcaccctgttcccgccctccagcgaggagctgcaggccaacaaggcgaccctcgtgtgcctgatctccgacttctaccccggcgccgtgacggtcgcctggaaggccgacagctcccccgtgaaggccggggtggagaccaccacccccagcaagcagagcaacaacaagtacgcggcctccagctacctgtccctcacgccggagcagtggaagtcccaccgcagctacagctgccaggtcacccacgagggctccaccgtggagaagaccgtggcccccacggagtgcagc

SEQ ID NO: 8493 - RNA, 1344 nt, synthetic construct
  misc_feature 1..1344: note = derived and/or modified sequence opt1 from Tezepelumab_HeavyChain1
  source 1..1344: mol_type = other RNA
cagatgcagctggtggagagcggcgggggcgtcgtgcagcccgggcgctccctccggctgagctgcgccgcctccggcttcaccttccgcacctacgggatgcactgggtgcggcaggcgccgggcaagggcctggagtgggtcgccgtgatctggtacgacgggagcaacaagcactacgccgactccgtgaagggccgcttcacgatcacccgggacaacagcaagaacaccctcaacctgcagatgaactccctgcgcgccgaggacaccgccgtctactactgcgcgcgggcgccccagtgggagctcgtgcacgaggccttcgacatctgggggcagggcacgatggtgaccgtcagctccgccagcaccaaggggccctccgtgttccccctggccccgtgcagccgctccaccagcgagtccacggccgccctgggctgcctcgtgaaggactacttccccgagcccgtcaccgtgagctggaactccggcgccctgaccagcggggtgcacaccttccccgccgtcctgcagtccagcggcctctacagcctgtccagcgtggtgacggtcccgtccagcaacttcgggacccagacctacacgtgcaacgtggaccacaagccctccaacaccaaggtggacaagaccgtcgagcggaagtgctgcgtggagtgcccgccctgccccgcgccgcccgtggccggccccagcgtcttcctgttcccgcccaagcccaaggacaccctcatgatctcccgcacccccgaggtgacgtgcgtcgtggtggacgtcagccacgaggaccccgaggtgcagttcaactggtacgtggacggcgtcgaggtgcacaacgccaagaccaagccccgggaggagcagttcaactccaccttccgcgtggtcagcgtgctgaccgtggtccaccaggactggctgaacgggaaggagtacaagtgcaaggtgtccaacaagggcctccccgcccccatcgagaagacgatcagcaagaccaaggggcagccgcgggagccccaggtgtacaccctgccgccctcccgcgaggagatgaccaagaaccaggtcagcctgacgtgcctcgtgaagggcttctacccctccgacatcgccgtggagtgggagagcaacgggcagcccgagaacaactacaagaccacgcccccgatgctggactccgacggcagcttcttcctgtactccaagctcaccgtcgacaagagccggtggcagcagggcaacgtgttcagctgctccgtgatgcacgaggcgctgcacaaccactacacccagaagtccctgagcctcagccccgggaag

SEQ ID NO: 8494 - RNA, 642 nt, synthetic construct
  misc_feature 1..642: note = derived and/or modified sequence opt1 from Tezepelumab_LightChain1
  source 1..642: mol_type = other RNA
agctacgtgctgacccagcccccgtccgtcagcgtggcccccggccagaccgcccgcatcacgtgcgggggcaacaacctcgggtccaagagcgtgcactggtaccagcagaagcccggccaggcgcccgtcctggtggtgtacgacgactccgaccggccgagctggatccccgagcgcttctccgggagcaactccggcaacaccgccaccctgaccatcagccggggcgaggccggggacgaggccgactactactgccaggtctgggactccagctccgaccacgtggtgttcggcgggggcacgaagctcaccgtcctggggcagcccaaggccgcgcccagcgtgaccctgttcccgccctccagcgaggagctccaggccaacaaggccaccctggtgtgcctgatctccgacttctaccccggcgccgtcacggtggcgtggaaggccgacagctcccccgtgaaggccggcgtcgagaccaccaccccgagcaagcagagcaacaacaagtacgccgcctccagctacctctccctgacgcccgagcagtggaagtcccaccgcagctacagctgccaggtgacccacgaggggtccaccgtggagaagaccgtcgcgcccacggagtgcagc

SEQ ID NO: 8495 - RNA, 1338 nt, synthetic construct
  misc_feature 1..1338: note = derived and/or modified sequence opt1 from ThioMAb-chMA79b-HC(A118C)_HeavyChain
  source 1..1338: mol_type = other RNA
gaggtgcagctgcagcagagcggcgccgagctcatgaagcccggggcctccgtcaagatcagctgcaaggcgaccggctacaccttctccagctactggatcgagtgggtgaagcagcgcccggggcacggcctggagtggatcggggagatcctgcccggcggcggggacacgaactacaacgagatcttcaagggcaaggccaccttcaccgccgacacctccagcaacacggcctacatgcagctctccagcctgacctccgaggacagcgccgtgtactactgcacccggcgcgtccccgtgtacttcgactactgggggcagggcacctccgtgacggtcagctcctgcagcaccaaggggccctccgtgttcccgctggcgcccagctccaagagcacctccggcggcaccgccgccctcgggtgcctggtgaaggactacttccccgagcccgtcacggtgagctggaacagcggcgccctgacctccggggtgcacaccttcccggcggtcctccagagctccggcctgtacagcctgtccagcgtggtgaccgtcccctccagctccctcggcacgcagacctacatctgcaacgtgaaccacaagcccagcaacaccaaggtggacaagaaggtcgagcccaagtcctgcgacaagacccacacgtgcccgccctgccccgcccccgagctgctcgggggcccgagcgtgttcctcttcccgcccaagcccaaggacaccctgatgatctcccggacccccgaggtgacctgcgtcgtggtggacgtcagccacgaggaccccgaggtgaagttcaactggtacgtcgacggggtggaggtgcacaacgccaagacgaagccccgcgaggagcagtacaactccacctaccgggtcgtgagcgtgctgaccgtcctccaccaggactggctgaacggcaaggagtacaagtgcaaggtgtccaacaaggccctgcccgccccgatcgagaagaccatcagcaaggcgaaggggcagccccgcgagccccaggtgtacacgctgcccccgtcccgggaggagatgaccaagaaccaggtcagcctgacctgcctggtgaagggcttctaccccagcgacatcgccgtggagtgggagtccaacggccagcccgagaacaactacaagaccacgccgcccgtcctcgacagcgacgggtccttcttcctgtacagcaagctgaccgtggacaagtcccgctggcagcagggcaacgtgttcagctgctccgtcatgcacgaggccctccacaaccactacacccagaagtccctgagcctgagccccggg

SEQ ID NO: 8496 - RNA, 1347 nt, synthetic construct
  misc_feature 1..1347: note = derived and/or modified sequence opt1 from ThioMab-hu10A8.v1-HC(A118C)_HeavyChain
  source 1..1347: mol_type = other RNA
gaggtgcagctggtcgagagcggcgggggcctcgtgcagcccgggggctccctgcgcctgagctgcgccgcctccgggttcaccttcagctcctacgcggtgagctgggtccggcaggccccgggcaagggcctcgagtgggtggccaccatctccagcgggggctccctgacgttctacctggacagcgtgcgcgggcggttcaccatctcccgcgacaacagcaagaacaccctctacctgcagatgaactccctgcgggccgaggacaccgccgtctactactgcgcgcgccccatccccgactactacgccctcgactactggggccaggggacgctggtgaccgtgagctcctgcagcaccaagggcccctccgtcttcccgctggcccccagctccaagagcaccagcggcgggacggccgcgctcggctgcctggtgaaggactacttccccgagcccgtgaccgtctcctggaacagcggggccctgacctccggcgtgcacaccttcccggccgtgctccagagctccggcctgtacagcctgtccagcgtcgtgacggtgccctccagctccctcgggacccagacctacatctgcaacgtcaaccacaagcccagcaacaccaaggtggacaagaaggtggagcccaagtcctgcgacaagacgcacacgtgcccgccctgccccgcccccgagctgctgggcgggccgagcgtcttcctcttcccgcccaagcccaaggacaccctgatgatctcccggacccccgaggtgacctgcgtggtcgtggacgtcagccacgaggaccccgaggtgaagttcaactggtacgtggacggcgtcgaggtgcacaacgccaagaccaagccccgcgaggagcagtacaactccacctaccgggtggtcagcgtgctgaccgtgctccaccaggactggctgaacgggaaggagtacaagtgcaaggtctccaacaaggcgctgcccgccccgatcgagaagacgatcagcaaggccaagggccagccccgcgagccccaggtgtacaccctcccgcccagccgggaggagatgaccaagaaccaggtgtccctgacctgcctggtcaagggcttctaccccagcgacatcgccgtggagtgggagtccaacgggcagcccgagaacaactacaagacgaccccgcccgtgctcgacagcgacggctccttcttcctgtacagcaagctgaccgtcgacaagtcccgctggcagcaggggaacgtgttcagctgctccgtgatgcacgaggccctccacaaccactacacccagaagtccctgagcctgagccccggcaag

SEQ ID NO: 8497 - RNA, 1347 nt, synthetic construct
  misc_feature 1..1347: note = derived and/or modified sequence opt1 from ThioMab-hu10A8.v1-HC(V205C)_HeavyChain
  source 1..1347: mol_type = other RNA
gaggtgcagctggtcgagagcggcgggggcctcgtgcagcccgggggctccctgcgcctgagctgcgccgcctccgggttcaccttcagctcctacgcggtgagctgggtccggcaggccccgggcaagggcctcgagtgggtggccaccatctccagcgggggctccctgacgttctacctggacagcgtgcgcgggcggttcaccatctcccgcgacaacagcaagaacaccctctacctgcagatgaactccctgcgggccgaggacaccgccgtctactactgcgcgcgccccatccccgactactacgccctcgactactggggccaggggacgctggtgaccgtgagctccgccagcaccaagggcccctccgtcttcccgctggcccccagctccaagagcaccagcggcgggacggcggccctcggctgcctggtgaaggactacttccccgagcccgtgaccgtctcctggaacagcggggccctgacctccggcgtgcacaccttcccggccgtgctccagagctccggcctgtacagcctgtccagcgtcgtgacggtgccctccagctccctcgggacccagacctacatctgcaacgtcaaccacaagcccagcaacaccaaggtggacaagaaggtggagcccaagtcctgcgacaagacgcacacgtgcccgccctgccccgcccccgagctgctgggcgggccgagcgtcttcctcttcccgcccaagcccaaggacaccctgatgatctcccggacccccgaggtgacctgcgtggtcgtggacgtcagccacgaggaccccgaggtgaagttcaactggtacgtggacggcgtcgaggtgcacaacgcgaagaccaagccccgcgaggagcagtacaactccacctaccgggtggtcagcgtgctgaccgtgctccaccaggactggctgaacgggaaggagtacaagtgcaaggtctccaacaaggccctgcccgccccgatcgagaagacgatcagcaaggccaagggccagccccgcgagccccaggtgtacaccctcccgcccagccgggaggagatgaccaagaaccaggtgtccctgacctgcctggtcaagggcttctaccccagcgacatcgccgtggagtgggagtccaacgggcagcccgagaacaactacaagacgaccccgcccgtgctcgacagcgacggctccttcttcctgtacagcaagctgaccgtcgacaagtcccgctggcagcaggggaacgtgttcagctgctccgtgatgcacgaggcgctccacaaccactacacccagaagtccctgagcctgagccccggcaag

SEQ ID NO: 8498 - RNA, 642 nt, synthetic construct
  misc_feature 1..642: note = derived and/or modified sequence opt1 from ThioMab-hu10A8.v1-LC(A118C)_LightChain
  source 1..642: mol_type = other RNA
gacatccagatgacccagagcccctccagcctgtccgccagcgtgggcgaccgcgtcaccatcacgtgcaaggcctcccaggacgtgagcaccgcggtggcctggtaccagcagaagccggggaaggcccccaagctcctgatctactccgccagctaccggtacaccggcgtcccctcccgcttcagcgggtccggcagcgggaccgacttcacgctgaccatctccagcctccagcccgaggacttcgccacctactactgccagcagcacttctccagcccgcggaccttcggccagggcacgaaggtggagatcaagcgcaccgtggcggccccctccgtcttcatcttcccgcccagcgacgagcagctgaagtccgggaccgccagcgtggtgtgcctgctcaacaacttctacccccgggaggccaaggtccagtggaaggtggacaacgcgctgcagagcggcaactcccaggagagcgtgaccgagcaggactccaaggacagcacgtactccctgagctccaccctcaccctgagcaaggccgactacgagaagcacaaggtctacgcctgcgaggtgacccaccaggggctgtccagccccgtgacgaagtccttcaaccgcggcgagtgc

SEQ ID NO: 8499 - RNA, 642 nt, synthetic construct
  misc_feature 1..642: note = derived and/or modified sequence opt1 from ThioMab-hu10A8.v1-LC(V205C)_LightChain
  source 1..642: mol_type = other RNA
gacatccagatgacccagagcccctccagcctgtccgccagcgtgggcgaccgcgtcaccatcacgtgcaaggcctcccaggacgtgagcaccgcggtggcctggtaccagcagaagccggggaaggcccccaagctcctgatctactccgccagctaccggtacaccggcgtcccctcccgcttcagcgggtccggcagcgggaccgacttcacgctgaccatctccagcctccagcccgaggacttcgccacctactactgccagcagcacttctccagcccgcggaccttcggccagggcacgaaggtggagatcaagcgcaccgtggcggccccctccgtcttcatcttcccgcccagcgacgagcagctgaagtccgggaccgccagcgtggtgtgcctgctcaacaacttctacccccgggaggccaaggtccagtggaaggtggacaacgcgctgcagagcggcaactcccaggagagcgtgaccgagcaggactccaaggacagcacgtactccctgagctccaccctcaccctgagcaaggccgactacgagaagcacaaggtctacgcctgcgaggtgacccaccaggggctgtccagcccctgcacgaagtccttcaaccgcggcgagtgc

SEQ ID NO: 8500 - RNA, 1338 nt, synthetic construct
  misc_feature 1..1338: note = derived and/or modified sequence opt1 from ThioMAb-huMA79b.v17-HC(A118C)_HeavyChain
  source 1..1338: mol_type = other RNA
gaggtgcagctggtcgagagcggcgggggcctcgtgcagcccgggggctccctgcgcctgagctgcgccgcctccgggtacaccttcagctcctactggatcgagtgggtgcggcaggcgccgggcaagggcctcgagtggatcggggagatcctgcccggcgggggcgacaccaactacaacgagatcttcaaggggcgcgccacgttcagcgccgacacctccaagaacaccgcctacctgcagatgaacagcctccgggccgaggacaccgcggtctactactgcacgcgccgggtgcccgtgtacttcgactactggggccagggcaccctggtcaccgtgtccagctgctccaccaaggggcccagcgtgttcccgctggccccctccagcaagtccacgagcggcgggaccgccgccctcggctgcctggtcaaggactacttccccgagcccgtgaccgtgtcctggaacagcggcgcgctgacctccggggtccacacgttcccggccgtgctccagagcagcggcctgtactccctgagctccgtggtcaccgtgcccagctccagcctcgggacccagacctacatctgcaacgtgaaccacaagccctccaacacgaaggtcgacaagaaggtggagcccaagagctgcgacaagacccacacgtgcccgccctgccccgcccccgagctgctgggcgggccgtccgtgttcctcttcccgcccaagcccaaggacaccctgatgatcagccgcacccccgaggtgacctgcgtcgtggtcgacgtgtcccacgaggaccccgaggtcaagttcaactggtacgtggacggcgtggaggtccacaacgccaagaccaagccccgggaggagcagtacaacagcacctaccgcgtggtgtccgtcctgacggtgctccaccaggactggctgaacggcaaggagtacaagtgcaaggtgagcaacaaggccctgcccgcgccgatcgagaagaccatctccaaggccaaggggcagccccgggagccccaggtctacaccctgcccccgagccgcgaggagatgaccaagaaccaggtgtccctcacgtgcctggtgaagggcttctaccccagcgacatcgccgtcgagtgggagtccaacgggcagcccgagaacaactacaagaccaccccgcccgtgctcgacagcgacggcagcttcttcctgtactccaagctgaccgtggacaagagccggtggcagcaggggaacgtcttctcctgcagcgtgatgcacgaggccctccacaaccactacacgcagaagtccctgagcctgtcccccggc

SEQ ID NO: 8501 - RNA, 654 nt, synthetic construct
  misc_feature 1..654: note = derived and/or modified sequence opt1 from ThioMAb-huMA79b.v17-HC(A118C)_LightChain
  source 1..654: mol_type = other RNA
gacatccagctgacccagagcccctccagcctctccgccagcgtgggcgaccgcgtcaccatcacgtgcaaggcctcccagagcgtggactacgacggggactccttcctgaactggtaccagcagaagccgggcaaggcgcccaagctgctcatctacgccgccagcaacctggagtccggggtgcccagccggttctccggcagcgggtccggcaccgacttcaccctgaccatcagctccctccagcccgaggacttcgccacgtactactgccagcagagcaacgaggacccgctgaccttcggccaggggaccaaggtcgagatcaagcgcaccgtggccgcgccctccgtgttcatcttcccgcccagcgacgagcagctgaagtccggcacggccagcgtcgtgtgcctcctgaacaacttctacccccgggaggccaaggtgcagtggaaggtcgacaacgccctgcagagcgggaactcccaggagagcgtgaccgagcaggactccaaggacagcacctactccctcagctccaccctgacgctgagcaaggcggactacgagaagcacaaggtgtacgcctgcgaggtcacccaccagggcctctccagccccgtgaccaagtccttcaaccgcggggagtgc

SEQ ID NO: 8502 - RNA, 1338 nt, synthetic construct
  misc_feature 1..1338: note = derived and/or modified sequence opt1 from ThioMAb-huMA79b.v18-HC(A118C)_HeavyChain
  source 1..1338: mol_type = other RNA
gaggtgcagctggtcgagagcggcgggggcctcgtgcagcccgggggctccctgcgcctgagctgcgccgcctccgggtacaccttcagctcctactggatcgagtgggtgcggcaggcgccgggcaagggcctcgagtggatcggggagatcctgcccggcgggggcgacaccaactacaacgagatcttcaaggggcgcgccacgttcagcgccgacacctccaagaacaccgcctacctgcagatgaacagcctccgggccgaggacaccgcggtctactactgcacgcgccgggtgcccatccgcctggactactggggccagggcaccctggtgaccgtctccagctgctccaccaaggggcccagcgtgttcccgctcgccccctccagcaagtccacgagcggcgggaccgccgccctgggctgcctggtgaaggactacttccccgagcccgtcaccgtgtcctggaacagcggcgcgctcacctccggggtgcacacgttcccggccgtcctgcagagcagcggcctgtactccctcagctccgtggtgaccgtccccagctccagcctggggacccagacctacatctgcaacgtgaaccacaagccctccaacacgaaggtggacaagaaggtcgagcccaagagctgcgacaagacccacacgtgcccgccctgccccgcccccgagctgctcggcgggccgtccgtgttcctgttcccgcccaagcccaaggacaccctgatgatcagccggacccccgaggtgacctgcgtcgtggtggacgtctcccacgaggaccccgaggtgaagttcaactggtacgtcgacggcgtggaggtgcacaacgccaagaccaagccccgcgaggagcagtacaacagcacctaccgggtcgtgtccgtgctcacggtcctgcaccaggactggctgaacggcaaggagtacaagtgcaaggtgagcaacaaggccctccccgcgccgatcgagaagaccatctccaaggccaaggggcagccccgcgagccccaggtgtacaccctgcccccgagccgggaggagatgaccaagaaccaggtctccctgacgtgcctcgtgaagggcttctaccccagcgacatcgccgtggagtgggagtccaacgggcagcccgagaacaactacaagaccaccccgcccgtcctggacagcgacggcagcttcttcctgtactccaagctcaccgtggacaagagccgctggcagcaggggaacgtgttctcctgcagcgtcatgcacgaggccctgcacaaccactacacgcagaagtccctgagcctctcccccggc

SEQ ID NO: 8503 - RNA, 654 nt, synthetic construct; identical to SEQ ID NO: 8347
  misc_feature 1..654: note = derived and/or modified sequence opt1 from ThioMAb-huMA79b.v28-HC(A118C)_LightChain
  source 1..654: mol_type = other RNA

SEQ ID NO: 8504 - RNA, 654 nt, synthetic construct
  misc_feature 1..654: note = derived and/or modified sequence opt1 from ThioMAb-huMA79b.v28-LC(V205C)_LightChain
  source 1..654: mol_type = other RNA
gacatcgtgctgacccagagccccgcctccctcgccgtcagcctgggccagcgcgcgaccatctcctgcaaggccagccagtccgtggactacgacggggacagcttcctgaactggtaccagcagaagccgggccagccgcccaagctgttcatctacgccgcctccaacctcgagagcgggatccccgcccggttctccggcagcgggtccggcacggacttcaccctgaacatccaccccgtggaggaggaggacgcggccacctactactgccagcagagcaacgaggaccccctcaccttcggcgccgggacggagctggagctgaagcgcaccgtcgccgcgccctccgtgttcatcttcccgcccagcgacgagcagctcaagtccggcaccgccagcgtggtctgcctgctgaacaacttctacccccgggaggccaaggtgcagtggaaggtggacaacgccctccagtccgggaacagccaggagtccgtcaccgagcaggacagcaaggacagcacgtactccctgagctccaccctgaccctcagcaaggccgactacgagaagcacaaggtgtacgcgtgcgaggtgacccaccagggcctgtccagcccctgcacgaagtccttcaaccgcggggagtgc

SEQ ID NO: 8505 - RNA, 1332 nt, synthetic construct
  misc_feature 1..1332: note = derived and/or modified sequence opt1 from Ticiliuab_HeavyChain1
  source 1..1332: mol_type = other RNA
caggtgcagctggtcgagagcggcgggggcgtggtgcagcccgggcgctccctccggctgagctgcgccgcctccggcttcaccttcagctcctacgggcactgggtccgccaggcgccgggcaagggcctggagtgggtggccgtgatctggtacgacgggagcaacaagtactacgccgactccgtcaagggccggttcaccatcagccgcgacaactccaagaacacgctctacctgcagaacagcctgcgggccgaggacaccgccgtgtactactgcgcgcgcgacccccgcggggccaccctctactactactactacggcgacgtgtgggggcagggcaccacggtcaccgtgtccagcgcctccaccaagggccccagcgtgttccccctggccccgtgctcccggagcacctccgagagcacggcggccctggggtgcctcgtcaaggactacttccccgagcccgtgaccgtgtcctggaacagcggcgccctgaccagcggggtccacaccttccccgccgtgctgcagtccagcggcctctactccctgagctccgtggtcacggtgccgagctccaacttcggcacccagacctacacgtgcaacgtggaccacaagcccagcaacaccaaggtcgacaagaccgtggagcggaagtgctgcgtggagtgcccgccctgccccgccccgcccgtcgcggggccctccgtgttcctgttcccgcccaagcccaaggacaccctcatcagccgcacccccgaggtcacgtgcgtggtggtcgacgtgtcccacgaggaccccgaggtgcagttcaactggtacgtcgacggcgtggaggtgcacaacgccaagaccaagccccgggaggagcagttcaacagcaccttccgcgtcgtgtccgtgctgaccgtcgtgcaccaggactggctgaacgggaaggagtacaagtgcaaggtgagcaacaagggcctccccgcccccatcgagaagacgatctccaagaccaaggggcagccgcgggagccccaggtctacaccctgccgcccagccgcgaggagaccaagaaccaggtgtccctgacgtgcctcgtgaagggcttctaccccagcgacatcgccgtcgagtgggagtccaacggccagcccgagaacaactacaagaccacgcccccgctggacagcgacgggagcttcttcctgtactccaagctcaccgtggacaagagccggtggcagcagggcaacgtgttctcctgcagcgtccacgaggccctgcacaaccactacacccagaagtccctgagcctctcccccgggaag

SEQ ID NO: 8506 - RNA, 639 nt, synthetic construct
  misc_feature 1..639: note = derived and/or modified sequence opt1 from Ticiliuab_LightChain1
  source 1..639: mol_type = other RNA
gacatccagacccagagcccctccagcctgtccgccagcgtgggcgaccgcgtcaccatcacgtgccgggcctcccagagcatcaactcctacctcgactggtaccagcagaagccggggaaggcgcccaagctgctgatctacgccgccagctccctccagagcggcgtgccctcccgcttcagcgggtccggcagcgggaccgacttcaccctgaccatctccagcctgcagcccgaggacttcgccacgtactactgccagcagtactactccaccccgttcaccttcggccccggcaccaaggtggagatcaagcggacggtcgccgcgcccagcgtgttcatcttcccgccctccgacgagcagctcaagagcgggaccgccagcgtggtctgcctgctgaacaacttctacccccgcgaggccaaggtgcagtggaaggtggacaacgccctccagtccggcaacagccaggagtccgtcaccgagcaggacagcaaggactccacctacagcctgtccagcacgctgaccctctccaaggcggactacgagaagcacaaggtgtacgcctgcgaggtgacccaccaggggctgagctcccccgtcaccaagagcttcaaccggggcgagtgc

SEQ ID NO: 8507 - RNA, 1347 nt, synthetic construct
  misc_feature 1..1347: note = derived and/or modified sequence opt1 from Tigatuzumab_HeavyChain1
  source 1..1347: mol_type = other RNA
gaggtgcagctggtcgagagcggcgggggcctcgtgcagcccgggggctccctgcgcctgagctgcgccgcctccgggttcaccttcagctcctacgtgatgagctgggtccggcaggcgccgggcaagggcctcgagtgggtggccaccatctccagcgggggctcctacacgtactaccccgacagcgtgaaggggcgcttcaccatctcccgggacaacgccaagaacaccctgtacctgcagatgaacagcctccgcgccgaggacaccgccgtctactactgcgcgcggcgcggcgactccatgatcacgaccgactactgggggcagggcaccctggtgaccgtgagctccgccagcacgaagggcccctccgtcttccccctggccccgagctccaagagcaccagcgggggcaccgccgcgctcgggtgcctggtgaaggactacttccccgagcccgtgaccgtctcctggaacagcggcgccctgacgtccggcgtgcacaccttccccgccgtgctccagagctccgggctgtacagcctgtccagcgtcgtgaccgtgccgtccagctccctcggcacccagacgtacatctgcaacgtcaaccacaagcccagcaacaccaaggtggacaagcgggtggagcccaagtcctgcgacaagacccacacgtgcccgccctgccccgcccccgagctgctcgggggccccagcgtcttcctgttcccgcccaagcccaaggacaccctgatgatctcccgcacccccgaggtgacctgcgtggtcgtggacgtcagccacgaggacccggaggtgaagttcaactggtacgtggacggggtcgaggtgcacaacgccaagaccaagccccgggaggagcagtacaactccacgtaccgcgtggtcagcgtgctgaccgtgctccaccaggactggctgaacggcaaggagtacaagtgcaaggtctccaacaaggcgctgcccgcccccatcgagaagaccatcagcaaggccaagggccagccgcgggagccccaggtgtacaccctcccgcccagccgcgaggagatgacgaagaaccaggtgtccctgacctgcctggtcaaggggttctaccccagcgacatcgccgtggagtgggagtccaacggccagcccgagaacaactacaagaccacgcccccggtgctcgacagcgacgggtccttcttcctgtacagcaagctgaccgtcgacaagtcccggtggcagcagggcaacgtgttcagctgctccgtgatgcacgaggccctccacaaccactacacccagaagtccctgagcctgagccccgggaag

SEQ ID NO: 8508 - RNA, 1347 nt, synthetic construct; identical to SEQ ID NO: 8507
  misc_feature 1..1347: note = derived and/or modified sequence opt1 from Tigatuzumab_HeavyChain
  source 1..1347: mol_type = other RNA

SEQ ID NO: 8509 - RNA, 639 nt, synthetic construct
  misc_feature 1..639: note = derived and/or modified sequence opt1 from Tigatuzumab_LightChain1
  source 1..639: mol_type = other RNA
gacatccagatgacccagagcccctccagcctgtccgccagcgtgggcgaccgcgtcaccatcacgtgcaaggcctcccaggacgtggggaccgcggtggcctggtaccagcagaagccgggcaaggcccccaagctcctgatctactgggccagcacccggcacaccggggtcccctcccgcttcagcggctccgggagcggcacggacttcaccctgaccatctccagcctccagcccgaggacttcgccacctactactgccagcagtactccagctaccggacgttcggccaggggaccaaggtggagatcaagcgcaccgtggcggccccgtccgtcttcatcttcccgcccagcgacgagcagctgaagtccggcaccgccagcgtggtgtgcctgctcaacaacttctacccccgggaggccaaggtccagtggaaggtggacaacgcgctgcagtccgggaacagccaggagagcgtgacggagcaggactccaaggacagcacctactccctgagctccaccctcaccctgagcaaggccgactacgagaagcacaaggtctacgcctgcgaggtgacgcaccagggcctgtccagccccgtgaccaagtccttcaaccgcggggagtgc

SEQ ID NO: 8510 - RNA, 639 nt, synthetic construct; identical to SEQ ID NO: 8509
  misc_feature 1..639: note = derived and/or modified sequence opt1 from Tigatuzumab_LightChain
  source 1..639: mol_type = other RNA

SEQ ID NO: 8511 - RNA, 1338 nt, synthetic construct
  misc_feature 1..1338: note = derived and/or modified sequence opt1 from Tildrakizumab_HeavyChain1
  source 1..1338: mol_type = other RNA
caggtgcagctggtccagagcggcgccgaggtgaagaagcccggggcctccgtgaaggtcagctgcaaggcgtccggctacatcttcatcacctactggatgacctgggtgcgccaggccccggggcagggcctcgagtggatggggcagatcttccccgccagcggctccgccgactacaacgagaagttcgagggccgggtgacgatgaccaccgacaccagcacgtccaccgcctacatggagctgcgcagcctgcggtccgacgacaccgcggtctactactgcgcccgcgggggcgggggcttcgcctactgggggcagggcaccctcgtgacggtgagctccgccagcaccaagggcccctccgtcttccccctggcgccgagctccaagagcacctccgggggcaccgccgccctggggtgcctcgtgaaggactacttccccgagcccgtgacggtcagctggaactccggcgccctgaccagcggcgtgcacaccttccccgccgtgctgcagagctccgggctctacagcctgtccagcgtcgtgaccgtgccgtccagctccctgggcacgcagacctacatctgcaacgtcaaccacaagcccagcaacaccaaggtggacaagaaggtggagcccaagtcctgcgacaagacccacacgtgcccgccctgccccgcgcccgagctcctcgggggccccagcgtcttcctgttcccgcccaagcccaaggacaccctgatgatctcccggacccccgaggtgacctgcgtggtcgtggacgtcagccacgaggacccggaggtgaagttcaactggtacgtggacggggtcgaggtgcacaacgccaagacgaagccccgcgaggagcagtacaactccacctaccgggtggtcagcgtgctgaccgtgctgcaccaggactggctcaacggcaaggagtacaagtgcaaggtctccaacaaggccctgcccgcccccatcgagaagaccatcagcaaggccaagggccagccgcgcgagccccaggtgtacacgctgccgccctcccgggacgagctcaccaagaaccaggtgagcctgacctgcctggtcaaggggttctacccctccgacatcgcggtggagtgggagagcaacggccagcccgagaacaactacaagaccacgcccccggtgctcgacagcgacgggtccttcttcctgtacagcaagctgaccgtcgacaagtcccgctggcagcagggcaacgtgttcagctgctccgtgatgcacgaggccctccacaaccactacacccagaagtccctgagcctgagccccgggaag

SEQ ID NO: 8512 - RNA, 642 nt, synthetic construct
  misc_feature 1..642: note = derived and/or modified sequence opt1 from Tildrakizumab_LightChain1
  source 1..642: mol_type = other RNA
gacatccagatgacccagagcccctccagcctgtccgccagcgtgggcgaccgggtcaccatcacgtgccggacctccgagaacatctacagctacctcgcctggtaccagcagaagccggggaaggcgcccaagctgctgatctacaacgccaagaccctcgccgagggcgtgccctcccgcttcagcgggtccggcagcgggaccgacttcacgctgaccatctccagcctgcagcccgaggacttcgccacctactactgccagcaccactacggcatcccgttcaccttcggccaggggacgaaggtggagatcaagcggaccgtcgccgcgccctccgtgttcatcttcccgcccagcgacgagcagctcaagtccggcaccgccagcgtggtctgcctgctgaacaacttctacccccgcgaggccaaggtgcagtggaaggtggacaacgccctccagtccgggaacagccaggagtccgtcaccgagcaggacagcaaggacagcacgtactccctgagctccaccctgaccctcagcaaggcggactacgagaagcacaaggtgtacgcctgcgaggtgacccaccagggcctgtccagccccgtcacgaagtccttcaaccgcggggagtgc

SEQ ID NO: 8513 - RNA, 1344 nt, synthetic construct
  misc_feature 1..1344: note = derived and/or modified sequence opt1 from Tisotumab_vedotin_HeavyChain1
  source 1..1344: mol_type = other RNA
gaggtgcagctgctcgagagcggcgggggcctggtccagcccgggggctccctgcgcctcagctgcgccgcctccgggttcaccttcagcaactacgcgatgtcctgggtgcggcaggccccgggcaagggcctggagtgggtgagctccatcagcgggtccggcgactacacctactacaccgacagcgtcaaggggcgcttcaccatctcccgggacaacagcaagaacaccctgtacctccagatgaactccctgcgcgccgaggacaccgccgtgtactactgcgcccggagcccctggggctactacctggactcctgggggcagggcacgctcgtgaccgtcagctccgcgagcaccaagggcccctccgtgttccccctggccccgagcagcaagtccaccagcgggggcacggccgccctggggtgcctcgtgaaggactacttccccgagcccgtcaccgtgtcctggaacagcggcgcgctgacctccggcgtgcacaccttccccgccgtcctgcagagctccgggctctacagcctgtccagcgtggtgacggtcccgtccagctccctgggcacccagacctacatctgcaacgtgaaccacaagcccagcaacaccaaggtggacaagcgcgtcgagcccaagtcctgcgacaagacgcacacgtgcccgccctgccccgcccccgagctcctcgggggccccagcgtgttcctgttcccgcccaagcccaaggacaccctcatgatctcccggacccccgaggtgacctgcgtcgtggtggacgtcagccacgaggacccggaggtgaagttcaactggtacgtcgacggggtggaggtgcacaacgccaagaccaagccccgcgaggagcagtacaactccacctaccgggtcgtgagcgtgctgaccgtcctgcaccaggactggctcaacggcaaggagtacaagtgcaaggtgagcaacaaggccctgcccgcgcccatcgagaagacgatctccaaggccaagggccagccgcgcgagccccaggtgtacaccctgccgcccagccgggaggagatgaccaagaaccaggtctccctgacctgcctggtgaaggggttctaccccagcgacatcgccgtggagtgggagtccaacggccagcccgagaacaactacaagacgacgcccccggtcctggacagcgacgggtccttcttcctctacagcaagctgaccgtggacaagtcccgctggcagcagggcaacgtgttcagctgctccgtcatgcacgaggccctgcacaaccactacacccagaagtccctcagcctgagccccgggaag

SEQ ID NO: 8514 - RNA, 642 nt, synthetic construct
  misc_feature 1..642: note = derived and/or modified sequence opt1 from Tisotumab_vedotin_LightChain1
  source 1..642: mol_type = other RNA
gacatccagatgacccagagcccgccctccctgagcgcctccgccggcgaccgcgtgaccatcacgtgccgggcgagccaggggatctccagccgcctcgcctggtaccagcagaagcccgagaaggcccccaagtccctgatctacgccgccagctccctgcagagcggcgtcccctcccggttcagcgggtccggcagcgggaccgacttcaccctcaccatctccagcctgcagccggaggacttcgcgacgtactactgccagcagtacaactcctacccctacaccttcggccagggcaccaagctggagatcaagcgcaccgtggccgcccccagcgtgttcatcttcccgccctccgacgagcagctcaagagcgggacggccagcgtcgtgtgcctgctgaacaacttctacccccgggaggcgaaggtgcagtggaaggtcgacaacgccctccagtccggcaacagccaggagtccgtgaccgagcaggacagcaaggactccacctacagcctgtccagcaccctgacgctctccaaggccgactacgagaagcacaaggtgtacgcctgcgaggtcacccaccaggggctgagctcccccgtgaccaagagcttcaaccgcggcgagtgc

SEQ ID NO: 8515 - RNA, 1341 nt, synthetic construct
  misc_feature 1..1341: note = derived and/or modified sequence opt1 from Tocilizumab_HeavyChain1
  source 1..1341: mol_type = other RNA
gtgcagctgcaggagagcggccccgggctcgtccgcccctcccagaccctgagcctgacctgcacggtgtccggctacagcatcacctccgaccacgcctggagctgggtgcggcagccgcccgggcgcggcctcgagtggatcgggtacatctcctacagcggcatcaccacctacaacccctccctcaagagccgggtcacgatgctgcgcgacacctccaagaaccagttcagcctgcggctgtccagcgtgaccgccgcggacaccgccgtgtactactgcgcccgctccctggcccggacgaccgccatggactactggggccaggggagcctcgtcaccgtgtccagcgcgtccaccaagggcccgagcgtgttccccctggcccccagctccaagagcacgtccgggggcaccgccgccctggggtgcctcgtcaaggactacttccccgagccggtgaccgtgagctggaactccggcgcgctgaccagcggcgtccacacgttccccgccgtgctgcagtccagcgggctctactccctgagctccgtggtcaccgtgcccagctccagcctgggcacccagacctacatctgcaacgtgaaccacaagccctccaacacgaaggtcgacaagaaggtggagcccaagagctgcgacaagacccacacgtgcccgccctgccccgcccccgagctcctcgggggcccctccgtgttcctgttcccgcccaagcccaaggacaccctgatgatcagccgcacccccgaggtgacctgcgtcgtggtcgacgtgtcccacgaggaccccgaggtcaagttcaactggtacgtggacggcgtggaggtccacaacgccaagaccaagccccgggaggagcagtacaacagcacctaccgcgtggtgagcgtcctgacggtgctgcaccaggactggctcaacgggaaggagtacaagtgcaaggtgtccaacaaggccctgccggcgcccatcgagaagaccatcagcaaggccaagggccagccccgggagccccaggtctacaccctgccgccctcccgcgacgagctcaccaagaaccaggtgagcctgacgtgcctggtgaaggggttctacccctccgacatcgccgtcgagtgggagagcaacggccagccggagaacaactacaagaccaccccgcccgtgctcgactccgacgggagcttcttcctgtactccaagctgaccgtggacaagagccggtggcagcagggcaacgtcttctcctgcagcgtgatgcacgaggccctccacaaccactacacgcagaagtccctgagcctgtcccccggc

SEQ ID NO: 8516 - RNA, 642 nt, synthetic construct
  misc_feature 1..642: note = derived and/or modified sequence opt1 from Tocilizumab_LightChain1
  source 1..642: mol_type = other RNA
gacatccagatgacgcagagcccctccagcctgtccgccagcgtgggcgaccgcgtcaccatcacgtgccgggcctcccaggacatcagctcctacctcaactggtaccagcagaagccggggaaggcgcccaagctgctgatctactacaccagccgcctccactccggcgtgcccagccggttctccgggagcggctccgggaccgacttcaccttcacgatcagctccctgcagcccgaggacatcgccacctactactgccagcagggcaacaccctgccgtacaccttcggccaggggacgaaggtggagatcaagcgcaccgtcgccgcccccagcgtgttcatcttcccgccctccgacgagcagctcaagagcggcaccgcctccgtggtctgcctgctgaacaacttctacccccgggaggcgaaggtgcagtggaaggtggacaacgccctccagagcgggaacagccaggagtccgtcaccgagcaggacagcaaggactccacgtacagcctgtccagcaccctgaccctctccaaggccgactacgagaagcacaaggtgtacgcctgcgaggtgacccaccagggcctgagctcccccgtcaccaagagcttcaaccgcggggagtgc

SEQ ID NO: 8517 - RNA, 1353 nt, synthetic construct
  misc_feature 1..1353: note = derived and/or modified sequence opt1 from Tosatoxumab_HeavyChain1
  source 1..1353: mol_type = other RNA
gaggtgcagatggtccagagcggcgccgaggtgaagaagcccggggagcccctgaagatctcctgcaagggcagcgggtacaagttcggcacccactggatcgggtgggtgcgccagcggcccggcaagggcctcgagtggatggggatcatccaccccgccgactccgagaccaagtacagcccctccttccagggccaggtcagcttctccgcggacaagagctccaacacggcctacctgcactggagcaccctgcgcgcctccgacaccgccatgtactactgcgcccggcgcagcgggtccagctcctggtacgcgctcgacttctggggccaggggaccatggtgacggtgagctccgccagcaccaagggcccgtccgtcttccccctggcccccagcagcaagtccaccagcggcgggaccgccgcgctgggctgcctcgtgaaggactacttccccgagccggtgacggtctcctggaacagcggggccctgacctccggcgtgcacaccttccccgccgtgctgcagagctccggcctctacagcctgtccagcgtcgtgaccgtgccctccagctccctggggacgcagacctacatctgcaacgtcaaccacaagcccagcaacaccaaggtggacaagcgggtggagccgaagtcctgcgacaagacccacacgtgcccgccctgccccgcccccgagctcctgggcgggcccagcgtcttcctgttcccgcccaagcccaaggacaccctcatgatctcccgcacccccgaggtgacctgcgtggtcgtggacgtgagccacgaggaccccgaggtcaagttcaactggtacgtggacggcgtcgaggtgcacaacgccaagacgaagccccgggaggagcagtacaactccacctaccgcgtggtcagcgtgctgaccgtgctgcaccaggactggctcaacgggaaggagtacaagtgcaaggtcagcaacaaggcgctgccggcccccatcgagaagaccatctccaaggccaagggccagccccgggagccccaggtgtacacgctgccgcccagccgcgaggagatgaccaagaaccaggtgtccctgacctgcctcgtcaagggcttctaccccagcgacatcgccgtggagtgggagtccaacgggcagccggagaacaactacaagaccacgccgcccgtgctggacagcgacggctccttcttcctctacagcaagctgaccgtcgacaagtcccggtggcagcaggggaacgtgttcagctgctccgtgatgcacgaggccctgcacaaccactacacccagaagtccctcagcctgagccccggcaag

SEQ ID NO: 8518 - RNA, 651 nt, synthetic construct
  misc_feature 1..651: note = derived and/or modified sequence opt1 from Tosatoxumab_LightChain1
  source 1..651: mol_type = other RNA
cagagcgtgctgacccagtcccccagcgcctccggcaccccggggcagcgcgtcacgatcagctgctccggcgggagctccaacatcggcagcaacaccgtgaactggtaccagcagttccccggggccgcgcccaagctcctgatctacaccaacaaccagcggccctccggcgtgccggaccgcttcagcggctccaagagcgggacctccgccagcctggccatctccggcctccagagcgaggacgaggccgactactactgcgccacgtgggacgactccctgaacgggctgtacgtcttcggcaccgggaccaaggtgaccgtgctcggccagcccaaggcgaaccccacggtcaccctgttcccgcccagctccgaggagctgcaggccaacaaggccaccctcgtgtgcctgatcagcgacttctaccccggcgccgtgaccgtcgcgtggaaggccgacgggagccccgtgaaggccggcgtggagacgaccaagccctccaagcagagcaacaacaagtacgccgcctccagctacctgtccctcaccccggagcagtggaagtcccaccggagctacagctgccaggtcacccacgaggggtccacggtggagaagaccgtggcgcccaccgagtgcagc

SEQ ID NO: 8519 - RNA, 1341 nt, synthetic construct
  misc_feature 1..1341: note = derived and/or modified sequence opt1 from Tositumomab_HeavyChain
  source 1..1341: mol_type = other RNA
caggcctacctgcagcagagcggcgccgagctcgtgcgccccggggcgtccgtcaagatgagctgcaaggcctccggctacaccttcaccagctacaacatgcactgggtgaagcagacgccgcggcaggggctggagtggatcggcgccatctaccccgggaacggcgacacctcctacaaccagaagttcaagggcaaggccaccctgaccgtggacaagagctccagcacggcctacatgcagctctccagcctgacctccgaggacagcgcggtctacttctgcgcccgcgtggtgtactactccaacagctactggtacttcgacgtctgggggaccggcaccacggtgaccgtgtccgggcccagcgtcttccccctggccccgtccagcaagtccaccagcggcgggaccgccgcgctcggctgcctggtgaaggactacttccccgagcccgtgacggtcagctggaactccggcgccctgaccagcggggtgcacaccttccccgccgtgctccagtccagcggcctgtactccctgagctccgtcgtgaccgtgccgagctccagcctcgggacgcagacctacatctgcaacgtcaaccacaagccctccaacaccaaggtggacaagaaggccgagcccaagagctgcgacaagacccacacgtgcccgccctgccccgcccccgagctgctgggcggcccctccgtgttcctcttcccgcccaagcccaaggacaccctgatgatcagccggacccccgaggtgacctgcgtcgtggtcgacgtgtcccacgaggacccggaggtcaagttcaactggtacgtggacggggtggaggtccacaacgcgaagacgaagccccgcgaggagcagtacaacagcacctaccgggtggtgtccgtcctgaccgtgctccaccaggactggctgaacggcaaggagtacaagtgcaaggtgagcaacaaggccctgcccgcccccatcgagaagaccatctccaaggccaaggggcagccgcgcgagccccaggtctacacgctcccgcccagccgggacgagctgaccaagaaccaggtgagcctgacctgcctcgtgaagggcttctacccctccgacatcgccgtcgagtgggagagcaacgggcagcccgagaacaactacaagaccacgcccccggtgctggactccgacggcagcttcttcctgtactccaagctcaccgtggacaagagccgctggcagcagggcaacgtcttctcctgcagcgtgatgcacgaggcgctgcacaaccactacacccagaagtccctgagcctctcccccgggaag

SEQ ID NO: 8520 - RNA, 630 nt, synthetic construct
  misc_feature 1..630: note = derived and/or modified sequence opt1 from Tositumomab_LightChain
  source 1..630: mol_type = other RNA
cagatcgtgctgagccagtcccccgccatcctcagcgcctccccgggcgagaaggtcaccatgacctgccgcgcgagctccagcgtgtcctacatgcactggtaccagcagaagcccgggagctcccccaagccctggatctacgccccgagcaacctggcctccggcgtgcccgcccggttcagcgggtccggcagcgggacgtcctacagcctgaccatctcccgcgtcgaggccgaggacgcggccacctactactgccagcagtggagcttcaacccgcccaccttcggcgccggcacgaagctcgagctgaagcggaccgtggccgcgccctccgtgttcatcttcccgcccagcgacgagcagctcaagagcgggaccgcctccgtcgtgtgcctgctgaacaacttctacccccgcgaggccaaggtgcagtggaaggtcgacaacgccctgcagagcggcaactcccaggagagcgtgaccgagcaggactccaaggacagcacgtactccctcagctccaccctgaccctgagcaaggccgactacgagaagcacaaggtgtacgcgtgcgaggtcacccaccaggggctctccagccccgtgacgaagtccttcaaccgg

SEQ ID NO: 8521 - RNA, 1338 nt, synthetic construct
  misc_feature 1..1338: note = derived and/or modified sequence opt1 from Tovetumab_HeavyChain1
  source 1..1338: mol_type = other RNA
caggtgcagctggtcgagagcggcgggggcctcgtgaagcccgggggctccctgcgcctgagctgcgccgcctccgggttcaccttcagcgactactacatgaactggatccggcaggcgccgggcaagggcctcgagtgggtgtcctacatcagctccagcgggtccatcatctactacgccgacagcgtcaagggccgcttcaccatctcccgggacaacgccaagaacagcctgtacctgcagatgaactccctccgcgccgaggacacggccgtgtactactgcgcgcgggaggggcgcatcgccgcccggggcatggacgtgtgggggcagggcaccaccgtcaccgtgagctccgccagcacgaagggcccctccgtgttccccctggcgccctgcagccgctccaccagcgagagcaccgccgccctggggtgcctcgtcaaggactacttcccggagcccgtgaccgtgtcctggaacagcggcgccctgacgtccggggtccacaccttccccgccgtgctgcagagctccggcctctacagcctgtccagcgtggtcaccgtgccctccagcaacttcggcacccagacgtacacgtgcaacgtggaccacaagccgtccaacaccaaggtcgacaagaccgtggagcggaagtgctgcgtggagtgcccgccctgccccgcgccgcccgtcgccgggcccagcgtgttcctgttcccgcccaagcccaaggacaccctcatgatctcccgcacccccgaggtgacctgcgtcgtggtcgacgtgagccacgaggaccccgaggtgcagttcaactggtacgtcgacggcgtggaggtgcacaacgccaagaccaagccccgggaggagcagttcaactccacgttccgcgtcgtgagcgtgctgaccgtcgtgcaccaggactggctgaacgggaaggagtacaagtgcaaggtgtccaacaagggcctccccgcccccatcgagaagaccatcagcaagaccaaggggcagccccgggagccgcaggtctacacgctgccgccctcccgcgaggagatgaccaagaaccaggtgagcctgacctgcctcgtgaagggcttctaccccagcgacatcgccgtcgagtgggagtccaacggccagcccgagaacaactacaagaccacgccgcccatgctggacagcgacgggtccttcttcctgtacagcaagctcaccgtggacaagtcccggtggcagcagggcaacgtgttcagctgctccgtcatgcacgaggcgctgcacaaccactacacccagaagtccctgagcctcagccccgggaag

SEQ ID NO: 8522 - RNA, 645 nt, synthetic construct
  misc_feature 1..645: note = derived and/or modified sequence opt1 from Tovetumab_LightChain1
  source 1..645: mol_type = other RNA
gacatccagatgacccagagcccctccagcctgtccgccagcgtgggcgaccgggtctccatcacgtgccggcccagccagtccttcagccgctacatcaactggtaccagcagaagcccgggaaggcccccaagctcctgatccacgcggcctccagcctggtgggcggggtgccctcccggttcagcggctccgggagcggcaccgacttcaccctcaccatctccagcctgcagccggaggacttcgccacctactactgccagcagacgtactccaacccgcccatcaccttcggccaggggacccgcctggagatgaagcggaccgtcgccgcccccagcgtgttcatcttcccgccctccgacgagcagctcaagagcggcacggcgagcgtggtctgcctgctgaacaacttctacccccgcgaggccaaggtgcagtggaaggtggacaacgccctccagtccgggaacagccaggagtccgtcaccgagcaggacagcaaggactccacctacagcctgtccagcaccctgacgctctccaaggccgactacgagaagcacaaggtgtacgcgtgcgaggtgacccaccagggcctgagctcccccgtcaccaagagcttcaaccgcggggagtgc

SEQ ID NO: 8523 - RNA, 1347 nt, synthetic construct
  misc_feature 1..1347: note = derived and/or modified sequence opt1 from Tralokinumab_HeavyChain1
  source 1..1347: mol_type = other RNA
caggtgcagctggtccagagcggcgccgaggtgaagaagcccggggcctccgtgaaggtcagctgcaaggcgtccggctacaccttcaccaactacgggctcagctgggtgcgccaggccccgggccaggggctggagtggatgggctggatctccgccaacaacggcgacacgaactacgggcaggagttccagggccgggtgaccatgaccaccgacacgagcacctccaccgcctacatggagctgcgcagcctccggtccgacgacaccgccgtctactactgcgcgcgcgacagctccagctcctgggcccggtggttcttcgacctgtgggggcgcggcacgctggtgaccgtgagctccgccagcaccaaggggccctccgtcttccccctcgccccctgcagccggtccaccagcgagagcacggcggccctgggctgcctggtgaaggactacttcccggagcccgtgaccgtctcctggaacagcggcgccctcacctccggggtgcacaccttccccgccgtgctgcagagctccggcctgtacagcctctccagcgtcgtgacggtgccctccagctccctggggaccaagacctacacgtgcaacgtcgaccacaagccgagcaacaccaaggtggacaagcgcgtggagtccaagtacggcccgccctgccccagctgccccgcccccgagttcctgggcgggccctccgtcttcctcttcccgcccaagcccaaggacaccctgatgatcagccggacccccgaggtgacctgcgtggtcgtggacgtctcccaggaggaccccgaggtgcagttcaactggtacgtggacggcgtcgaggtgcacaacgcgaagacgaagccgcgcgaggagcagttcaacagcacctaccgggtggtctccgtgctgaccgtgctccaccaggactggctgaacgggaaggagtacaagtgcaaggtcagcaacaagggcctgcccagctccatcgagaagaccatcagcaaggccaaggggcagccccgcgagccccaggtgtacacgctcccgccctcccaggaggagatgaccaagaaccaggtgagcctgacctgcctggtcaagggcttctacccctccgacatcgccgtggagtgggagagcaacggccagcccgagaacaactacaagaccacgccgcccgtgctcgactccgacgggagcttcttcctgtactcccggctgaccgtcgacaagagccgctggcaggagggcaacgtgttctcctgcagcgtgatgcacgaggccctccacaaccactacacccagaagtccctgagcctgtccctcgggaag

SEQ ID NO: 8524 - RNA, 642 nt, synthetic construct
  misc_feature 1..642: note = derived and/or modified sequence opt1 from Tralokinumab_LightChain1
  source 1..642: mol_type = other RNA
agctacgtgctgacccagcccccgtccgtcagcgtggcccccggcaagaccgcccgcatcacgtgcgggggcaacatcatcgggtccaagctcgtgcactggtaccagcagaagcccggccaggcgcccgtcctggtgatctacgacgacggggaccggccgagcggcatccccgagcgcttctccggcagcaactccgggaacaccgccaccctgaccatcagccgggtggaggccggcgacgaggccgactactactgccaggtctgggacacggggtccgaccccgtggtgttcggcgggggcaccaagctcaccgtcctgggccagcccaaggccgcgccgagcgtgaccctgttcccgccctccagcgaggagctccaggccaacaaggccacgctggtgtgcctgatctccgacttctaccccggggccgtcaccgtggcgtggaaggccgacagctcccccgtgaaggccggcgtcgagaccaccacgcccagcaagcagtccaacaacaagtacgccgccagctcctacctcagcctgacccccgagcagtggaagtcccaccgcagctacagctgccaggtgacccacgaggggtccaccgtggagaagacggtcgcgcccaccgagtgcagc

SEQ ID NO: 8525 - RNA, 1332 nt, synthetic construct
  misc_feature 1..1332: note = derived and/or modified sequence opt1 from Trastuzuab_HeavyChain1
  source 1..1332: mol_type = other RNA
gaggtgcagctggtcgagagcggcgggggcctcgtgcagcccgggggctccctgcgcctgagctgcgccgcctccgggttcaacatcaaggacacctacatccactgggtgcggcaggcgccgggcaagggcctcgagtgggtcgcccgcatctaccccaccaacgggtacacgcggtacgccgacagcgtgaagggccgcttcaccatctccgccgacaccagcaagaacaccgcctacctgcagaactccctgcgggcggaggacacggccgtgtactactgcagccgctggggcggggacgggttctacgccgactactggggccagggcaccctcgtcaccgtgtccagcgcctccaccaaggggcccagcgtgttccccctggcgccgtccagcaagtccacgagcggcgggaccgccgccctgggctgcctcgtcaaggactacttccccgagcccgtgaccgtgtcctggaacagcggcgccctgacctccggggtccacacgttccccgccgtgctgcagagcagcggcctctactccctgagctccgtggtcaccgtgccgagctccagcctggggacccagacctacatctgcaacgtgaaccacaagccctccaacacgaaggtcgacaagaaggtggagcccaagagctgcgacaagacccacacgtgcccgccctgccccgcgcccgagctcctgggcgggccctccgtgttcctgttcccgcccaagcccaaggacaccctcatcagccggacccccgaggtgacctgcgtcgtggtcgacgtgtcccacgaggacccggaggtcaagttcaactggtacgtggacggcgtggaggtccacaacgccaagaccaagccccgcgaggagcagtacaacagcacctaccgggtggtgtccgtcctgacggtgctgcaccaggactggctcaacggcaaggagtacaagtgcaaggtgagcaacaaggccctgcccgcccccatcgagaagaccatctccaaggccaaggggcagccgcgcgagccccaggtctacaccctgccgcccagccgggaggagaccaagaaccaggtgtccctcacgtgcctggtgaagggcttctaccccagcgacatcgcggtcgagtgggagtccaacgggcagcccgagaacaactacaagaccacgcccccggtgctggacagcgacggcagcttcttcctctactccaagctgaccgtggacaagagccgctggcagcaggggaacgtcttctcctgcagcgtgcacgaggccctgcacaaccactacacccagaagtccctcagcctgtcccccggc

SEQ ID NO: 8526 - RNA, 639 nt, synthetic construct
  misc_feature 1..639: note = derived and/or modified sequence opt1 from Trastuzuab_LightChain1
  source 1..639: mol_type = other RNA
gacatccagacccagagcccctccagcctgtccgccagcgtgggcgaccgcgtcaccatcacgtgccgggcctcccaggacgtgaacaccgcggtggcctggtaccagcagaagccggggaaggcccccaagctcctgatctacagcgcctccttcctgtacagcggcgtcccctcccgcttcagcgggtcccggagcggcaccgacttcaccctcacgatctccagcctgcagcccgaggacttcgccacctactactgccagcagcactacaccaccccgcccacgttcgggcagggcaccaaggtggagatcaagcgcaccgtggcggccccctccgtcttcatcttcccgcccagcgacgagcagctgaagtccggcaccgccagcgtggtgtgcctcctgaacaacttctacccccgggaggccaaggtccagtggaaggtggacaacgcgctgcagtccgggaacagccaggagagcgtgacggagcaggactccaaggacagcacctactccctcagctccaccctgaccctgagcaaggccgactacgagaagcacaaggtctacgcctgcgaggtgacgcaccagggcctctccagccccgtgaccaagtccttcaaccgcggggagtgc

SEQ ID NO: 8527 - RNA, 1347 nt, synthetic construct
  misc_feature 1..1347: note = derived and/or modified sequence opt1 from Trastuzumab_emtansine_HeavyChain1
  source 1..1347: mol_type = other RNA
gaggtgcagctggtcgagagcggcgggggcctcgtgcagcccgggggctccctgcgcctgagctgcgccgcctccgggttcaacatcaaggacacctacatccactgggtgcggcaggcgccgggcaagggcctcgagtgggtcgcccgcatctaccccaccaacgggtacacgcggtacgccgacagcgtgaagggccgcttcaccatctccgccgacaccagcaagaacaccgcctacctgcagatgaactccctgcgggcggaggacacggccgtgtactactgcagccgctggggcggggacgggttctacgccatggactactggggccagggcaccctcgtcaccgtgtccagcgcctccaccaaggggcccagcgtgttccccctggcgccgtccagcaagtccacgagcggcgggaccgccgccctgggctgcctcgtcaaggactacttccccgagcccgtgaccgtgtcctggaacagcggcgccctgacctccggggtccacacgttccccgccgtgctgcagagcagcggcctctactccctgagctccgtggtcaccgtgccgagctccagcctggggacccagacctacatctgcaacgtgaaccacaagccctccaacacgaaggtcgacaagaaggtggagcccaagagctgcgacaagacccacacgtgcccgccctgccccgcgcccgagctcctgggcgggccctccgtgttcctgttcccgcccaagcccaaggacaccctcatgatcagccggacccccgaggtgacctgcgtcgtggtcgacgtgtcccacgaggacccggaggtcaagttcaactggtacgtggacggcgtggaggtccacaacgccaagaccaagccccgcgaggagcagtacaacagcacctaccgggtggtgtccgtcctgacggtgctgcaccaggactggctcaacggcaaggagtacaagtgcaaggtgagcaacaaggccctgcccgcccccatcgagaagaccatctccaaggccaaggggcagccgcgcgagccccaggtctacaccctgccgcccagccgggaggagatgaccaagaaccaggtgtccctcacgtgcctggtgaagggcttctaccccagcgacatcgcggtcgagtgggagtccaacgggcagcccgagaacaactacaagaccacgcccccggtgctggacagcgacggcagcttcttcctctactccaagctgaccgtggacaagagccgctggcagcaggggaacgtcttctcctgcagcgtgatgcacgaggccctgcacaaccactacacccagaagtccctcagcctgtcccccggc

SEQ ID NO: 8528 - RNA, 642 nt, synthetic construct; identical to SEQ ID NO: 8384
  misc_feature 1..642: note = derived and/or modified sequence opt1 from Trastuzumab_emtansine_LightChain1
  source 1..642: mol_type = other RNA

SEQ ID NO: 8529 - RNA, 1347 nt, synthetic construct; identical to SEQ ID NO: 8527
  misc_feature 1..1347: note = derived and/or modified sequence opt1 from Trastuzumab_HeavyChain1
  source 1..1347: mol_type = other RNA

SEQ ID NO: 8530 - RNA, 1353 nt, synthetic construct
  misc_feature 1..1353: note = derived and/or modified sequence opt1 from Trastuzumab_HeavyChain
  source 1..1353: mol_type = other RNA
gaggtgcagctggtcgagagcggcgggggcctcgtgcagcccgggggctccctgcgcctgagctgcgccgcctccgggttcaacatcaaggacacctacatccactgggtgcggcaggcgccgggcaagggcctcgagtgggtcgcccgcatctaccccaccaacgggtacacgcggtacgccgacagcgtgaagggccgcttcaccatctccgccgacaccagcaagaacaccgcctacctgcagatgaactccctgcgggcggaggacacggccgtgtactactgcagccgctggggcggggacgggttctacgccatggactactggggccagggcaccctcgtcaccgtgtccagcgcctccaccaaggggcccagcgtgttccccctggcgccgtccagcaagtccacgagcggcgggaccgccgccctgggctgcctcgtcaaggactacttccccgagcccgtgaccgtgtcctggaacagcggcgccctgacctccggggtccacacgttccccgccgtgctgcagagcagcggcctctactccctgagctccgtggtcaccgtgccgagctccagcctggggacccagacctacatctgcaacgtgaaccacaagccctccaacacgaaggtcgacaagaaggtggagccgcccaagagctgcgacaagacccacacgtgcccgccctgccccgcgcccgagctcctgggcgggccctccgtgttcctgttcccgcccaagcccaaggacaccctcatgatcagccggacccccgaggtgacctgcgtcgtggtcgacgtgtcccacgaggaccccgaggtcaagttcaactggtacgtggacggcgtggaggtccacaacgccaagaccaagccccgcgaggagcagtacaacagcacctaccgggtggtgtccgtcctgacggtgctgcaccaggactggctcaacggcaaggagtacaagtgcaaggtgagcaacaaggccctgcccgccccgatcgagaagaccatctccaaggccaaggggcagccccgcgagccccaggtctacaccctgcccccgagccgggacgagctcaccaagaaccaggtgtccctgacgtgcctggtgaagggcttctaccccagcgacatcgcggtcgagtgggagtccaacgggcagcccgagaacaactacaagaccaccccgcccgtgctcgacagcgacggcagcttcttcctgtactccaagctgaccgtggacaagagccgctggcagcaggggaacgtcttctcctgcagcgtgatgcacgaggccctccacaaccactacacgcagaagtccctgagcctgtcccccggcaag

SEQ ID NO: 8531 - RNA, 660 nt, synthetic construct
  misc_feature 1..660: note = derived and/or modified sequence opt1 from Trastuzumab_HeavyChain_variant_1n8z_B
  source 1..660: mol_type = other RNA
gaggtgcagctggtcgagagcggcgggggcctcgtgcagcccgggggctccctgcgcctgagctgcgccgcctccgggttcaacatcaaggacacctacatccactgggtgcggcaggcgccgggcaagggcctcgagtgggtcgcccgcatctaccccaccaacgggtacacgcggtacgccgacagcgtgaagggccgcttcaccatctccgccgacaccagcaagaacaccgcctacctgcagatgaactccctgcgggcggaggacacggccgtgtactactgcagccgctggggcggggacgggttctacgccatggactactggggccagggcaccctcgtcaccgtgtccagcgcctccaccaaggggcccagcgtgttccccctggcgccgtccagcaagtccacgagcggcgggaccgccgccctgggctgcctcgtcaaggactacttccccgagcccgtgaccgtgtcctggaacagcggcgccctgacctccggggtccacacgttccccgccgtgctgcagagcagcggcctctactccctgagctccgtggtcaccgtgccgagctccagcctggggacccagacctacatctgcaacgtgaaccacaagccctccaacacgaaggtcgacaagaaggtggagccc

SEQ ID NO: 8532 - RNA, 45 nt, synthetic construct
  misc_feature 1..45: note = derived and/or modified sequence opt1 from Trastuzumab_HeavyChain_variant_7637_H
  source 1..45: mol_type = other RNA
gagcccaagagctgcgacaagacccacacctgcccgccctgcccc

SEQ ID NO: 8533 - RNA, 642 nt, synthetic construct; identical to SEQ ID NO: 8384
  misc_feature 1..642: note = derived and/or modified sequence opt1 from Trastuzumab_LightChain1
  source 1..642: mol_type = other RNA

SEQ ID NO: 8534 - RNA, 642 nt, synthetic construct; identical to SEQ ID NO: 8384
  misc_feature 1..642: note = derived and/or modified sequence opt1 from Trastuzumab_LightChain_variant_1n8z_A
  source 1..642: mol_type = other RNA

SEQ ID NO: 8535 - RNA, 642 nt, synthetic construct; identical to SEQ ID NO: 8384
  misc_feature 1..642: note = derived and/or modified sequence opt1 from Trastuzumab_LightChain_variant_7637_L
  source 1..642: mol_type = other RNA

SEQ ID NO: 8536 - RNA, 1344 nt, synthetic construct
  misc_feature 1..1344: note = derived and/or modified sequence opt1 from TRC-105_HeavyChain1
  source 1..1344: mol_type = other RNA
gaggtgaagctggaggagagcggcgggggcctcgtccagcccgggggctccatgaagctgagctgcgccgcctccgggttcaccttcagcgacgcgtggatggactgggtgcgccagtccccggagaagggcctggagtgggtggccgagatccggagcaaggcctccaaccacgccacctactacgccgagagcgtcaagggccgcttcacgatctcccgggacgacagcaagtccagcgtgtacctccagatgaactccctgcgcgcggaggacaccgggatctactactgcacccggtggcgccggttcttcgacagctggggccaggggaccacgctgaccgtgtccagcgcctccaccaagggccccagcgtcttccccctcgccccctccagcaagagcacctccgggggcacggccgcgctgggctgcctggtgaaggactacttcccggagcccgtgaccgtcagctggaactccggggccctcaccagcggcgtgcacaccttccccgccgtgctgcagtccagcgggctgtactccctcagctccgtcgtgacggtgcccagctccagcctgggcacccagacctacatctgcaacgtcaaccacaagccgtccaacaccaaggtggacaagaaggtggagcccaagagctgcgacaagacgcacacgtgcccgccctgcccggcccccgagctgctcggcgggccctccgtcttcctgttcccgcccaagcccaaggacaccctgatgatcagccgcacccccgaggtgacctgcgtggtcgtggacgtgtcccacgaggaccccgaggtcaagttcaactggtacgtggacggcgtcgaggtgcacaacgccaagaccaagccgcgggaggagcagtacaacagcacctaccgcgtggtctccgtgctcaccgtgctgcaccaggactggctgaacgggaaggagtacaagtgcaaggtcagcaacaaggcgctccccgcccccatcgagaagacgatcagcaaggccaagggccagccccgggagccccaggtgtacaccctgccgccctcccgcgacgagctgaccaagaaccaggtgagcctgacctgcctcgtcaaggggttctacccctccgacatcgccgtggagtgggagagcaacggccagcccgagaacaactacaagacgaccccgcccgtgctggactccgacggcagcttcttcctctactccaagctgaccgtcgacaagagccggtggcagcaggggaacgtgttctcctgcagcgtgatgcacgaggccctgcacaaccactacacccagaagtccctcagcctgtcccccggcaag

SEQ ID NO: 8537 - RNA, 639 nt, synthetic construct
  misc_feature 1..639: note = derived and/or modified sequence opt1 from TRC-105_LightChain1
  source 1..639: mol_type = other RNA
cagatcgtgctgagccagtcccccgccatcctcagcgcctccccgggcgagaaggtcaccatgacctgccgcgcgagctccagcgtgtcctacatgcactggtaccagcagaagcccgggagctcccccaagccctggatctacgccacgagcaacctggcctccggcgtgccggtccggttcagcgggtccggcagcgggacctcctacagcctgaccatctcccgcgtggaggccgaggacgccgcgacctactactgccagcagtggagctccaaccccctcacgttcggcgccggcaccaagctggagctgaagcggaccgtggccgcccccagcgtcttcatcttcccgcccagcgacgagcagctcaagtccgggaccgcgagcgtggtgtgcctgctgaacaacttctacccccgcgaggccaaggtccagtggaaggtggacaacgccctccagtccggcaacagccaggagtccgtgacggagcaggacagcaaggactccacctacagcctgtccagcaccctgaccctctccaaggccgactacgagaagcacaaggtctacgcctgcgaggtgacgcaccaggggctgagctcccccgtgaccaagagcttcaaccggggcgagtgc

SEQ ID NO: 8538 - RNA, 1362 nt, synthetic construct
  misc_feature 1..1362: note = derived and/or modified sequence opt1 from Tregalizumab_HeavyChain1
  source 1..1362: mol_type = other RNA
gaggagcagctggtggagagcggcgggggcctcgtcaagcccgggggctccctgcgcctgagctgcgccgcctccgggttcagcttctccgactgccggatgtactggctccgccaggcgccgggcaagggcctggagtggatcggggtgatcagcgtgaagtccgagaactacggcgccaactacgccgagagcgtccgggggcgcttcaccatctcccgggacgacagcaagaacaccgtgtacctgcagatgaactccctcaagacggaggacaccgccgtgtactactgcagcgcctcctactaccgctacgacgtcggcgcgtggttcgcctactgggggcagggcaccctggtgaccgtgagctccgccagcacgaagggcccctccgtcttccccctggcccccagctccaagagcaccagcgggggcaccgcggccctcgggtgcctggtgaaggactacttcccggagcccgtgaccgtctcctggaacagcggcgccctgacgtccggcgtgcacaccttccccgccgtgctccagagctccgggctgtacagcctgtccagcgtcgtgaccgtgccctccagctccctcggcacccagacgtacatctgcaacgtcaaccacaagccgagcaacaccaaggtggacaagaaggtggagcccaagtcctgcgacaagacccacacgtgcccgccctgcccggcccccgagctgctcgggggccccagcgtcttcctgttcccgcccaagcccaaggacaccctgatgatctcccggacccccgaggtgacctgcgtggtcgtggacgtcagccacgaggaccccgaggtgaagttcaactggtacgtggacggggtcgaggtgcacaacgcgaagaccaagccgcgcgaggagcagtacaactccacgtaccgggtggtcagcgtgctgaccgtgctccaccaggactggctgaacggcaaggagtacaagtgcaaggtctccaacaaggccctgcccgcccccatcgagaagaccatcagcaaggccaagggccagccccgcgagccccaggtgtacaccctcccgcccagccgggacgagctgacgaagaaccaggtgtccctgacctgcctcgtcaaggggttctaccccagcgacatcgccgtggagtgggagtccaacggccagcccgagaacaactacaagaccaccccgcccgtgctggacagcgacgggtccttcttcctgtacagcaagctcacggtcgacaagtcccgctggcagcagggcaacgtgttcagctgctccgtgatgcacgaggcgctgcacaaccactacacccagaagtccctgagcctcagccccgggaag

SEQ ID NO: 8539 - RNA, 654 nt, synthetic construct
  misc_feature 1..654: note = derived and/or modified sequence opt1 from Tregalizumab_LightChain1
  source 1..654: mol_type = other RNA
gacatcgtgatgacccagagccccgactccctggccgtcagcctcggcgagcgcgccaccatcaactgccgggcgtccaagagcgtgtccacgagcgggtactcctacatctactggtaccagcagaagccgggccagccgcccaagctgctgatctacctcgccagcatcctggagtccggggtgcccgaccgcttcagcggctccgggagcggcaccgacttcaccctgaccatctccagcctccaggccgaggacgtcgccgtgtactactgccagcactcccgggagctgccctggacgttcggccaggggaccaaggtggagatcaagcgcaccgtcgccgcgcccagcgtgttcatcttcccgccctccgacgagcagctcaagagcggcaccgcctccgtggtctgcctgctgaacaacttctacccccgggaggccaaggtgcagtggaaggtggacaacgccctgcagagcgggaacagccaggagtccgtcacggagcaggacagcaaggactccacctacagcctctccagcaccctgaccctgtccaaggcggactacgagaagcacaaggtgtacgcctgcgaggtgacgcaccagggcctcagctcccccgtcaccaagagcttcaaccgcggggagtgc

SEQ ID NO: 8540 - RNA, 1353 nt, synthetic construct
  misc_feature 1..1353: note = derived and/or modified sequence opt1 from Tremelimumab_HeavyChain1
  source 1..1353: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgtgatctggtacgacgggagcaacaagtactacgccgactccgtcaagggccggttcaccatcagccgcgacaactccaagaacacgctctacctgcagatgaacagcctgcgggccgaggacaccgccgtgtactactgcgcgcgcgacccccgcggggccaccctctactactactactacggcatggacgtgtgggggcagggcaccacggtcaccgtgtccagcgcctccaccaagggccccagcgtgttccccctggccccgtgctcccggagcacctccgagagcacggcggccctggggtgcctcgtcaaggactacttccccgagcccgtgaccgtgtcctggaacagcggcgccctgaccagcggggtccacaccttccccgccgtgctgcagtccagcggcctctactccctgagctccgtggtcacggtgccgagctccaacttcggcacccagacctacacgtgcaacgtggaccacaagcccagcaacaccaaggtcgacaagaccgtggagcggaagtgctgcgtggagtgcccgccctgccccgccccgcccgtcgcggggccctccgtgttcctgttcccgcccaagcccaaggacaccctcatgatcagccgcacccccgaggtcacgtgcgtggtggtcgacgtgtcccacgaggaccccgaggtgcagttcaactggtacgtcgacggcgtggaggtgcacaacgccaagaccaagccccgggaggagcagttcaacagcaccttccgcgtcgtgtccgtgctgaccgtcgtgcaccaggactggctgaacgggaaggagtacaagtgcaaggtgagcaacaagggcctccccgcccccatcgagaagacgatctccaagaccaaggggcagccgcgggagccccaggtctacaccctgccgcccagccgcgaggagatgaccaagaaccaggtgtccctgacgtgcctcgtgaagggcttctaccccagcgacatcgccgtcgagtgggagtccaacggccagcccgagaacaactacaagaccacgcccccgatgctggacagcgacgggagcttcttcctgtactccaagctcaccgtggacaagagccggtggcagcagggcaacgtgttctcctgcagcgtcatgcacgaggccctgcacaaccactacacccagaagtccctgagcctctcccccgggaag

SEQ ID NO: 8541 - RNA, 642 nt, synthetic construct
  misc_feature 1..642: note = derived and/or modified sequence opt1 from Tremelimumab_LightChain1
  source 1..642: mol_type = other RNA
gacatccagatgacccagagcccctccagcctgtccgccagcgtgggcgaccgcgtcaccatcacgtgccgggcctcccagagcatcaactcctacctcgactggtaccagcagaagccggggaaggcgcccaagctgctgatctacgccgccagctccctccagagcggcgtgccctcccgcttcagcgggtccggcagcgggaccgacttcaccctgaccatctccagcctgcagcccgaggacttcgccacgtactactgccagcagtactactccaccccgttcaccttcggccccggcaccaaggtggagatcaagcggacggtcgccgcgcccagcgtgttcatcttcccgccctccgacgagcagctcaagagcgggaccgccagcgtggtctgcctgctgaacaacttctacccccgcgaggccaaggtgcagtggaaggtggacaacgccctccagtccggcaacagccaggagtccgtcaccgagcaggacagcaaggactccacctacagcctgtccagcacgctgaccctctccaaggcggactacgagaagcacaaggtgtacgcctgcgaggtgacccaccaggggctgagctcccccgtcaccaagagcttcaaccggggcgagtgc

SEQ ID NO: 8542 - RNA, 1341 nt, synthetic construct
  misc_feature 1..1341: note = derived and/or modified sequence opt1 from Trevogrumab_HeavyChain1
  source 1..1341: mol_type = other RNA
gaggtgcaggtcctggagagcggcggggacctcgtgcagcccggcgggtccctgcgcctgagctgcgccgcctccggcttcaccttcagcgcgtacgccatgacctgggtgcggcaggcccccgggaagggcctcgagtgggtctccgccatcagcggctccgggggcagcgcctactacgcggactccgtgaaggggcgcttcacgatcagccgggacaactccaagaacaccgtgtacctgcagatgaacagcctgcgcgccgaggacaccgccgtctactactgcgccaaggacggcgcgtggaagatgtccgggctcgacgtgtggggccagggcaccacggtgatcgtcagctccgccagcaccaaggggccctccgtgttccccctggccccctgcagccggtccaccagcgagagcaccgccgccctgggctgcctcgtgaaggactacttcccggagcccgtcacggtgtcctggaacagcggggcgctgacctccggcgtgcacaccttccccgccgtcctgcagagctccggcctctacagcctgtccagcgtggtgaccgtcccctccagctccctggggacgaagacctacacgtgcaacgtggaccacaagccgagcaacaccaaggtggacaagcgcgtcgagtccaagtacggcccgccctgcccgccctgccccgcccccgagttcctcgggggccccagcgtgttcctgttcccgcccaagcccaaggacaccctgatgatctcccggacccccgaggtgacctgcgtcgtggtcgacgtgagccaggaggacccggaggtgcagttcaactggtacgtcgacggggtggaggtgcacaacgccaagaccaagccccgcgaggagcagttcaactccacgtaccgggtcgtgagcgtgctcaccgtcctgcaccaggactggctgaacggcaaggagtacaagtgcaaggtgtccaacaagggcctccccagcagcatcgagaagaccatctccaaggccaaggggcagccccgcgagccccaggtgtacaccctgccgcccagccaggaggagatgacgaagaaccaggtctccctgacctgcctcgtgaagggcttctaccccagcgacatcgcggtggagtgggagtccaacgggcagcccgagaacaactacaagaccaccccgcccgtcctggacagcgacggctccttcttcctgtacagccggctcacggtggacaagtcccgctggcaggaggggaacgtgttcagctgctccgtcatgcacgaggccctgcacaaccactacacccagaagtccctgagcctcagcctgggcaag

SEQ ID NO: 8543 - RNA, 642 nt, synthetic construct
  misc_feature 1..642: note = derived and/or modified sequence opt1 from Trevogrumab_LightChain1
  source 1..642: mol_type = other RNA
gacatccagatgacccagagccccgcctccctgagcgcctccgtgggcgaccgggtcaccatcacgtgccgggcgagccaggacatctccgactacctcgcctggtaccagcagaagccggggaagatcccccgcctgctgatctacaccaccagcaccctccagtccggcgtgcccagccggttccgcgggtccggcagcgggacggacttcaccctgaccatctccagcctgcagcccgaggacgtggccacctactactgccagaagtacgactccgccccgctcacgttcggcggcgggaccaaggtcgagatcaagcggaccgtggccgcgcccagcgtgttcatcttcccgccctccgacgagcagctcaagagcggcaccgcctccgtcgtgtgcctgctgaacaacttctacccccgcgaggccaaggtgcagtggaaggtcgacaacgccctgcagagcgggaactcccaggagagcgtgacggagcaggacagcaaggactccacctacagcctgtccagcaccctcaccctgtccaaggcggactacgagaagcacaaggtgtacgcctgcgaggtcacgcaccagggcctgagctcccccgtgaccaagagcttcaaccgcggggagtgc

SEQ ID NO: 8544 - RNA, 1737 nt, synthetic construct
  misc_feature 1..1737: note = derived and/or modified sequence opt1 from Tucotuzumab_celmoleukin_HeavyChain1
  source 1..1737: mol_type = other RNA
cagatccagctggtgcagagcggcgccgaggtcaagaagcccggggagaccgtgaagatctcctgcaaggccagcggctacaccttcacgaactacgggatgaactgggtgaagcagaccccgggcaaggggctcaagtggatgggctggatcaacacctacaccggcgagcccacgtacgcggacgacttcaaggggcgcttcgccttctccctggagaccagcacctccaccgccttcctgcagatcaacaacctccggagcgaggacacggccacctacttctgcgtccgcttcatctccaagggcgactactgggggcagggcaccagcgtgaccgtgtccagcgcctccacgaaggggcccagcgtcttccccctggcgccgtccagcaagtccaccagcggcggcaccgccgccctggggtgcctcgtgaaggactacttccccgagcccgtgaccgtctcctggaacagcggcgccctgacgtccggggtgcacaccttccccgcggtgctgcagagcagcggcctctactccctgagctccgtcgtgaccgtgccgagctccagcctgggcacccagacgtacatctgcaacgtcaaccacaagccctccaacaccaaggtggacaagcgggtggagcccaagagctgcgacaagacccacacgtgcccgccctgccccgcccccgagctcctcgggggcccctccgtcttcctgttcccgcccaagcccaaggacaccctcatgatcagccgcacccccgaggtgacctgcgtggtcgtggacgtgtcccacgaggacccggaggtcaagttcaactggtacgtggacggggtcgaggtgcacaacgccaagaccaagccccgggaggagcagtacaacagcacgtaccgcgtggtctccgtgctgaccgtgctgcaccaggactggctcaacggcaaggagtacaagtgcaaggtcagcaacaaggccctgcccgcccccatcgagaagaccatctccaaggcgaaggggcagccgcgggagccccaggtgtacaccctgccgcccagccgcgaggagatgacgaagaaccaggtgtccctgacctgcctggtcaagggcttctaccccagcgacatcgccgtggagtgggagtccaacggccagcccgagaacaactacaagaccacgcccccggtgctggacagcgacgggagcttcttcctctactccaagctgaccgtcgacaagagccggtggcagcagggcaacgtgttctcctgcagcgtgatgcacgaggccctgcacaaccactacacccagaagtccctcagcctgtcccccgggaaggcccccaccagctccagcaccaagaagacccagctgcagctcgagcacctcctgctggacctgcagatgatcctgaacggcatcaacaactacaagaaccccaagctcacgcgcatgctgaccttcaagttctacatgccgaagaaggccaccgagctgaagcacctccagtgcctggaggaggagctgaagcccctcgaggaggtcctgaacctggcgcagtccaagaacttccacctccggccccgcgacctgatcagcaacatcaacgtgatcgtgctggagctcaaggggtccgagaccacgttcatgtgcgagtacgccgacgagaccgccaccatcgtcgagttcctgaaccggtggatcaccttctgccagagcatcatctccacgctgacc

SEQ ID NO: 8545 - RNA, 639 nt, synthetic construct
  misc_feature 1..639: note = derived and/or modified sequence opt1 from Tucotuzumab_celmoleukin_LightChain1
  source 1..639: mol_type = other RNA
gagatcgtgctgacccagagccccgccaccctctccctgagcccgggcgagcgcgtcacgctgacctgctccgccagctccagcgtgtcctacatgctctggtaccagcagaagcccgggagctcccccaagccctggatcttcgacaccagcaacctggcgtccggcttcccggcccggttcagcgggtccggcagcgggacctcctacagcctgatcatctccagcatggaggccgaggacgccgccacgtactactgccaccagcgctccggctacccctacaccttcggcgggggcaccaagctcgagatcaagcggaccgtggcggcccccagcgtcttcatcttcccgcccagcgacgagcagctgaagtccgggacggccagcgtggtgtgcctgctcaacaacttctacccccgcgaggccaaggtccagtggaaggtggacaacgcgctgcagtccggcaacagccaggagtccgtgaccgagcaggacagcaaggactccacctacagcctgtccagcaccctcacgctgtccaaggccgactacgagaagcacaaggtctacgcctgcgaggtgacccaccaggggctgagctcccccgtgaccaagagcttcaaccggggcgagtgc

SEQ ID NO: 8546 - RNA, 1344 nt, synthetic construct
  misc_feature 1..1344: note = derived and/or modified sequence opt1 from Ublituximab_HeavyChain1
  source 1..1344: mol_type = other RNA
caggcctacctgcagcagagcggcgccgagctcgtgcgccccggggcgtccgtcaagatgagctgcaaggcctccggctacaccttcaccagctacaacatgcactgggtgaagcagacgccgcggcaggggctggagtggatcggcgggatctaccccggcaacggcgacacctcctacaaccagaagttcaaggggaaggccaccctgaccgtgggcaagagctccagcacggcctacatgcagctctccagcctgacctccgaggacagcgccgtctacttctgcgcgcgctacgactacaactacgccatggactactgggggcagggcacctccgtgaccgtgagctccgccagcacgaaggggccctccgtcttccccctggccccgagctccaagagcaccagcggcggcaccgcggccctcgggtgcctggtgaaggactacttccccgagcccgtgaccgtctcctggaacagcggcgccctgacgtccggggtgcacaccttccccgccgtgctccagagctccggcctgtacagcctgtccagcgtcgtgaccgtgccgtccagctccctcggcacccagacgtacatctgcaacgtcaaccacaagcccagcaacaccaaggtggacaagaaggtggagcccaagtcctgcgacaagacccacacgtgcccgccctgccccgcccccgagctgctcgggggccccagcgtcttcctgttcccgcccaagcccaaggacaccctgatgatctcccggacccccgaggtgacctgcgtggtcgtggacgtgagccacgaggacccggaggtcaagttcaactggtacgtggacggggtcgaggtgcacaacgcgaagaccaagccccgcgaggagcagtacaactccacgtaccgggtggtcagcgtgctgaccgtgctccaccaggactggctgaacggcaaggagtacaagtgcaaggtctccaacaaggccctgcccgcccccatcgagaagaccatcagcaaggccaaggggcagccgcgcgagccccaggtgtacaccctcccgcccagccgggacgagctgacgaagaaccaggtgtccctgacctgcctcgtcaagggcttctaccccagcgacatcgccgtggagtgggagtccaacggccagcccgagaacaactacaagaccacgcccccggtgctggacagcgacgggtccttcttcctgtacagcaagctcaccgtcgacaagtcccgctggcagcagggcaacgtgttcagctgctccgtgatgcacgaggcgctgcacaaccactacacccagaagtccctgagcctcagccccgggaag

SEQ ID NO: 8547 - RNA, 639 nt, synthetic construct
  misc_feature 1..639: note = derived and/or modified sequence opt1 from Ublituximab_LightChain1
  source 1..639: mol_type = other RNA
cagatcgtgctgagccagtcccccgccatcctcagcgcctcccccggcgagaaggtcaccatgacctgccgcgcgagctccagcgtgtcctacatgcactggtaccagcagaagcccgggagctcccccaagccctggatctacgccacgagcaacctggcctccggcgtgccggcccggttcagcgggtccggcagcgggacctcctacagcttcaccatctcccgcgtcgaggccgaggacgcggccacctactactgccagcagtggacgttcaacccgcccaccttcggcggcgggacccggctggagatcaagcgcaccgtggccgcccccagcgtgttcatcttcccgccctccgacgagcagctcaagagcggcacggcgagcgtcgtgtgcctgctgaacaacttctacccccgggaggccaaggtgcagtggaaggtcgacaacgccctccagtccgggaacagccaggagtccgtgaccgagcaggacagcaaggactccacctacagcctgtccagcaccctgacgctctccaaggccgactacgagaagcacaaggtgtacgcctgcgaggtcacccaccagggcctgagctcccccgtgaccaagagcttcaaccgcggggagtgc

SEQ ID NO: 8548 - RNA, 1353 nt, synthetic construct
  misc_feature 1..1353: note = derived and/or modified sequence opt1 from Ulocuplumab_HeavyChain1
  source 1..1353: mol_type = other RNA
gaggtgcagctggtcgagagcggcgggggcctcgtgcagcccgggggctccctgcgcctgagctgcgccgccgcggggttcaccttctccagctactccatgaactgggtgcggcaggccccgggcaagggcctcgagtgggtcagctacatctccagccgctcccggaccatctactacgccgacagcgtgaaggggcgcttcacgatctcccgggacaacgccaagaacagcctgtacctgcagatgaactccctccgcgacgaggacaccgccgtgtactactgcgcgcgggactacggcgggcagccgccctactactactactacggcatggacgtctgggggcagggcaccaccgtgacggtgagctccgccagcaccaagggcccctccgtcttccccctggccccctgcagccgctccaccagcgagagcaccgccgcgctggggtgcctcgtgaaggactacttccccgagcccgtgacggtctcctggaacagcggcgccctgacctccggggtgcacaccttcccggccgtgctgcagagctccggcctctacagcctgtccagcgtcgtgaccgtgccctccagctccctgggcacgaagacctacacgtgcaacgtcgaccacaagcccagcaacaccaaggtggacaagcgggtggagtccaagtacgggcccccgtgcccgccctgccccgcccccgagttcctcggcgggcccagcgtcttcctgttcccgcccaagcccaaggacaccctgatgatctcccgcacccccgaggtgacctgcgtggtcgtggacgtcagccaggaggaccccgaggtgcagttcaactggtacgtggacggcgtcgaggtgcacaacgccaagaccaagccccgggaggagcagttcaactccacgtaccgcgtggtcagcgtgctcaccgtgctgcaccaggactggctgaacgggaaggagtacaagtgcaaggtctccaacaagggcctcccgagcagcatcgagaagaccatctccaaggcgaagggccagccccgggagccccaggtgtacaccctgcccccgagccaggaggagatgacgaagaaccaggtgtccctgacctgcctcgtcaaggggttctaccccagcgacatcgccgtggagtgggagtccaacggccagcccgagaacaactacaagaccaccccgcccgtgctggacagcgacgggtccttcttcctgtacagccgcctcacggtcgacaagtcccggtggcaggagggcaacgtgttcagctgctccgtgatgcacgaggccctgcacaaccactacacccagaagtccctgagcctcagcctgggg

SEQ ID NO: 8549 - RNA, 642 nt, synthetic construct
  misc_feature 1..642: note = derived and/or modified sequence opt1 from Ulocuplumab_LightChain1
  source 1..642: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccgcctccagcctgcagtccggcgtgcccagccgcttctccgggagcggctccgggaccgacttcaccctcaccatcagctccctgcagcccgaggacttcgtgacgtactactgccagcagtacaacagctacccgcggaccttcggccagggcaccaaggtcgagatcaagcgcaccgtggccgcgccctccgtgttcatcttcccgcccagcgacgagcagctcaagagcgggacggcctccgtcgtgtgcctgctgaacaacttctacccccgggaggccaaggtgcagtggaaggtcgacaacgccctgcagagcggcaactcccaggagagcgtgaccgagcaggactccaaggacagcacctactccctcagctccaccctgacgctgagcaaggcggactacgagaagcacaaggtgtacgcctgcgaggtcacccaccaggggctctccagccccgtgaccaagtccttcaaccgcggcgagtgc

SEQ ID NO: 8550 - RNA, 1344 nt, synthetic construct
  misc_feature 1..1344: note = derived and/or modified sequence opt1 from Urelumab_HeavyChain1
  source 1..1344: mol_type = other RNA
caggtgcagctgcagcagtggggcgccgggctcctgaagcccagcgagaccctgtccctgacctgcgccgtctacggcgggagcttctccggctactactggagctggatccgccagtccccggagaaggggctcgagtggatcggcgagatcaaccacggcgggtacgtgacgtacaaccccagcctggagtcccgggtgaccatcagcgtcgacacctccaagaaccagttcagcctcaagctgtccagcgtgaccgcggccgacacggccgtgtactactgcgcccgcgactacggccccgggaactacgactggtacttcgacctgtggggccgggggaccctcgtcaccgtgtccagcgcctccaccaagggccccagcgtgttcccgctggcgccctgctcccgcagcacgtccgagagcaccgccgccctgggctgcctcgtcaaggactacttccccgagcccgtgaccgtgagctggaactccggggccctgaccagcggcgtccacacgttcccggcggtgctgcagtccagcgggctctactccctgagctccgtggtcaccgtgcccagctccagcctgggcaccaagacctacacgtgcaacgtggaccacaagccctccaacaccaaggtcgacaagcgggtggagagcaagtacgggcccccgtgcccgccctgccccgcccccgagttcctcggcggcccctccgtgttcctgttcccgcccaagcccaaggacaccctgatgatcagccgcacccccgaggtcacgtgcgtggtggtcgacgtgtcccaggaggaccccgaggtccagttcaactggtacgtggacggggtggaggtccacaacgccaagaccaagccccgggaggagcagttcaacagcacctaccgcgtggtgtccgtcctcaccgtgctgcaccaggactggctgaacggcaaggagtacaagtgcaaggtgagcaacaaggggctcccgtccagcatcgagaagacgatcagcaaggccaagggccagccccgggagccccaggtctacaccctgcccccgtcccaggaggagatgaccaagaaccaggtgagcctgacctgcctcgtgaagggcttctacccctccgacatcgccgtcgagtgggagagcaacgggcagcccgagaacaactacaagacgaccccgcccgtgctggactccgacggcagcttcttcctgtactcccgcctcaccgtggacaagagccggtggcaggaggggaacgtcttctcctgcagcgtgatgcacgaggcgctgcacaaccactacacccagaagtccctgagcctctccctgggcaag

SEQ ID NO: 8551 - RNA, 648 nt, synthetic construct
  misc_feature 1..648: note = derived and/or modified sequence opt1 from Urelumab_LightChain1
  source 1..648: mol_type = other RNA
gagatcgtgctgacccagagccccgccaccctctccctgagccccggcgagcgcgccacgctgtcctgccgggcgagccagtccgtcagctcctacctcgcctggtaccagcagaagcccgggcaggcgccccgcctgctgatctacgacgccagcaaccgggccaccggcatccccgcccgcttctccgggagcggctccgggaccgacttcaccctcacgatcagctccctggagccggaggacttcgccgtgtactactgccagcagcggagcaactggccgcccgccctgaccttctgcggcggcaccaaggtggagatcaagcgcaccgtcgccgcgccctccgtgttcatcttcccgcccagcgacgagcagctcaagtccgggacggccagcgtggtctgcctgctgaacaacttctacccccgggaggccaaggtgcagtggaaggtggacaacgccctccagtccggcaacagccaggagagcgtcaccgagcaggactccaaggacagcacctactccctgagctccaccctgacgctcagcaaggccgactacgagaagcacaaggtgtacgcgtgcgaggtgacccaccaggggctgtccagccccgtcaccaagtccttcaaccgcggcgagtgc

SEQ ID NO: 8552 - RNA, 1347 nt, synthetic construct
  misc_feature 1..1347: note = derived and/or modified sequence opt1 from Urtoxazumab_HeavyChain1
  source 1..1347: mol_type = other RNA
gaggtgcagctggtcgagagcggcgggggcctcgtgcagcccgggggctccctgcgcctgagctgcgccgcctccgggttcaccttcagctcctacggcatgagctgggtgcggcaggcgccgggcaaggggctcgagtgggtcgccaccatctccacgggcgggagctacacctactaccccgactccgtgaagggccgcttcaccatcagccgggacaacgccaagaacaccctgtacctgcagatgaactccctccgcgccgaggacacggccgtgtactactgcgcgcggcgcggggacgcctggggcaacctggactactggggccaggggaccctggtcaccgtgagctccgccagcaccaagggcccctccgtgttccccctcgccccgagctccaagagcacgtccgggggcaccgcggccctgggctgcctggtcaaggactacttccccgagcccgtgaccgtgagctggaacagcggggccctcacctccggcgtccacacgttccccgccgtgctgcagagctccgggctgtacagcctctccagcgtggtcaccgtgccgtccagctccctgggcacccagacctacatctgcaacgtgaaccacaagcccagcaacacgaaggtcgacaagaaggtggagcccaagtcctgcgacaagacccacacgtgcccgccctgccccgcccccgagctgctcgggggccccagcgtgttcctgttcccgcccaagcccaaggacaccctgatgatctcccggacccccgaggtgacctgcgtcgtggtcgacgtgagccacgaggacccggaggtcaagttcaactggtacgtggacggcgtggaggtccacaacgcgaagaccaagccccgcgaggagcagtacaactccacctaccgggtggtgagcgtcctcacggtgctgcaccaggactggctgaacgggaaggagtacaagtgcaaggtgtccaacaaggccctccccgcccccatcgagaagaccatcagcaaggccaagggccagccgcgcgagccccaggtctacaccctgccgccctcccgggacgagctgaccaagaaccaggtgagcctcacgtgcctggtgaaggggttctaccccagcgacatcgccgtcgagtgggagtccaacggccagcccgagaacaactacaagaccacgcccccggtgctggacagcgacgggtccttcttcctctacagcaagctgaccgtggacaagtcccgctggcagcagggcaacgtcttcagctgctccgtgatgcacgaggcgctgcacaaccactacacccagaagtccctcagcctgagccccggcaag

SEQ ID NO: 8553 - RNA, 642 nt, synthetic construct
  misc_feature 1..642: note = derived and/or modified sequence opt1 from Urtoxazumab_LightChain1
  source 1..642: mol_type = other RNA
gagatcgtgctgacccagagccccgccaccctctccgtcagcccgggcgagcgcgccacgctgtcctgccgggcgagccagaccatctccaacaacctgcactggtaccagcagaagcccgggcaggcgccccgcctcctgatcaagagcgcctcccagagcatctccggcatccccgcccggttcagcgggtccggcagcgggaccgacttcaccctgacgatctccagcctcgagtccgaggacttcgccgtgtactactgccagcagagctactcctggccgctgaccttcggccagggcaccaaggtggagatcaagcgcaccgtcgccgcccccagcgtgttcatcttcccgccctccgacgagcagctcaagagcgggacggccagcgtggtctgcctgctgaacaacttctacccccgggaggccaaggtgcagtggaaggtggacaacgcgctgcagtccggcaacagccaggagtccgtcaccgagcaggacagcaaggactccacctacagcctctccagcaccctgacgctgtccaaggccgactacgagaagcacaaggtgtacgcctgcgaggtgacccaccaggggctcagctcccccgtcaccaagagcttcaaccgcggcgagtgc

SEQ ID NO: 8554 - RNA, 1347 nt, synthetic construct
  misc_feature 1..1347: note = derived and/or modified sequence opt1 from Ustekinumab_HeavyChain1
  source 1..1347: mol_type = other RNA
gaggtgcagctggtccagagcggcgccgaggtgaagaagcccggggagtccctcaagatcagctgcaagggctccgggtacagcttcaccacctactggctgggctgggtgcgccagatgcccgggaagggcctggactggatcggcatcatgtcccccgtcgacagcgacatccggtactcccccagcttccagggccaggtgacgatgtccgtggacaagagcatcaccaccgcctacctccagtggaactccctgaaggcgagcgacaccgccatgtactactgcgcccgccggcgccccgggcaggggtacttcgacttctggggccaggggacgctggtcaccgtgtccagctccagcaccaagggcccgtccgtgttccccctcgcccccagctccaagagcaccagcggcgggacggccgcgctgggctgcctggtcaaggactacttccccgagccggtgaccgtgtcctggaacagcggggccctcacctccggcgtccacaccttccccgccgtgctgcagagctccggcctgtacagcctctccagcgtggtcacggtgccctccagctccctggggacccagacctacatctgcaacgtgaaccacaagcccagcaacaccaaggtcgacaagcgggtggagccgaagtcctgcgacaagacgcacacgtgcccgccctgccccgcccccgagctgctcggcgggcccagcgtgttcctgttcccgcccaagcccaaggacaccctgatgatctcccgcacccccgaggtgacctgcgtcgtggtcgacgtgagccacgaggaccccgaggtcaagttcaactggtacgtggacggcgtggaggtccacaacgcgaagaccaagccccgggaggagcagtacaactccacctaccgcgtggtgagcgtcctcaccgtgctgcaccaggactggctgaacgggaaggagtacaagtgcaaggtgtccaacaaggccctcccggcccccatcgagaagacgatcagcaaggccaagggccagccccgggagccccaggtctacaccctgccgcccagccgcgacgagctgaccaagaaccaggtgtccctgacctgcctcgtgaagggcttctaccccagcgacatcgccgtcgagtgggagtccaacgggcagccggagaacaactacaagacgaccccgcccgtgctggacagcgacggctccttcttcctctacagcaagctgaccgtggacaagtcccggtggcagcaggggaacgtcttcagctgctccgtgatgcacgaggcgctgcacaaccactacacccagaagtccctcagcctgagccccggcaag

SEQ ID NO: 8555 - RNA, 642 nt, synthetic construct
  misc_feature 1..642: note = derived and/or modified sequence opt1 from Ustekinumab_LightChain1
  source 1..642: mol_type = other RNA
gacatccagatgacccagagcccctccagcctgtccgccagcgtgggcgaccgcgtcaccatcacgtgccgggcctcccaggggatcagctcctggctcgcgtggtaccagcagaagccggagaaggcccccaagagcctgatctacgccgcctccagcctgcagtccggcgtgcccagccgcttctccgggagcggctccgggaccgacttcaccctcaccatcagctccctgcagcccgaggacttcgccacgtactactgccagcagtacaacatctacccgtacaccttcggccagggcaccaagctggagatcaagcggaccgtggcggcccccagcgtcttcatcttcccgccctccgacgagcagctcaagagcgggacggccagcgtggtgtgcctgctgaacaacttctacccccgcgaggccaaggtccagtggaaggtggacaacgcgctccagtccggcaacagccaggagtccgtgaccgagcaggacagcaaggactccacctacagcctgtccagcaccctgacgctctccaaggccgactacgagaagcacaaggtctacgcctgcgaggtgacccaccaggggctgagctcccccgtgaccaagagcttcaaccggggcgagtgc

SEQ ID NO: 8556 - RNA, 1341 nt, synthetic construct
  misc_feature 1..1341: note = derived and/or modified sequence opt1 from Vadastuximab_talirine_HeavyChain1
  source 1..1341: mol_type = other RNA
caggtgcagctggtccagagcggcgccgaggtgaagaagcccggggcctccgtgaaggtcagctgcaaggcgtccggctacaccttcaccaactacgacatcaactgggtgcgccaggccccggggcagggcctcgagtggatcgggtggatctaccccggcgacggcagcaccaagtacaacgagaagttcaaggccaaggccaccctgaccgccgacacctccacgagcaccgcgtacatggagctgcggtccctccgcagcgacgacaccgccgtgtactactgcgcctccgggtacgaggacgccatggactactggggccaggggaccacggtcaccgtgagctccgcgagcaccaagggcccctccgtgttccccctggccccgagctccaagagcacctccgggggcacggccgccctgggctgcctcgtcaaggactacttccccgagcccgtgaccgtgagctggaactccggggccctgaccagcggcgtccacaccttccccgcggtgctgcagagctccgggctctacagcctgtccagcgtggtcacggtgccgtccagctccctgggcacccagacctacatctgcaacgtgaaccacaagcccagcaacaccaaggtcgacaagaaggtggagcccaagtcctgcgacaagacgcacacgtgcccgccctgccccgcccccgagctcctgggcgggccctgcgtgttcctgttcccgcccaagcccaaggacaccctcatgatcagccggacccccgaggtgacctgcgtcgtggtcgacgtgtcccacgaggacccggaggtcaagttcaactggtacgtggacggcgtggaggtccacaacgccaagaccaagccccgcgaggagcagtacaacagcacctaccgggtggtgtccgtcctgaccgtgctgcaccaggactggctcaacgggaaggagtacaagtgcaaggtgagcaacaaggccctgcccgcccccatcgagaagacgatctccaaggcgaagggccagccgcgcgagccccaggtctacaccctgccgcccagccgggacgagctcaccaagaaccaggtgtccctgacctgcctggtgaaggggttctaccccagcgacatcgccgtcgagtgggagtccaacggccagcccgagaacaactacaagacgacgcccccggtgctcgacagcgacggcagcttcttcctgtactccaagctgaccgtggacaagagccgctggcagcaggggaacgtcttctcctgcagcgtgatgcacgaggccctccacaaccactacacccagaagtccctgagcctgtcccccggcaag

SEQ ID NO: 8557 - RNA, 642 nt, synthetic construct
  misc_feature 1..642: note = derived and/or modified sequence opt1 from Vadastuximab_talirine_LightChain1
  source 1..642: mol_type = other RNA
gacatccagatgacccagagcccctccagcctgtccgccagcgtgggcgaccgcgtcaccatcaactgcaaggcctcccaggacatcaacagctacctctcctggttccagcagaagccggggaaggcgcccaagacgctgatctaccgggccaaccgcctggtggacggcgtgcccagccggttctccgggagcggctccgggcaggactacaccctcaccatcagctccctgcagcccgaggacttcgccacctactactgcctgcagtacgacgagttcccgctcacgttcggcggcgggaccaaggtcgagatcaagcgcaccgtggccgcccccagcgtgttcatcttcccgccctccgacgagcagctcaagagcggcaccgcgtccgtcgtgtgcctgctgaacaacttctacccccgggaggccaaggtgcagtggaaggtcgacaacgccctgcagagcgggaactcccaggagagcgtgacggagcaggacagcaaggactccacctacagcctgtccagcaccctcaccctgtccaaggccgactacgagaagcacaaggtgtacgcgtgcgaggtcacgcaccagggcctgagctcccccgtgaccaagagcttcaaccgcggggagtgc

SEQ ID NO: 8558 - RNA, 1362 nt, synthetic construct
  misc_feature 1..1362: note = derived and/or modified sequence opt1 from Vandortuzumab_vedotin_HeavyChain1
  source 1..1362: mol_type = other RNA
gaggtgcagctggtcgagagcggcgggggcctcgtgcagcccgggggctccctgcgcctgagctgcgccgtgtccgggtacagcatcacctccgactacgcctggaactgggtccggcaggcgccgggcaagggcctcgagtgggtggggtacatcagcaactccggcagcacctcctacaaccccagcctgaagtcccgcttcaccatcagccgggacacctccaagaacaccctgtacctccagatgaacagcctgcgcgccgaggacaccgccgtgtactactgcgcccgggagcgcaactacgactacgacgactactactacgccatggactactgggggcagggcacgctggtcaccgtgtccagcgcgtccaccaaggggcccagcgtgttccccctcgccccgtccagcaagagcacctccggcggcacggccgccctggggtgcctggtcaaggactacttccccgagcccgtgaccgtgagctggaactccggcgcgctcaccagcggggtccacaccttccccgccgtgctgcagtccagcggcctgtactccctcagctccgtggtcacggtgccgagctccagcctgggcacccagacctacatctgcaacgtgaaccacaagccctccaacaccaaggtcgacaagaaggtggagcccaagagctgcgacaagacgcacacgtgcccgccctgccccgcccccgagctgctcgggggcccctccgtgttcctgttcccgcccaagcccaaggacaccctgatgatcagccggacccccgaggtgacctgcgtcgtggtcgacgtgtcccacgaggacccggaggtcaagttcaactggtacgtggacggggtggaggtccacaacgccaagaccaagccccgcgaggagcagtacaacagcacctaccgggtggtgtccgtcctcaccgtgctgcaccaggactggctgaacggcaaggagtacaagtgcaaggtgagcaacaaggccctccccgcgcccatcgagaagacgatcagcaaggccaaggggcagccgcgcgagccccaggtctacaccctgccgccctcccgggaggagatgaccaagaaccaggtgagcctgacctgcctcgtgaagggcttctacccctccgacatcgccgtcgagtgggagagcaacggccagcccgagaacaactacaagacgacgcccccggtgctggactccgacgggagcttcttcctgtactccaagctcaccgtggacaagagccgctggcagcagggcaacgtcttctcctgcagcgtgatgcacgaggccctgcacaaccactacacccagaagtccctgagcctctcccccgggaag

SEQ ID NO: 8559 - RNA, 660 nt, synthetic construct
  misc_feature 1..660: note = derived and/or modified sequence opt1 from Vandortuzumab_vedotin_LightChain1
  source 1..660: mol_type = other RNA
gacatccagatgacccagagcccctccagcctgtccgccagcgtgggcgaccgcgtcaccatcacgtgcaagtccagccagtccctcctgtaccggagcaaccagaagaactacctggcctggtaccagcagaagccggggaaggcgcccaagctcctgatctactgggcctccacccgcgagagcggcgtgccctcccggttcagcgggtccggcagcgggaccgacttcaccctgacgatctccagcctccagcccgaggacttcgccacctactactgccagcagtactacaactacccgcgcaccttcggccagggcaccaaggtggagatcaagcggacggtcgccgccccctccgtgttcatcttcccgcccagcgacgagcagctgaagtccgggaccgcgagcgtggtctgcctgctcaacaacttctacccccgcgaggccaaggtgcagtggaaggtggacaacgccctgcagagcggcaactcccaggagagcgtcaccgagcaggactccaaggacagcacctactccctgagctccacgctcaccctgagcaaggccgactacgagaagcacaaggtgtacgcgtgcgaggtgacccaccaggggctgtccagccccgtcaccaagtccttcaaccggggcgagtgc

SEQ ID NO: 8560 - RNA, 1329 nt, synthetic construct
  misc_feature 1..1329: note = derived and/or modified sequence opt1 from Vantictumab_HeavyChain1
  source 1..1329: mol_type = other RNA
gaggtgcagctggtcgagagcggcgggggcctcgtgcagcccgggggctccctgcgcctgagctgcgccgcctccgggttcaccttcagccactacaccctctcctgggtgcggcaggcgccgggcaagggcctggagtgggtcagcgtgatctccggggacggcagctacacgtactacgccgactccgtgaaggggcgcttcaccatcagctccgacaacagcaagaacaccctgtacctccagatgaactccctgcgggccgaggacaccgccgtctactactgcgcccgcaacttcatcaagtacgtgttcgcgaactggggccaggggacgctggtgaccgtcagctccgccagcaccaagggcccctccgtgttccccctcgccccctgcagccggtccaccagcgagagcacggccgcgctgggctgcctggtgaaggactacttcccggagcccgtcaccgtgtcctggaacagcggggccctcacctccggcgtgcacaccttccccgccgtcctgcagagctccgggctgtacagcctctccagcgtggtgacggtcccctccagcaacttcggcacccagacctacacgtgcaacgtggaccacaagccgtccaacaccaaggtggacaagaccgtcgagcgcaagtgctgcgtggagtgcccgccctgccccgccccgcccgtggccggccccagcgtcttcctgttcccgcccaagcccaaggacaccctgatgatctcccggacccccgaggtgacgtgcgtcgtggtggacgtcagccacgaggaccccgaggtgcagttcaactggtacgtggacggggtcgaggtgcacaacgcgaagaccaagccgcgcgaggagcagttcaactccaccttccgggtggtcagcgtgctcaccgtggtccaccaggactggctgaacggcaaggagtacaagtgcaaggtgtccaacaaggggctgcccgcccccatcgagaagacgatcagcaagaccaagggccagccccgcgagccccaggtgtacaccctcccgccctcccgggaggagatgaccaagaaccaggtcagcctgacgtgcctggtgaaggggttctaccccagcgacatcgccgtggagtgggagtccaacggccagcccgagaacaactacaagaccaccccgcccatgctcgacagcgacggctccttcttcctgtacagcaagctgaccgtcgacaagtcccgctggcagcaggggaacgtgttcagctgctccgtgatgcacgaggccctccacaaccactacacgcagaagtccctgagcctgagccccggc

SEQ ID NO: 8561 - RNA, 639 nt, synthetic construct
  misc_feature 1..639: note = derived and/or modified sequence opt1 from Vantictumab_LightChain1
  source 1..639: mol_type = other RNA
gacatcgagctgacccagcccccgagcgtgtccgtcgcccccggccagaccgcccgcatcagctgctccggggacaacatcggcagcttctacgtgcactggtaccagcagaagcccgggcaggcgcccgtgctcgtcatctacgacaagtccaaccggccgagcggcatccccgagcgcttctccgggagcaactccggcaacacggccaccctgaccatcagcggcacccaggccgaggacgaggccgactactactgccagtcctacgccaacacgctgagcctcgtgttcgggggcgggaccaagctgaccgtgctgggccagcccaaggcggccccctccgtcaccctcttcccgcccagctccgaggagctgcaggccaacaaggccacgctggtgtgcctcatcagcgacttctaccccggggcggtgaccgtcgcctggaaggccgactccagccccgtgaaggccggcgtggagaccaccacgccgtccaagcagagcaacaacaagtacgccgcgagctcctacctgagcctgacccccgagcagtggaagtcccaccggagctactcctgccaggtcacccacgagggcagcaccgtggagaagacggtggcccccaccgagtgctcc

SEQ ID NO: 8562 - RNA, 1389 nt, synthetic construct
  misc_feature 1..1389: note = derived and/or modified sequence opt1 from Vanucizumab_HeavyChain1
  source 1..1389: mol_type = other RNA
caggtgcagctggtccagagcggcgccgaggtgaagaagcccggggcctccgtgaaggtcagctgcaaggcgtccggctacaccttcaccgggtactacatgcactgggtgcgccaggccccgggccaggggctcgagtggatgggctggatcaaccccaacagcggcgggacgaactacgcccagaagttccagggccgggtgaccatgacccgcgacacctccatcagcacggcctacatggagctgtcccggctgcgcagcgacgacaccgccgtctactactgcgcgcggtcccccaacccctactactacgacagctccgggtactactacccgggcgccttcgacatctgggggcagggcaccatggtgaccgtgagctccgccagcgtcgccgcgccctccgtgttcatcttcccgcccagcgacgagcagctcaagtccggcacggccagcgtggtctgcctgctgaacaacttctacccgcgcgaggccaaggtgcagtggaaggtggacaacgccctccagtccgggaacagccaggagagcgtcaccgagcaggactccaaggacagcacctactccctgagctccaccctgacgctcagcaaggccgactacgagaagcacaaggtgtacgcgtgcgaggtgacccaccagggcctgtccagccccgtcaccaagtccttcaaccgcggggagtgcgacaagacccacacgtgcccgccctgccccgcccccgagctgctcggcggccccagcgtgttcctgttcccgcccaagcccaaggacaccctgatgatctcccggacccccgaggtgacctgcgtcgtggtggacgtcagccacgaggaccccgaggtgaagttcaactggtacgtcgacggggtggaggtgcacaacgccaagacgaagccgcgggaggagcagtacaactccacctaccgcgtcgtgagcgtgctcaccgtcctgcaccaggactggctgaacggcaaggagtacaagtgcaaggtgtccaacaaggccctccccgcccccatcgagaagaccatcagcaaggcgaaggggcagccccgggagccccaggtgtgcacgctgccgccctcccgcgacgagctgaccaagaaccaggtcagcctctcctgcgccgtgaagggcttctaccccagcgacatcgccgtggagtgggagagcaacgggcagcccgagaacaactacaagaccaccccgcccgtcctggactccgacggcagcttcttcctggtgtccaagctcacggtggacaagagccggtggcagcagggcaacgtcttctcctgcagcgtgatgcacgaggccctgcacaaccactacacccagaagtccctgagcctctcccccgggaag

SEQ ID NO: 8563 - RNA, 1359 nt, synthetic construct
  misc_feature 1..1359: note = derived and/or modified sequence opt1 from Vanucizumab_HeavyChain2
  source 1..1359: mol_type = other RNA
gaggtgcagctggtcgagagcggcgggggcctcgtgcagcccgggggctccctgcgcctgagctgcgccgcctccgggtacaccttcaccaactacggcatgaactgggtgcggcaggcgccgggcaaggggctcgagtgggtcggctggatcaacacgtacaccggggagcccacctacgccgccgacttcaagcgccggttcaccttcagcctggacacgtccaagagcaccgcctacctgcagatgaactccctccgcgccgaggacaccgcggtgtactactgcgccaagtacccccactactacggcagctcccactggtacttcgacgtgtgggggcagggcaccctggtcacggtgagctccgccagcaccaagggcccctccgtgttcccgctggcccccagctccaagagcacctccgggggcaccgcggccctcgggtgcctggtcaaggactacttccccgagcccgtgacggtgagctggaactccggcgccctgaccagcggcgtccacaccttcccggccgtgctccagagctccgggctgtacagcctgtccagcgtggtcaccgtgccctccagctccctcggcacgcagacctacatctgcaacgtgaaccacaagcccagcaacaccaaggtcgacaagaaggtggagcccaagtcctgcgacaagacccacacgtgcccgccctgccccgcccccgagctgctcgggggcccgagcgtgttcctcttcccgcccaagcccaaggacaccctgatgatctcccggacccccgaggtgacctgcgtcgtggtcgacgtgagccacgaggaccccgaggtcaagttcaactggtacgtggacggggtggaggtccacaacgcgaagacgaagccccgcgaggagcagtacaactccacctaccgggtggtgagcgtcctgaccgtgctccaccaggactggctgaacggcaaggagtacaagtgcaaggtgtccaacaaggccctgcccgccccgatcgagaagaccatcagcaaggccaagggccagccccgcgagccccaggtctacacgctgcccccgtgccgggacgagctgaccaagaaccaggtgtccctgtggtgcctcgtgaaggggttctaccccagcgacatcgccgtcgagtgggagtccaacggccagcccgagaacaactacaagaccaccccgcccgtgctggacagcgacgggagcttcttcctgtactccaagctcacggtggacaagagccgctggcagcagggcaacgtcttctcctgcagcgtgatgcacgaggcgctgcacaaccactacacccagaagtccctgagcctctcccccgggaag

SEQ ID NO: 8564 - RNA, 639 nt, synthetic construct
  misc_feature 1..639: note = derived and/or modified sequence opt1 from Vanucizumab_LightChain1
  source 1..639: mol_type = other RNA
cagcccggcctgacccagccgcccagcgtgtccgtcgcccccgggcagaccgcccgcatcacgtgcggcgggaacaacatcggcagcaagtccgtgcactggtaccagcagaagcccgggcaggcgccggtgctcgtcgtgtacgacgacagcgaccggccctccggcatccccgagcgcttcagcggctccaacagcgggaacaccgccaccctgaccatctcccgggtggaggccggcgacgaggccgactactactgccaggtctgggacagctccagcgaccactacgtgttcgggacgggcaccaaggtgaccgtcctgtccagcgcctccaccaaggggcccagcgtgttcccgctcgcgccctccagcaagtccacgagcggcggcaccgccgccctggggtgcctggtgaaggactacttccccgagcccgtcaccgtgagctggaactccggcgccctcaccagcggggtgcacacgttcccggcggtcctgcagtccagcggcctgtactccctcagctccgtggtgaccgtccccagctccagcctgggcacccagacctacatctgcaacgtgaaccacaagccctccaacacgaaggtggacaagaaggtcgagcccaagagctgc

SEQ ID NO: 8565 - RNA, 642 nt, synthetic construct; identical to SEQ ID NO: 7726
  misc_feature 1..642: note = derived and/or modified sequence opt1 from Vanucizumab_LightChain2
  source 1..642: mol_type = other RNA

SEQ ID NO: 8566 - RNA, 1356 nt, synthetic construct
  misc_feature 1..1356: note = derived and/or modified sequence opt1 from Varlilumab_HeavyChain1
  source 1..1356: mol_type = other RNA
caggtgcagctggtcgagagcggcgggggcgtggtgcagcccgggcgctccctccggctgagctgcgccgcctccggcttcaccttcagctcctacgacatgcactgggtccgccaggcgccggggaagggcctggagtgggtggccgtgatctggtacgacggcagcaacaagtactacgccgactccgtcaaggggcggttcaccatcagccgcgacaactccaagaacacgctctacctgcagatgaacagcctgcgggccgaggacaccgccgtgtactactgcgcgcgcggctccgggaactggggcttcttcgactactgggggcagggcaccctcgtgaccgtcagctccgccagcacgaagggcccctccgtgttccccctggcccccagctccaagagcacctccgggggcaccgccgcgctggggtgcctcgtgaaggactacttcccggagcccgtcaccgtgagctggaacagcggcgccctgacgtccggcgtgcacaccttccccgccgtcctgcagagctccgggctctacagcctgtccagcgtggtgaccgtcccctccagctccctgggcacccagacgtacatctgcaacgtgaaccacaagccgagcaacaccaaggtggacaagaaggtcgagcccaagtcctgcgacaagacccacacgtgcccgccctgcccggcccccgagctcctcgggggccccagcgtgttcctgttcccgcccaagcccaaggacaccctgatgatctcccggacccccgaggtgacctgcgtcgtggtcgacgtgagccacgaggaccccgaggtgaagttcaactggtacgtcgacggggtggaggtgcacaacgccaagaccaagccgcgcgaggagcagtacaactccacgtaccgggtcgtgagcgtgctgaccgtcctgcaccaggactggctcaacggcaaggagtacaagtgcaaggtgtccaacaaggcgctgcccgcccccatcgagaagaccatcagcaaggccaagggccagccccgcgagccccaggtgtacaccctgccgccctcccgggacgagctcacgaagaaccaggtcagcctgacctgcctggtgaaggggttctaccccagcgacatcgccgtggagtgggagtccaacggccagcccgagaacaactacaagaccaccccgcccgtcctcgacagcgacgggtccttcttcctgtacagcaagctgacggtggacaagtcccgctggcagcagggcaacgtgttcagctgctccgtcatgcacgaggccctccacaaccactacacccagaagtccctgagcctgagccccgggaagggctccagc

SEQ ID NO: 8567 - RNA, 642 nt, synthetic construct
  misc_feature 1..642: note = derived and/or modified sequence opt1 from Varlilumab_LightChain1
  source 1..642: mol_type = other RNA
gacatccagatgacccagagcccctccagcctgtccgccagcgtgggcgaccgcgtcaccatcacgtgccgggcctcccaggggatcagccgctggctcgcgtggtaccagcagaagccggagaaggcccccaagtccctgatctacgccgccagctccctgcagagcggcgtgccctcccggttcagcgggtccggcagcgggaccgacttcaccctcaccatctccagcctgcagcccgaggacttcgccacgtactactgccagcagtacaacacctacccgcgcaccttcggccagggcaccaaggtggagatcaagcggacggtcgcggccccctccgtgttcatcttcccgcccagcgacgagcagctgaagtccgggaccgccagcgtggtctgcctcctgaacaacttctacccccgcgaggccaaggtgcagtggaaggtggacaacgcgctgcagagcggcaactcccaggagagcgtcaccgagcaggactccaaggacagcacctactccctcagctccacgctgaccctgagcaaggccgactacgagaagcacaaggtgtacgcctgcgaggtgacccaccaggggctctccagccccgtcaccaagtccttcaaccggggcgagtgc

SEQ ID NO: 8568 - RNA, 1338 nt, synthetic construct
  misc_feature 1..1338: note = derived and/or modified sequence opt1 from Vatelizumab_HeavyChain1
  source 1..1338: mol_type = other RNA
caggtgcagctgcaggagagcggccccgggctcgtcaagccgtccgagaccctgagcctgacctgcacggtgtccggcttcagcctcaccaactacgggatccactggatccgccagccgcccggcaaggggctggagtggctgggcgtgatctgggcccggggcttcaccaactacaactccgccctcatgagccgcctgaccatctccaaggacaacagcaagaaccaggtctccctgaagctcagctccgtgacggcggccgacaccgccgtgtactactgcgcccgggccaacgacggggtctactacgcgatggactactggggccaggggaccctggtgaccgtgagctccgccagcacgaagggcccctccgtcttccccctggccccctgcagccgctccaccagcgagtccaccgccgcgctcgggtgcctggtgaaggactacttccccgagcccgtgaccgtcagctggaacagcggcgccctgacgtccggcgtgcacaccttcccggccgtgctccagagctccgggctgtacagcctgtccagcgtcgtgaccgtgccctccagctccctcggcaccaagacgtacacgtgcaacgtcgaccacaagcccagcaacaccaaggtggacaagcgggtggagtccaagtacgggcccccgtgccccagctgccccgcccccgagttcctgggcggcccgtccgtcttcctgttcccgcccaagcccaaggacaccctcatgatcagccgcacccccgaggtgacctgcgtggtcgtggacgtctcccaggaggaccccgaggtgcagttcaactggtacgtggacggggtcgaggtgcacaacgccaagaccaagccccgggaggagcagttcaacagcacctaccgcgtggtctccgtgctgacggtgctgcaccaggactggctcaacggcaaggagtacaagtgcaaggtcagcaacaaggggctgccctccagcatcgagaagaccatcagcaaggcgaagggccagccgcgggagccccaggtgtacaccctgccgccctcccaggaggagatgaccaagaaccaggtgagcctcacgtgcctggtcaaggggttctacccctccgacatcgccgtggagtgggagagcaacggccagcccgagaacaactacaagaccacgcccccggtgctggactccgacggcagcttcttcctctactcccgcctgaccgtcgacaagagccggtggcaggaggggaacgtgttctcctgcagcgtgatgcacgaggccctgcacaaccactacacccagaagtccctcagcctgtccctgggcaag

SEQ ID NO: 8569 - RNA, 639 nt, synthetic construct
  misc_feature 1..639: note = derived and/or modified sequence opt1 from Vatelizumab_LightChain1
  source 1..639: mol_type = other RNA
gacttcgtgatgacccagagccccgccttcctgtccgtcaccccgggcgagaaggtgacgatcacgtgcagcgcccagtccagcgtgaactacatccactggtaccagcagaagcccgaccaggcgcccaagaagctcatctacgacacctccaagctggccagcggggtcccctcccggttcagcggctccgggagcggcaccgactacaccttcaccatctccagcctggaggccgaggacgccgccacctactactgccagcagtggaccacgaacccgctcaccttcgggcagggcaccaaggtggagatcaagcggaccgtggcggccccctccgtcttcatcttcccgcccagcgacgagcagctgaagtccggcacggccagcgtggtgtgcctgctcaacaacttctacccccgcgaggccaaggtccagtggaaggtggacaacgcgctgcagtccgggaacagccaggagtccgtgaccgagcaggacagcaaggacagcacctactccctgagctccaccctcacgctgagcaaggccgactacgagaagcacaaggtctacgcctgcgaggtgacccaccagggcctgtccagccccgtgaccaagtccttcaaccgcggggagtgc

SEQ ID NO: 8570 - RNA, 1353 nt, synthetic construct
  misc_feature 1..1353: note = derived and/or modified sequence opt1 from Vedolizumab_HeavyChain1
  source 1..1353: mol_type = other RNA
caggtgcagctggtccagagcggcgccgaggtgaagaagcccggggcctccgtgaaggtcagctgcaagggctccgggtacaccttcaccagctactggatgcactgggtgcgccaggcgccgggccagcggctcgagtggatcggggagatcgacccctccgagagcaacacgaactacaaccagaagttcaagggccgcgtgaccctgaccgtcgacatctccgccagcaccgcctacatggagctgtccagcctccggtccgaggacacggccgtgtactactgcgcccgcggcgggtacgacggctgggactacgcgatcgactactgggggcagggcaccctggtgaccgtcagctccgccagcaccaaggggccctccgtgttccccctggccccgagctccaagagcacgtccggcggcaccgccgcgctcgggtgcctggtgaaggactacttccccgagcccgtcaccgtgagctggaacagcggcgccctgacctccggggtgcacacgttccccgccgtcctccagagctccggcctgtacagcctgtccagcgtggtgaccgtcccgtccagctccctcggcacccagacctacatctgcaacgtgaaccacaagcccagcaacacgaaggtggacaagaaggtcgagcccaagtcctgcgacaagacccacacgtgcccgccctgccccgcccccgagctggccggggcgcccagcgtgttcctgttcccgcccaagcccaaggacaccctcatgatctcccggacccccgaggtgacctgcgtcgtggtcgacgtgagccacgaggacccggaggtgaagttcaactggtacgtcgacggcgtggaggtgcacaacgccaagaccaagccccgcgaggagcagtacaactccacctaccgggtcgtgagcgtgctgacggtcctgcaccaggactggctcaacgggaaggagtacaagtgcaaggtgtccaacaaggccctgcccgcccccatcgagaagaccatcagcaaggccaagggccagccgcgcgagccccaggtgtacaccctgccgccctcccgggacgagctcaccaagaaccaggtcagcctgacgtgcctggtgaaggggttctaccccagcgacatcgcggtggagtgggagtccaacggccagcccgagaacaactacaagaccacgcccccggtcctcgacagcgacggctccttcttcctgtacagcaagctgaccgtggacaagtcccgctggcagcaggggaacgtgttcagctgctccgtcatgcacgaggccctccacaaccactacacccagaagtccctgagcctgagccccggcaag

SEQ ID NO: 8571 - RNA, 657 nt, synthetic construct
  misc_feature 1..657: note = derived and/or modified sequence opt1 from Vedolizumab_LightChain1
  source 1..657: mol_type = other RNA
gacgtggtcatgacccagagccccctgtccctcccggtgacccccggcgagcccgccagcatctcctgccgcagctcccagagcctggccaagtcctacgggaacacgtacctgagctggtacctccagaagcccggccagtccccgcagctgctgatctacgggatcagcaaccggttctccggcgtgcccgaccgcttcagcgggtccggcagcggcaccgacttcaccctcaagatctcccgggtcgaggcggaggacgtgggggtgtactactgcctgcagggcacccaccagccctacacgttcgggcagggcaccaaggtcgagatcaagcgcaccgtggccgcccccagcgtgttcatcttcccgccctccgacgagcagctcaagagcgggaccgcctccgtcgtgtgcctgctgaacaacttctacccccgggaggccaaggtgcagtggaaggtcgacaacgcgctgcagagcggcaacagccaggagtccgtgacggagcaggacagcaaggactccacctacagcctctccagcaccctgaccctgtccaaggccgactacgagaagcacaaggtgtacgcctgcgaggtcacgcaccagggcctcagctcccccgtgaccaagagcttcaaccgcggggagtgc

SEQ ID NO: 8572 - RNA, 1353 nt, synthetic construct
  misc_feature 1..1353: note = derived and/or modified sequence opt1 from Veltuzumab_HeavyChain1
  source 1..1353: mol_type = other RNA
caggtgcagctgcagcagagcggcgccgaggtcaagaagcccgggtccagcgtgaaggtgtcctgcaaggccagcggctacaccttcacctcctacaacatgcactgggtcaagcaggcgccggggcagggcctcgagtggatcggggccatctaccccggcatgggcgacaccagctacaaccagaagttcaaggggaaggccaccctgaccgccgacgagtccaccaacacggcctacatggagctgagctccctccgcagcgaggacaccgcgttctactactgcgcccggtccacctactacggcggggactggtacttcgacgtgtggggccaggggaccacggtgaccgtcagctccgccagcaccaagggcccctccgtgttccccctggccccgagctccaagagcacctccggcgggacggcggccctgggctgcctcgtgaaggactacttccccgagcccgtcaccgtgagctggaacagcggggccctgacctccggcgtgcacaccttccccgccgtcctgcagagctccggcctctacagcctgtccagcgtggtgacggtcccgtccagctccctggggacccagacctacatctgcaacgtgaaccacaagcccagcaacaccaaggtggacaagcgcgtcgagcccaagtcctgcgacaagacgcacacgtgcccgccctgccccgcccccgagctcctgggcgggcccagcgtgttcctgttcccgcccaagcccaaggacaccctcatgatctcccggacccccgaggtgacctgcgtcgtggtggacgtcagccacgaggacccggaggtgaagttcaactggtacgtcgacggcgtggaggtgcacaacgcgaagaccaagccccgcgaggagcagtacaactccacctaccgggtcgtgagcgtgctgaccgtcctgcaccaggactggctcaacgggaaggagtacaagtgcaaggtgtccaacaaggccctgcccgcccccatcgagaagacgatcagcaaggccaagggccagccgcgcgagccccaggtgtacaccctgccgccctcccgggaggagatgaccaagaaccaggtcagcctgacctgcctcgtgaagggcttctaccccagcgacatcgccgtggagtgggagtccaacgggcagcccgagaacaactacaagacgacgcccccggtcctggacagcgacggctccttcttcctctacagcaagctgaccgtggacaagtcccgctggcagcaggggaacgtgttcagctgctccgtcatgcacgaggcgctgcacaaccactacacccagaagtccctcagcctgagccccggcaag

SEQ ID NO: 8573 - RNA, 639 nt, synthetic construct
  misc_feature 1..639: note = derived and/or modified sequence opt1 from Veltuzumab_LightChain1
  source 1..639: mol_type = other RNA
gacatccagctgacccagagcccctccagcctctccgccagcgtgggcgaccgggtcaccatgacgtgccgggcctccagctccgtgagctacatccactggttccagcagaagcccgggaaggcgcccaagccctggatctacgccacctccaacctggccagcggcgtgcccgtccgcttctccgggagcggctccgggaccgactacaccttcacgatcagctccctgcagccggaggacatcgccacctactactgccagcagtggaccagcaacccgcccaccttcggcggcgggacgaagctcgagatcaagcggaccgtggccgcgccctccgtgttcatcttcccgcccagcgacgagcagctgaagtccggcaccgccagcgtcgtgtgcctgctcaacaacttctacccccgcgaggccaaggtgcagtggaaggtcgacaacgccctgcagagcgggaactcccaggagagcgtgaccgagcaggactccaaggacagcacgtactccctgagctccaccctcaccctgagcaaggcggactacgagaagcacaaggtgtacgcctgcgaggtcacccaccagggcctgtccagccccgtgacgaagtccttcaaccgcggggagtgc

SEQ ID NO: 8574 - RNA, 1359 nt, synthetic construct
  misc_feature 1..1359: note = derived and/or modified sequence opt1 from Vesencumab_HeavyChain1
  source 1..1359: mol_type = other RNA
gaggtgcagctggtcgagagcggcgggggcctcgtgcagcccgggggctccctgcgcctgagctgcgccgcctccgggttcaccttcagctcctacgcgatgagctgggtgcggcaggccccgggcaagggcctcgagtgggtctcccagatcagccccgccgggggctacaccaactacgccgactccgtgaaggggcgcttcacgatcagcgccgacacctccaagaacaccgcgtacctgcagatgaacagcctgcgggccgaggacaccgccgtgtactactgcgcccgcggcgagctcccctactaccggatgtccaaggtcatggacgtgtgggggcagggcacgctggtgaccgtcagctccgcgagcaccaagggcccctccgtgttcccgctggcccccagctccaagagcaccagcgggggcacggccgccctcgggtgcctggtgaaggactacttccccgagcccgtcaccgtgtcctggaacagcggcgccctgacctccggcgtgcacaccttcccggcggtcctccagagctccgggctgtacagcctgtccagcgtggtgacggtcccctccagctccctcggcacccagacctacatctgcaacgtgaaccacaagcccagcaacaccaaggtggacaagaaggtcgagcccaagtcctgcgacaagacgcacacgtgcccgccctgccccgcccccgagctgctcgggggcccgagcgtgttcctcttcccgcccaagcccaaggacaccctgatgatctcccgcacccccgaggtgacctgcgtcgtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggccctgcccgccccgatcgagaagacgatcagcaaggcgaagggccagccccgggagccccaggtgtacaccctgcccccgagccgcgaggagatgaccaagaaccaggtctccctgacctgcctggtgaaggggttctaccccagcgacatcgccgtggagtgggagtccaacggccagcccgagaacaactacaagacgaccccgcccgtcctcgacagcgacgggtccttcttcctgtacagcaagctgaccgtggacaagtcccggtggcagcagggcaacgtgttcagctgctccgtcatgcacgaggccctccacaaccactacacccagaagtccctgagcctgagccccgggaag

SEQ ID NO: 8575 - RNA, 642 nt, synthetic construct
  misc_feature 1..642: note = derived and/or modified sequence opt1 from Vesencumab_LightChain1
  source 1..642: mol_type = other RNA
gacatccagatgacccagagcccctccagcctgtccgccagcgtgggcgaccgcgtcaccatcacgtgccgggcctcccagtacttcagctcctacctcgcgtggtaccagcagaagccggggaaggcccccaagctgctgatctacggcgccagctcccgcgccagcggggtgccctcccggttcagcggctccgggagcggcaccgacttcaccctcaccatctccagcctgcagcccgaggacttcgccacgtactactgccagcagtacctgggctccccgcccaccttcgggcagggcaccaaggtggagatcaagcgcaccgtcgcggcccccagcgtgttcatcttcccgccctccgacgagcagctcaagagcgggacggccagcgtggtctgcctgctgaacaacttctacccccgggaggccaaggtgcagtggaaggtggacaacgcgctccagtccggcaacagccaggagtccgtcaccgagcaggacagcaaggactccacctacagcctgtccagcaccctgacgctctccaaggccgactacgagaagcacaaggtgtacgcctgcgaggtgacccaccaggggctgagctcccccgtcaccaagagcttcaaccgcggcgagtgc

SEQ ID NO: 8576 - RNA, 1338 nt, synthetic construct
  misc_feature 1..1338: note = derived and/or modified sequence opt1 from Visilizumab_HeavyChain1
  source 1..1338: mol_type = other RNA
caggtgcagctggtccagagcggcgccgaggtgaagaagcccggggcctccgtgaaggtcagctgcaaggcgtccggctacaccttcatcagctacaccatgcactgggtgcgccaggccccggggcagggcctcgagtggatggggtacatcaacccccggtccggctacacgcactacaaccagaagctgaaggacaaggccaccctgaccgccgacaagagcgcctccaccgcgtacatggagctcagctccctgcgcagcgaggacacggccgtgtactactgcgcccggtccgcctactacgactacgacggcttcgcgtactgggggcagggcaccctggtcaccgtgagctccgccagcaccaaggggccctccgtgttccccctcgccccgtgcagccgctccacgagcgagtccaccgccgccctgggctgcctggtcaaggactacttccccgagcccgtgaccgtgagctggaacagcggggcgctcacctccggcgtccacacgttccccgccgtgctgcagagctccggcctgtacagcctctccagcgtggtcaccgtgccgtccagcaacttcgggacccagacctacacgtgcaacgtggaccacaagccctccaacaccaaggtcgacaagaccgtggagcggaagtgctgcgtggagtgcccgccctgccccgccccgcccgccgccgcgcccagcgtcttcctgttcccgcccaagcccaaggacaccctgatgatctcccgcacgcccgaggtgacctgcgtggtcgtggacgtcagccacgaggaccccgaggtgcagttcaactggtacgtggacggcgtcgaggtgcacaacgccaagaccaagccccgggaggagcagttcaactccaccttccgcgtggtcagcgtgctcacggtggtccaccaggactggctgaacgggaaggagtacaagtgcaaggtgtccaacaagggcctgcccgcccccatcgagaagaccatcagcaagaccaagggccagccgcgggagccccaggtgtacaccctcccgccctcccgcgaggagatgacgaagaaccaggtcagcctgacctgcctggtgaaggggttctacccctccgacatcgccgtggagtgggagagcaacggccagcccgagaacaactacaagaccacgcccccgatgctcgacagcgacgggtccttcttcctgtacagcaagctgaccgtcgacaagtcccggtggcagcagggcaacgtgttcagctgctccgtgatgcacgaggccctccacaaccactacacccagaagtccctgagcctgagcccctccaag

SEQ ID NO: 8577 - RNA, 639 nt, synthetic construct
  misc_feature 1..639: note = derived and/or modified sequence opt1 from Visilizumab_LightChain1
  source 1..639: mol_type = other RNA
gacatccagatgacccagagcccctccagcctgtccgccagcgtgggcgaccgggtcaccatcacgtgctccgccagctccagcgtgtcctacatgaactggtaccagcagaagccggggaaggcgcccaagcggctcatctacgacaccagcaagctggcctccggcgtgcccagccgcttctccgggagcggctccgggaccgacttcaccctgacgatcagctccctccagcccgaggacttcgccacctactactgccagcagtggagctccaacccgcccaccttcggcggcgggaccaaggtcgagatcaagcggacggtggccgcccccagcgtgttcatcttcccgcccagcgacgagcagctgaagtccggcaccgcgagcgtcgtgtgcctgctcaacaacttctacccccgcgaggccaaggtgcagtggaaggtcgacaacgccctgcagtccgggaacagccaggagtccgtgaccgagcaggacagcaaggactccacctacagcctgtccagcacgctcaccctgtccaaggccgactacgagaagcacaaggtgtacgcgtgcgaggtcacccaccagggcctgagctcccccgtgaccaagagcttcaaccgcggggagtgc

SEQ ID NO: 8578 - RNA, 1353 nt, synthetic construct
  misc_feature 1..1353: note = derived and/or modified sequence opt1 from Volociximab_HeavyChain
  source 1..1353: mol_type = other RNA
caggtgcagctgaaggagagcggccccgggctcgtcgccccgtcccagagcctgtccatcacgtgcaccatcagcggcttctccctgaccgactacggggtgcactgggtgcgccagccgcccggcaaggggctcgagtggctggtcgtgatctggagcgacggctccagcacctacaactccgccctcaagagccggatgaccatccgcaaggacaactccaagagccaggtgttcctgatcatgaactccctgcagaccgacgacagcgcgatgtactactgcgcccggcacggcacgtactacgggatgaccaccaccggcgacgccctggactactgggggcagggcacgtccgtcaccgtgagctccgccagcaccaaggggccctccgtgttccccctcgccccctgcagccgcagcacctccgagagcacggcggccctgggctgcctggtcaaggactacttccccgagcccgtgaccgtgtcctggaacagcggcgccctcacctccggggtccacaccttcccggccgtgctgcagagctccggcctgtacagcctctccagcgtggtcacggtgccctccagctccctggggaccaagacctacacgtgcaacgtggaccacaagcccagcaacaccaaggtcgacaagcgggtggagtccaagtacgggcccccgtgccccagctgccccgcgcccgagttcctgggcggcccgtccgtgttcctcttcccgcccaagcccaaggacaccctgatgatcagccgcacccccgaggtgacctgcgtcgtggtcgacgtgtcccaggaggaccccgaggtccagttcaactggtacgtggacggcgtggaggtccacaacgccaagacgaagccccgggaggagcagttcaacagcacctaccgcgtggtgagcgtcctgaccgtgctccaccaggactggctgaacgggaaggagtacaagtgcaaggtgtccaacaagggcctgcccagctccatcgagaagaccatcagcaaggccaaggggcagccgcgggagccccaggtctacacgctcccgccctcccaggaggagatgaccaagaaccaggtgagcctgacctgcctggtgaagggcttctacccctccgacatcgccgtcgagtgggagagcaacggccagcccgagaacaactacaagaccacgcccccggtgctcgactccgacgggagcttcttcctgtactcccgcctgaccgtggacaagagccggtggcaggagggcaacgtcttctcctgcagcgtgatgcacgaggccctccacaaccactacacccagaagtccctgagcctgtccctcgggaag

SEQ ID NO: 8579 - RNA, 645 nt, synthetic construct
  misc_feature 1..645: note = derived and/or modified sequence opt1 from Volociximab_LightChain
  source 1..645: mol_type = other RNA
cagatcgtgctgacccagagccccgccatcatgtccgccagcctcggcgagcgggtcaccatgacgtgcaccgcgtccagctccgtgagctccaactacctgcactggtaccagcagaagccggggagcgcccccaacctgtggatctactccaccagcaacctcgcctccggcgtgcccgcccggttcagcgggtccggcagcgggacctcctacagcctgacgatctccagcatggaggccgaggacgcggccacctactactgccaccagtacctgcgctccccgcccaccttcggcggcgggaccaagctcgagatcaagcggacggtcgccgcccccagcgtgttcatcttcccgcccagcgacgagcagctgaagtccggcaccgcgagcgtggtctgcctgctcaacaacttctacccccgcgaggccaaggtgcagtggaaggtggacaacgccctgcagtccgggaacagccaggagtccgtcaccgagcaggacagcaaggactccacctacagcctgtccagcacgctcaccctgtccaaggccgactacgagaagcacaaggtgtacgcctgcgaggtgacccaccagggcctgagctcccccgtcaccaagagcttcaaccgcggggagtgc

SEQ ID NO: 8580 - RNA, 1344 nt, synthetic construct
  misc_feature 1..1344: note = derived and/or modified sequence opt1 from Vorsetuzumab_HeavyChain1
  source 1..1344: mol_type = other RNA
caggtgcagctggtccagagcggcgccgaggtgaagaagcccggggcctccgtgaaggtcagctgcaaggcgtccggctacaccttcaccaactacgggatgaactgggtgcgccaggccccgggccaggggctcaagtggatgggctggatcaacacgtacaccggcgagcccacctacgccgacgccttcaaggggcgggtgaccatgacgcgcgacaccagcatctccaccgcctacatggagctgagccggctgcgctccgacgacaccgcggtctactactgcgcccgggactacggcgactacgggatggactactggggccaggggacgaccgtgaccgtgagctccgccagcaccaagggcccctccgtcttccccctcgccccgagctccaagagcacgtccggcgggaccgcggccctgggctgcctggtgaaggactacttccccgagcccgtgaccgtcagctggaactccggggccctcaccagcggcgtgcacacgttccccgccgtgctgcagtccagcggcctgtacagcctctccagcgtcgtgaccgtgccgtccagctccctggggacccagacctacatctgcaacgtcaaccacaagcccagcaacacgaaggtggacaagaaggtggagcccaagtcctgcgacaagacccacacgtgcccgccctgccccgcccccgagctgctcggcgggcccagcgtcttcctgttcccgcccaagcccaaggacaccctgatgatctcccgcacccccgaggtgacctgcgtggtcgtggacgtcagccacgaggacccggaggtgaagttcaactggtacgtggacggcgtcgaggtgcacaacgcgaagaccaagccccgggaggagcagtacaactccacctaccgcgtggtcagcgtgctcacggtgctgcaccaggactggctgaacgggaaggagtacaagtgcaaggtctccaacaaggccctccccgcccccatcgagaagaccatcagcaaggccaagggccagccgcgggagccccaggtgtacaccctgccgccctcccgcgacgagctgaccaagaaccaggtgagcctcacgtgcctggtcaagggcttctacccctccgacatcgccgtggagtgggagagcaacgggcagcccgagaacaactacaagaccacgcccccggtgctggactccgacggcagcttcttcctctacagcaagctgaccgtcgacaagtcccggtggcagcaggggaacgtgttcagctgctccgtgatgcacgaggcgctgcacaaccactacacccagaagtccctcagcctgagccccggcaag

SEQ ID NO: 8581 - RNA, 654 nt, synthetic construct
  misc_feature 1..654: note = derived and/or modified sequence opt1 from Vorsetuzumab_LightChain1
  source 1..654: mol_type = other RNA
gacatcgtgatgacccagagccccgactccctggccgtcagcctcggcgagcgcgccaccatcaactgccgggcgtccaagagcgtgtccacgagcgggtactccttcatgcactggtaccagcagaagccgggccagccgcccaagctgctgatctacctcgccagcaacctggagtccggggtgcccgaccgcttcagcggctccgggagcggcaccgacttcaccctgaccatctccagcctccaggccgaggacgtcgccgtgtactactgccagcactcccgggaggtgccctggacgttcggccaggggaccaaggtcgagatcaagcgcaccgtggccgcgcccagcgtgttcatcttcccgccctccgacgagcagctcaagagcggcaccgcctccgtcgtgtgcctgctgaacaacttctacccccgggaggccaaggtgcagtggaaggtcgacaacgccctgcagagcgggaacagccaggagtccgtgacggagcaggacagcaaggactccacctacagcctgtccagcaccctcaccctgtccaaggcggactacgagaagcacaaggtgtacgcctgcgaggtcacgcaccagggcctgagctcccccgtgaccaagagcttcaaccgcggggagtgc

SEQ ID NO: 8582 - RNA, 1344 nt, synthetic construct; identical to SEQ ID NO: 8580
  misc_feature 1..1344: note = derived and/or modified sequence opt1 from Vorsetuzumab_mafodotin_HeavyChain1
  source 1..1344: mol_type = other RNA

SEQ ID NO: 8583 - RNA, 654 nt, synthetic construct; identical to SEQ ID NO: 8581
  misc_feature 1..654: note = derived and/or modified sequence opt1 from Vorsetuzumab_mafodotin_LightChain1
  source 1..654: mol_type = other RNA

SEQ ID NO: 8584 - RNA, 1347 nt, synthetic construct; identical to SEQ ID NO: 7806
  misc_feature 1..1347: note = derived and/or modified sequence opt1 from Yttrium_(90Y)_clivatuzumab_tetraxetan_HeavyChain1
  source 1..1347: mol_type = other RNA

SEQ ID NO: 8585 - RNA, 645 nt, synthetic construct; identical to SEQ ID NO: 7807
  misc_feature 1..645: note = derived and/or modified sequence opt1 from Yttrium_(90Y)_clivatuzumab_tetraxetan_LightChain1
  source 1..645: mol_type = other RNA

SEQ ID NO: 8586 - RNA, 1338 nt, synthetic construct
  misc_feature 1..1338: note = derived and/or modified sequence opt1 from Yttrium_Y_90_epratuzumab_tetraxetan_HeavyChain1
  source 1..1338: mol_type = other RNA
caggtgcagctggtccagagcggcgccgaggtgaagaagcccgggtccagcgtgaaggtctcctgcaaggccagcggctacaccttcacctcctactggctccactgggtgcgccaggcgccggggcagggcctggagtggatcgggtacatcaacccccggaacgactacacggagtacaaccagaacttcaaggacaaggccaccatcaccgccgacgagagcaccaacacggcctacatggagctgtccagcctccgctccgaggacaccgccttctacttctgcgcgcggcgcgacatcaccaccttctactggggccagggcacgaccgtgaccgtcagctccgccagcaccaaggggccctccgtgttccccctggccccgagctccaagagcacgtccggcgggaccgccgcgctgggctgcctcgtgaaggactacttccccgagcccgtcaccgtgagctggaactccggggccctgaccagcggcgtgcacacgttccccgccgtcctgcagagctccggcctctacagcctgtccagcgtggtgaccgtcccgtccagctccctggggacccagacctacatctgcaacgtgaaccacaagcccagcaacacgaaggtggacaagcgggtcgagcccaagtcctgcgacaagacccacacgtgcccgccctgccccgcccccgagctcctgggcgggcccagcgtgttcctgttcccgcccaagcccaaggacaccctcatgatctcccgcacccccgaggtgacctgcgtcgtggtggacgtcagccacgaggacccggaggtgaagttcaactggtacgtcgacggcgtggaggtgcacaacgccaagaccaagccccgggaggagcagtacaactccacctaccgcgtcgtgagcgtgctgacggtcctgcaccaggactggctcaacggcaaggagtacaagtgcaaggtgtccaacaaggcgctgcccgcccccatcgagaagaccatcagcaaggccaaggggcagccgcgggagccccaggtgtacaccctgccgccctcccgcgaggagatgaccaagaaccaggtcagcctcacgtgcctggtgaagggcttctacccctccgacatcgccgtggagtgggagagcaacgggcagcccgagaacaactacaagaccacgcccccggtcctggacagcgacggctccttcttcctctacagcaagctgaccgtggacaagtcccggtggcagcaggggaacgtgttcagctgctccgtcatgcacgaggccctgcacaaccactacacccagaagtccctcagcctgagccccggcaag

SEQ ID NO: 8587 - RNA, 657 nt, synthetic construct
  misc_feature 1..657: note = derived and/or modified sequence opt1 from Yttrium_Y_90_epratuzumab_tetraxetan_LightChain1
  source 1..657: mol_type = other RNA
gacatccagctgacccagagcccctccagcctctccgccagcgtgggcgaccgggtcaccatgtcctgcaagagctcccagagcgtgctgtactccgccaaccacaagaactacctggcgtggtaccagcagaagccggggaaggcccccaagctcctgatctactgggccagcacgcgggagtccggcgtgcccagccgcttctccgggagcggctccgggaccgacttcaccttcaccatcagctccctgcagcccgaggacatcgccacgtactactgccaccagtacctcagctcctggaccttcggcggcgggaccaaggtccagatcaagcggaccgtggccgcgccgagcgtgttcatcttcccgcccagcgacgagcagctgaagtccggcacggccagcgtcgtgtgcctgctcaacaacttctacccccgcgaggccaaggtgcagtggaaggtcgacaacgccctgcagtccgggaacagccaggagtccgtgaccgagcaggacagcaaggactccacctacagcctgtccagcaccctcacgctgtccaaggcggactacgagaagcacaaggtgtacgcctgcgaggtcacccaccagggcctgagctcccccgtgaccaagagcttcaaccgcggggagtgc

SEQ ID NO: 8588 - RNA, 1326 nt, synthetic construct
  misc_feature 1..1326: note = derived and/or modified sequence opt1 from Yttrium_Y_90_epratuzumab_HeavyChain1
  source 1..1326: mol_type = other RNA
caggtgcagctggtccagagcggcgccgaggtgaagaagcccgggtccagcgtgaaggtctcctgcaaggccagcggctacaccttcacctcctactggctccactgggtgcgccaggcgccggggcagggcctggagtggatcgggtacatcaacccccggaacgactacacggagtacaaccagaacttcaaggacaaggccaccatcaccgccgacgagagcaccaacacggcctacgagctgtccagcctccgctccgaggacaccgccttctacttctgcgcgcggcgcgacatcaccaccttctactggggccagggcacgaccgtgaccgtcagctccgccagcaccaaggggccctccgtgttccccctggccccgagctccaagagcacgtccggcgggaccgccgcgctgggctgcctcgtgaaggactacttccccgagcccgtcaccgtgagctggaactccggggccctgaccagcggcgtgcacacgttccccgccgtcctgcagagctccggcctctacagcctgtccagcgtggtgaccgtcccgtccagctccctggggacccagacctacatctgcaacgtgaaccacaagcccagcaacacgaaggtggacaagcgggtcgagcccaagtcctgcgacaagacccacacgtgcccgccctgccccgcccccgagctcctgggcgggcccagcgtgttcctgttcccgcccaagcccaaggacaccctcatctcccgcacccccgaggtgacctgcgtcgtggtggacgtcagccacgaggacccggaggtgaagttcaactggtacgtcgacggcgtggaggtgcacaacgccaagaccaagccccgggaggagcagtacaactccacctaccgcgtcgtgagcgtgctgacggtcctgcaccaggactggctcaacggcaaggagtacaagtgcaaggtgtccaacaaggcgctgcccgcccccatcgagaagaccatcagcaaggccaaggggcagccgcgggagccccaggtgtacaccctgccgccctcccgcgaggagaccaagaaccaggtcagcctcacgtgcctggtgaagggcttctacccctccgacatcgccgtggagtgggagagcaacgggcagcccgagaacaactacaagaccacgcccccggtcctggacagcgacggctccttcttcctctacagcaagctgaccgtggacaagtcccggtggcagcaggggaacgtgttcagctgctccgtccacgaggccctgcacaaccactacacccagaagtccctcagcctgagccccggcaag

SEQ ID NO: 8589 - RNA, 654 nt, synthetic construct
  misc_feature 1..654: note = derived and/or modified sequence opt1 from Yttrium_Y_90_epratuzumab_LightChain1
  source 1..654: mol_type = other RNA
gacatccagctgacccagagcccctccagcctctccgccagcgtgggcgaccgggtcacctcctgcaagagctcccagagcgtgctgtactccgccaaccacaagaactacctggcgtggtaccagcagaagccggggaaggcccccaagctcctgatctactgggccagcacgcgggagtccggcgtgcccagccgcttctccgggagcggctccgggaccgacttcaccttcaccatcagctccctgcagcccgaggacatcgccacgtactactgccaccagtacctcagctcctggaccttcggcggcgggaccaaggtccagatcaagcggaccgtggccgcgccgagcgtgttcatcttcccgcccagcgacgagcagctgaagtccggcacggccagcgtcgtgtgcctgctcaacaacttctacccccgcgaggccaaggtgcagtggaaggtcgacaacgccctgcagtccgggaacagccaggagtccgtgaccgagcaggacagcaaggactccacctacagcctgtccagcaccctcacgctgtccaaggcggactacgagaagcacaaggtgtacgcctgcgaggtcacccaccagggcctgagctcccccgtgaccaagagcttcaaccgcggggagtgc

SEQ ID NO: 8590 - RNA, 1365 nt, synthetic construct
  misc_feature 1..1365: note = derived and/or modified sequence opt1 from Zalutumumab_HeavyChain1
  source 1..1365: mol_type = other RNA
caggtgcagctggtcgagagcggcgggggcgtggtgcagcccgggcgctccctccggctgagctgcgccgcctccggcttcaccttcagcacctacgggatgcactgggtccgccaggcgccgggcaagggcctggagtgggtggccgtgatctgggacgacgggtcctacaagtactacggcgacagcgtcaaggggcggttcacgatctcccgcgacaacagcaagaacaccctctacctgcagatgaactccctgcgggccgaggacaccgccgtgtactactgcgcccgcgacggcatcaccatggtgcgcggggtcatgaaggactacttcgactactggggccagggcacgctcgtgaccgtgagctccgcgagcaccaaggggccctccgtcttccccctggcccccagctccaagagcacctccggcgggacggccgccctgggctgcctcgtgaaggactacttcccggagcccgtgaccgtcagctggaactccggcgcgctgaccagcggggtgcacaccttccccgccgtgctgcagagctccggcctctacagcctgtccagcgtcgtgacggtgccctccagctccctggggacccagacctacatctgcaacgtcaaccacaagccgagcaacaccaaggtggacaagcgggtggagcccaagtcctgcgacaagacgcacacgtgcccgccctgcccggcccccgagctcctgggcgggcccagcgtcttcctgttcccgcccaagcccaaggacaccctcatgatctcccggacccccgaggtgacctgcgtcgtggtggacgtcagccacgaggaccccgaggtgaagttcaactggtacgtggacggcgtcgaggtgcacaacgccaagaccaagccgcgcgaggagcagtacaactccacctaccgggtggtcagcgtgctgaccgtgctgcaccaggactggctcaacggcaaggagtacaagtgcaaggtctccaacaaggccctgcccgcgcccatcgagaagacgatcagcaaggccaaggggcagccccgcgagccccaggtgtacaccctgccgccctcccgggaggagatgaccaagaaccaggtgagcctgacctgcctcgtcaagggcttctacccctccgacatcgccgtggagtgggagagcaacgggcagcccgagaacaactacaagacgaccccgcccgtgctggacagcgacggctccttcttcctctacagcaagctgaccgtcgacaagtcccgctggcagcaggggaacgtgttcagctgctccgtgatgcacgaggccctgcacaaccactacacccagaagtccctcagcctgagccccggcaag

SEQ ID NO: 8591 - RNA, 642 nt, synthetic construct
  misc_feature 1..642: note = derived and/or modified sequence opt1 from Zalutumumab_LightChain1
  source 1..642: mol_type = other RNA
gccatccagctgacccagagcccctccagcctctccgccagcgtgggcgaccgcgtcaccatcacgtgccgggcgtcccaggacatcagctccgccctggtgtggtaccagcagaagccggggaaggcccccaagctgctcatctacgacgccagctccctggagagcggcgtgccctcccgcttcagcgggtccgagagcggcaccgacttcaccctgaccatctccagcctccagcccgaggacttcgccacgtactactgccagcagttcaactcctacccgctgaccttcgggggcggcaccaaggtcgagatcaagcggaccgtggcggcccccagcgtgttcatcttcccgccctccgacgagcagctcaagagcgggacggccagcgtcgtgtgcctgctgaacaacttctacccccgcgaggccaaggtgcagtggaaggtcgacaacgcgctgcagtccggcaacagccaggagtccgtgaccgagcaggacagcaaggactccacctacagcctctccagcaccctgacgctgtccaaggccgactacgagaagcacaaggtgtacgcctgcgaggtcacccaccaggggctcagctcccccgtgaccaagagcttcaaccggggcgagtgc

SEQ ID NO: 8592 - RNA, 1332 nt, synthetic construct
  misc_feature 1..1332: note = derived and/or modified sequence opt1 from Zanolimumab_H0_HeavyChain
  source 1..1332: mol_type = other RNA
caggtgcagctgcagcagtggggcgccgggctcctgaagcccagcgagaccctgtccctgacctgcgccgtctacggcgggagcttctccggctactactggagctggatccgccagccgcccgggaagggcctggagtggatcggcgagatcaaccactccgggagcacgaactacaacccctccctcaagagccgggtgaccatctccgtggacaccagcaagaaccagttctccctcaagctgagctccgtcaccgcggccgacacggccgtgtactactgcgcccgcgtgatcaactggttcgacccctggggccaggggaccctggtcaccgtgagctccgccagcaccaagggcccctccgtgttccccctcgcgcccagctccaagagcacgagcgggggcaccgccgccctgggctgcctggtcaaggactacttccccgagccggtgaccgtgtcctggaacagcggggccctcacctccggcgtccacacgttccccgcggtgctgcagagctccgggctgtacagcctctccagctggaccgtgccctccagctccctgggcacccagacctacatctgcaacgtcaacttcatcaagcccagcaacacgaaggtggacaagaaggtggagccgaagtcctgcgacaagacccacacgtgcccgccctgccccgcccccgagctgctcggcgggcccagcgtcttcctgttcccgcccaagcccaaggacaccctgatgatctcccggacccccgaggtgacctgcgtgtgggacgtcagccacgaggaccccgaggtgaagttcaactggtacgtggacggcgtcgaggtgcacaacgccaagaccaagccccgcgaggagcagtacaactccacctaccgggtcgtgagcgtgctcacggtcctgcaccaggactggctgaacgggaaggagtacaagtgcaaggtgtccaacaaggccctcccggcccccatcgagaagaccatcagcaaggcgaagggccagccccgcgagccccaggtgtacaccctgccgcccagccgggaggagatgaccaagaaccaggtctccctgacgtgcctcgtgaaggggttctaccccagcgacatcgccgtggagtgggagtccaacggccagccggagaacaactacaagaccaccccgcccgtcctggacagcgacggctccttcttcctgtacagcaagctcaccgtggacaagtcccgctggcagcaggggaacgtgttcagctgctccgtcatgcacgaggccctgcacaaccactacacgcagaagtccctgagcctcagccccggcaag

SEQ ID NO: 8593 - RNA, 642 nt, synthetic construct
  misc_feature 1..642: note = derived and/or modified sequence opt1 from Zanolimumab_L0_LightChain
  source 1..642: mol_type = other RNA
gacatccagatgacccagagcccctccagcgtgtccgccagcgtcggcgaccgggtgaccatcacgtgccgggcctcccaggacatcagctcctggctggcggtggtctaccagcacaagccggggaaggcccccaagctcctgatctacgccgccagctccctgcagagcggcgtgccctcccgcttcagcgggtccggcagcgggaccgacttcaccctcaccatctccagcctgcagcccgaggacttcgccacgtactactgccagcaggcgaactccttcccgtacaccttcggcggcgggaccaagctggagatcaagcggaccgtggccgcccccagcgtcttcatcttcccgccctccgacgagcagctcaagagcggcacggccagcgtggtgtgcctgctgaacaacttctacccccgcgaggcgaaggtccagtggaaggtggacaacgccctccagtccgggaacagccaggagtccgtgaccgagcaggacagcaaggactccacctacagcctgtccagcaccctgacgctctccaaggccgactacgagaagcacaaggtctacgcctgcgaggtgacccaccagggcctgagctcccccgtgaccaagttcaaccgcggggagtgc

SEQ ID NO: 8594 - RNA, 1344 nt, synthetic construct; identical to SEQ ID NO: 8213
  misc_feature 1..1344: note = derived and/or modified sequence opt1 from Zatuximab_HeavyChain1
  source 1..1344: mol_type = other RNA

SEQ ID NO: 8595 - RNA, 657 nt, synthetic construct; identical to SEQ ID NO: 8214
  misc_feature 1..657: note = derived and/or modified sequence opt1 from Zatuximab_LightChain1
  source 1..657: mol_type = other RNA

SEQ ID NO: 8596 - RNA, 1356 nt, synthetic construct
  misc_feature 1..1356: note = derived and/or modified sequence opt1 from Actoxumab_HeavyChain
  source 1..1356: mol_type = other RNA
caggtgcagctggtcgagagcggcgggggcgtggtgcagcccgggcgctccctccggctgagctgcgccgcctccggcttcagcttctccaactacgggatgcactgggtccgccaggcgccgggcaagggcctggagtgggtggccctcatctggtacgacgggagcaacgaggactacaccgactccgtgaagggccggttcaccatcagccgcgacaactccaagaacacgctgtacctgcagatgaacagcctccgggccgaggacaccgccgtctactactgcgcccgctgggggatggtgcggggcgtgatcgacgtcttcgacatctgggggcagggcaccgtggtgaccgtctccagcgcgtccacgaagggccccagcgtgttccccctggccccctccagcaagtccaccagcgggggcaccgccgccctggggtgcctcgtgaaggactacttcccggagcccgtcaccgtgtcctggaacagcggcgcgctgacgagcggcgtgcacaccttccccgccgtcctgcagtccagcgggctctactccctgagctccgtggtgaccgtccccagctccagcctgggcacccagacgtacatctgcaacgtgaaccacaagccgtccaacaccaaggtggacaagcgcgtcgagcccaagagctgcgacaagacccacacgtgcccgccctgcccggcccccgagctcctcgggggcccctccgtgttcctgttcccgcccaagcccaaggacaccctcatgatcagccggacccccgaggtgacctgcgtcgtggtcgacgtgtcccacgaggaccccgaggtgaagttcaactggtacgtcgacggggtggaggtgcacaacgccaagaccaagccgcgcgaggagcagtacaacagcacgtaccgggtcgtgtccgtgctgaccgtcctgcaccaggactggctcaacggcaaggagtacaagtgcaaggtgagcaacaaggccctgcccgcgcccatcgagaagaccatctccaaggccaagggccagccccgcgagccccaggtgtacaccctgccgcccagccgggaggagatgacgaagaaccaggtctccctgacctgcctggtgaaggggttctaccccagcgacatcgccgtggagtgggagagcaacggccagcccgagaacaactacaagaccaccccgcccgtcctggactccgacgggagcttcttcctctactccaagctgacggtggacaagagccgctggcagcagggcaacgtgttctcctgcagcgtcatgcacgaggccctgcacaaccactacacccagaagtccctcagcctgtcccccgggaag

SEQ ID NO: 8597 - RNA, 642 nt, synthetic construct
  misc_feature 1..642: note = derived and/or modified sequence opt1 from Actoxumab_LightChain
  source 1..642: mol_type = other RNA
gacatccagatgacccagagcccctccagcgtgtccgccagcgtcggcgaccgggtgaccatcacgtgccgggcctcccaggggatcagctcctggctggcgtggtaccagcacaagccgggcaaggcccccaagctcctgatctacgccgccagctccctgcagagcggggtgccctcccgcttcagcggctccgggagcggcaccgacttcaccctcaccatctccagcctgcagcccgaggacttcgccacgtactactgccagcaggcgaactccttcccgtggaccttcggccaggggaccaaggtcgagatcaagcggaccgtggccgcccccagcgtgttcatcttcccgccctccgacgagcagctcaagagcggcacggccagcgtcgtgtgcctgctgaacaacttctacccccgcgaggcgaaggtgcagtggaaggtcgacaacgccctgcagtccgggaacagccaggagtccgtgaccgagcaggacagcaaggactccacctacagcctctccagcaccctgacgctgtccaaggccgactacgagaagcacaaggtgtacgcctgcgaggtcacccaccagggcctcagctcccccgtgaccaagagcttcaaccgcggggagtgc

SEQ ID NO: 8598 - RNA, 1326 nt, synthetic construct
  misc_feature 1..1326: note = derived and/or modified sequence opt1 from Andecaliximab_HeavyChain
  source 1..1326: mol_type = other RNA
caggtgcagctgcaggagagcggccccgggctcgtcaagccgtccgagaccctgagcctgacctgcacggtgtccggcttcagcctcctgtcctacggggtgcactgggtccgccagccgcccggcaaggggctggagtggctcggcgtgatctggaccggcgggaccaccaactacaacagcgccctgatgtcccggttcacgatcagcaaggacgactccaagaacaccgtgtacctgaagatgaacagcctcaagaccgaggacaccgccatctactactgcgcgcgctactactacggcatggactactgggggcagggcacgctggtcaccgtgtccagcgcctccaccaaggggcccagcgtgttccccctggccccctgctcccggagcacctccgagagcacggccgccctcggctgcctggtcaaggactacttccccgagcccgtgaccgtgtcctggaacagcggcgcgctgaccagcggggtccacaccttcccggccgtgctccagtccagcggcctgtactccctgagctccgtggtcacggtgcccagctccagcctcgggaccaagacctacacgtgcaacgtggaccacaagccctccaacaccaaggtcgacaagcgcgtggagagcaagtacgggcccccgtgcccgccctgccccgcccccgagttcctgggcggcccctccgtgttcctgttcccgcccaagcccaaggacaccctcatgatcagccggacccccgaggtgacctgcgtcgtggtcgacgtgtcccaggaggaccccgaggtccagttcaactggtacgtggacggcgtggaggtccacaacgccaagacgaagccccgcgaggagcagttcaacagcacctaccgggtggtgtccgtcctgaccgtgctgcaccaggactggctcaacgggaaggagtacaagtgcaaggtgagcaacaagggcctgccgtccagcatcgagaagaccatctccaaggcgaaggggcagccccgcgagccccaggtctacacgctgcccccgagccaggaggagatgaccaagaaccaggtgagcctgacctgcctcgtgaagggcttctacccctccgacatcgccgtcgagtgggagagcaacggccagcccgagaacaactacaagaccacgccgcccgtgctggactccgacgggagcttcttcctctactcccggctgaccgtggacaagagccgctggcaggagggcaacgtcttctcctgcagcgtgatgcacgaggccctgcacaaccactacacccagaagtccctcagcctgtccctggggaag

SEQ ID NO: 8599 - RNA, 642 nt, synthetic construct
  misc_feature 1..642: note = derived and/or modified sequence opt1 from Andecaliximab_LightChain
  source 1..642: mol_type = other RNA
gacatccagatgacgcagagcccctccagcctgtccgccagcgtgggcgaccgcgtcaccatcacgtgcaaggcctcccaggacgtgcggaacaccgtggcgtggtaccagcagaagccggggaaggcccccaagctcctgatctacagctccagctaccgcaacaccggcgtccccgaccggttctccgggagcggctccgggaccgacttcacgctgaccatcagctccctccaggccgaggacgtggccgtgtactactgccagcagcactacatcaccccctacaccttcggcggcgggacgaaggtcgagatcaagcgcaccgtggccgcgccgagcgtgttcatcttcccgccctccgacgagcagctcaagagcggcaccgcctccgtcgtgtgcctgctgaacaacttctacccccgggaggccaaggtgcagtggaaggtcgacaacgccctgcagagcgggaactcccaggagagcgtgaccgagcaggacagcaaggactccacgtacagcctgtccagcaccctcaccctgtccaaggcggactacgagaagcacaaggtgtacgcctgcgaggtcacccaccagggcctgagctcccccgtgaccaagagcttcaaccgcggggagtgc

SEQ ID NO: 8600 - RNA, 1353 nt, synthetic construct
  misc_feature 1..1353: note = derived and/or modified sequence opt1 from Aprutumab_HeavyChain
  source 1..1353: mol_type = other RNA
gaggtgcagctgctcgagagcggcgggggcctggtccagcccgggggctccctgcgcctcagctgcgccgcctccgggttcaccttcagctcctacgcgatgagctgggtgcggcaggccccgggcaagggcctggagtgggtgtccgccatcagcgggtccggcaccagcacctactacgccgactccgtcaaggggcgcttcaccatcagccgggacaactccaagaacaccctgtacctccagatgaacagcctgcgcgccgaggacaccgcggtgtactactgcgcccgggtgcgctacaactggaaccacggcgactggttcgacccctgggggcagggcacgctggtcaccgtgtccagcgcctccaccaagggccccagcgtgttccccctcgccccgtccagcaagagcacctccgggggcacggcggccctggggtgcctggtcaaggactacttccccgagcccgtgaccgtgagctggaactccggcgccctcaccagcggcgtccacaccttccccgccgtgctgcagtccagcgggctgtactccctcagctccgtggtcacggtgccgagctccagcctgggcacccagacctacatctgcaacgtgaaccacaagccctccaacaccaaggtcgacaagaaggtggagcccaagagctgcgacaagacgcacacgtgcccgccctgccccgcccccgagctgctcgggggcccctccgtgttcctgttcccgcccaagcccaaggacaccctgatgatcagccggacccccgaggtgacctgcgtcgtggtcgacgtgtcccacgaggacccggaggtcaagttcaactggtacgtggacggggtggaggtccacaacgcgaagaccaagccccgcgaggagcagtacaacagcacctaccgggtggtgtccgtcctcaccgtgctgcaccaggactggctgaacggcaaggagtacaagtgcaaggtgagcaacaaggccctccccgcccccatcgagaagacgatcagcaaggccaagggccagccgcgcgagccccaggtctacaccctgccgccctcccgggacgagctgaccaagaaccaggtgagcctgacctgcctcgtgaaggggttctacccctccgacatcgccgtcgagtgggagagcaacggccagcccgagaacaactacaagacgacgcccccggtgctggactccgacgggagcttcttcctctactccaagctgaccgtggacaagagccgctggcagcagggcaacgtcttctcctgcagcgtgatgcacgaggcgctgcacaaccactacacccagaagtccctcagcctgtcccccggg

SEQ ID NO: 8601 - RNA, 648 nt, synthetic construct
  misc_feature 1..648: note = derived and/or modified sequence opt1 from Aprutumab_LightChain
  source 1..648: mol_type = other RNA
cagagcgtgctgacccagcccccgtccgccagcggcacccccgggcagcgcgtcacgatctcctgcagcggctccagctccaacatcgggaacaactacgtgagctggtaccagcagctccccggcaccgcccccaagctgctgatctacgagaactacaaccggccggcgggggtgcccgaccgcttctccggcagcaagtccggcaccagcgcctccctcgccatcagcgggctgcggtccgaggacgaggccgactactactgcagctcctgggacgacagcctgaactactgggtcttcggcgggggcaccaagctcacggtgctggggcagcccaaggccgcgccctccgtgaccctgttcccgcccagcagcgaggagctccaggccaacaaggccaccctggtctgcctgatctccgacttctaccccggcgccgtgaccgtggcgtggaaggccgacagctcccccgtcaaggccggcgtggagacgaccaccccgagcaagcagtccaacaacaagtacgccgccagctcctacctcagcctgacccccgagcagtggaagtcccaccgcagctactcctgccaggtgacgcacgaggggagcaccgtcgagaagaccgtggcgcccaccgagtgctcc

SEQ ID NO: 8602 - RNA, 1341 nt, synthetic construct
  misc_feature 1..1341: note = derived and/or modified sequence opt1 from Azintuxizumab_HeavyChain
  source 1..1341: mol_type = other RNA
gaggtgcagctggtcgagagcggcgggggcctcgtgcagcccgggggctccctgcgcctgagctgcgccgcctccgggttcaccttcagcgactactacatggcgtgggtgcggcaggccccgggcaagggcctcgagtgggtcgcctccatcaactacgacgggagctccacctactacgtggacagcgtgaagggccgcttcacgatctcccgggacaacgccaagaacagcctgtacctgcagatgaactccctccgcgccgaggacaccgcggtctactactgcgcccgggaccgcgggtactacttcgactactggggccaggggaccaccgtgacggtgagctccgccagcaccaagggcccctccgtcttccccctggcccccagctccaagagcacctccggcgggaccgcggccctgggctgcctcgtgaaggactacttcccggagcccgtgacggtcagctggaacagcggggccctgacctccggcgtgcacaccttccccgccgtgctgcagagctccggcctctacagcctgtccagcgtcgtgaccgtgccctccagctccctggggacgcagacctacatctgcaacgtcaaccacaagccgagcaacaccaaggtggacaagaaggtggagcccaagtcctgcgacaagacccacacgtgcccgccctgcccggcccccgagctcctgggcgggcccagcgtcttcctgttcccgcccaagcccaaggacaccctcatgatctcccggacccccgaggtgacctgcgtggtcgtggacgtcagccacgaggaccccgaggtgaagttcaactggtacgtggacggcgtcgaggtgcacaacgcgaagacgaagccgcgcgaggagcagtacaactccacctaccgggtggtcagcgtgctgaccgtgctgcaccaggactggctcaacgggaaggagtacaagtgcaaggtctccaacaaggccctgcccgcccccatcgagaagaccatcagcaaggccaagggccagccccgcgagccccaggtgtacacgctgccgccctcccgggaggagatgaccaagaaccaggtgagcctgacctgcctcgtcaagggcttctaccccagcgacatcgccgtggagtgggagtccaacgggcagcccgagaacaactacaagaccacgccgcccgtgctggacagcgacggctccttcttcctctacagcaagctgaccgtcgacaagtcccgctggcagcaggggaacgtgttcagctgctccgtgatgcacgaggcgctgcacaaccactacacccagaagtccctcagcctgagccccggcaag

SEQ ID NO: 8603 - RNA, 660 nt, synthetic construct
  misc_feature 1..660: note = derived and/or modified sequence opt1 from Azintuxizumab_LightChain
  source 1..660: mol_type = other RNA
gacgtggtcatgacccagacgcccctgagcctctccgtgacccccggccagcccgccagcatctcctgccgcagctcccagagcctggtgcactccaacgggaacacctacctgcactggtacctccagaagcccggccagagcccccagctgctgatctacaaggtctccaaccggttcagcggggtgccggaccgcttctccggcagcgggtccggcaccgacttcaccctcaagatcagccgggtggaggccgaggacgtcggcgtgtacttctgctcccagagcacgcacgtgccgcccttcaccttcgggggcgggaccaaggtcgagatcaagcgcaccgtggcggccccctccgtgttcatcttcccgcccagcgacgagcagctgaagtccggcacggccagcgtcgtgtgcctgctcaacaacttctacccccgggaggccaaggtgcagtggaaggtcgacaacgccctgcagagcgggaactcccaggagagcgtgaccgagcaggactccaaggacagcacctactccctgagctccaccctcacgctgagcaaggcggactacgagaagcacaaggtgtacgcctgcgaggtcacccaccagggcctgtccagccccgtgaccaagtccttcaaccgcggcgagtgc

SEQ ID NO: 8604 - RNA, 366 nt, synthetic construct
  misc_feature 1..366: note = derived and/or modified sequence opt1 from Blinatumomab_HeavyChain1
  source 1..366: mol_type = other RNA
caggtgcagctgcagcagagcggcgccgagctcgtccgccccgggtccagcgtgaagatctcctgcaaggccagcggctacgcgttctccagctactggatgaactgggtgaagcagcggccggggcagggcctggagtggatcgggcagatctggcccggcgacggcgacaccaactacaacgggaagttcaagggcaaggccaccctgacggccgacgagtccagctccaccgcctacatgcagctcagctccctggccagcgaggactccgcggtctacttctgcgcccgccgggagaccaccacggtggggcgctactactacgccatggactactggggccaggggaccaccgtgaccgtc

SEQ ID NO: 8605 - RNA, 363 nt, synthetic construct
  misc_feature 1..363: note = derived and/or modified sequence opt1 from Blinatumomab_HeavyChain2
  source 1..363: mol_type = other RNA
gacatcaagctgcagcagagcggcgccgagctcgcccgccccggggcgtccgtgaagatgagctgcaagacctccggctacaccttcacgcggtacaccatgcactgggtcaagcagcgcccggggcagggcctggagtggatcgggtacatcaaccccagccggggctacaccaactacaaccagaagttcaaggacaaggccaccctgacgaccgacaagtccagctccaccgcctacatgcagctcagctccctgaccagcgaggactccgccgtgtactactgcgcccgctactacgacgaccactactgcctggactactggggccaggggacgaccctcaccgtgagctccgtcgag

SEQ ID NO: 8606 - RNA, 1494 nt, synthetic construct
  misc_feature 1..1494: note = derived and/or modified sequence opt1 from Blinatumomab_LightChain_HeavyChain_HeavyChain_LightChain
  source 1..1494: mol_type = other RNA
gacatccagctgacccagagccccgcctccctcgccgtgagcctgggccagcgcgcgaccatctcctgcaaggccagccagtccgtcgactacgacggggacagctacctgaactggtaccagcagatcccgggccagccgcccaagctcctgatctacgacgcctccaacctggtgagcgggatcccgccccggttctccggcagcgggtccggcacggacttcaccctcaacatccaccccgtggagaaggtcgacgccgccacctaccactgccagcagagcaccgaggacccctggacgttcggcgggggcaccaagctggagatcaagggcggcgggggctccggcgggggcgggagcggcggcgggggctcccaggtgcagctgcagcagagcggggcggagctcgtgcgccccggctccagcgtcaagatctcctgcaaggccagcgggtacgccttcagctcctactggatgaactgggtgaagcagcggcccggccagggcctggagtggatcgggcagatctggcccggcgacggggacaccaactacaacggcaagttcaaggggaaggccaccctgacggcggacgagagctccagcaccgcctacatgcagctctccagcctggcctccgaggacagcgccgtgtacttctgcgcccgccgggagaccaccacggtcggccgctactactacgcgatggactactggggccaggggaccaccgtgaccgtgtccagcggcgggggcgggtccgacatcaagctgcagcagagcggcgccgagctcgcccggcccggcgcctccgtcaagatgagctgcaagacgtccgggtacaccttcacccgctacaccatgcactgggtgaagcagcggcccggccaggggctggagtggatcggctacatcaacccgagccgcggctacacgaactacaaccagaagttcaaggacaaggccaccctgaccaccgacaagtccagctccacggcgtacatgcagctcagcagcctgacctccgaggacagcgccgtgtactactgcgcccggtactacgacgaccactactgcctggactactgggggcagggcaccaccctcacggtctccagcgtggagggcgggtccggcgggagcggcgggtccggcgggagcggcggggtggacgacatccagctgacccagtcccccgccatcatgagcgcctcccccggggagaaggtcaccatgacctgccgcgcgagctccagcgtgtcctacatgaactggtaccagcagaagtccggcacgagccccaagcggtggatctacgacaccagcaaggtggccagcggggtcccgtaccgcttctccggcagcgggtccggcaccagctactccctgaccatcagctccatggaggccgaggacgccgccacgtactactgccagcagtggagctccaaccccctcaccttcggggcgggcaccaagctggagctgaag

SEQ ID NO: 8607 - RNA, 333 nt, synthetic construct
  misc_feature 1..333: note = derived and/or modified sequence opt1 from Blinatumomab_LightChain1
  source 1..333: mol_type = other RNA
gacatccagctgacccagagccccgcctccctcgccgtgagcctgggccagcgcgcgaccatctcctgcaaggccagccagtccgtcgactacgacggggacagctacctgaactggtaccagcagatccccggccagccgcccaagctcctgatctacgacgcctccaacctggtgagcgggatcccgccccggttctccggcagcgggtccggcacggacttcaccctcaacatccaccccgtggagaaggtcgacgccgccacctaccactgccagcagagcaccgaggacccctggacgttcggcgggggcaccaagctggagatcaag

SEQ ID NO: 8608 - RNA, 324 nt, synthetic construct
  misc_feature 1..324: note = derived and/or modified sequence opt1 from Blinatumomab_LightChain2
  source 1..324: mol_type = other RNA
gtggacgacatccagctgacccagagccccgccatcatgtccgccagcccgggcgagaaggtcaccatgacgtgccgcgcgtccagctccgtgagctacatgaactggtaccagcagaagtccgggaccagccccaagcggtggatctacgacacctccaaggtggccagcggcgtcccctaccgcttctccgggagcggctccgggaccagctactccctcacgatcagctccatggaggccgaggacgccgccacctactactgccagcagtggagctccaaccccctgaccttcggcgcgggcaccaagctggagctcaag

SEQ ID NO: 8609 - RNA, 1350 nt, synthetic construct
  misc_feature 1..1350: note = derived and/or modified sequence opt1 from Brazikumab_HeavyChain
  source 1..1350: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgtgatctggtacgacgggagcaacgagtactacgccgactccgtcaagggccggttcaccatcagccgcgacaactccaagaacaccctctacctgcagatgaacagcctgcgggccgaggacaccgccgtgtactactgcgcgcgcgaccgggggtacacctccagctggtaccccgacgccttcgacatctggggccaggggaccatggtgacggtctccagcgcctccaccaagggccccagcgtgttccccctcgccccgtgctcccgcagcacctccgagagcaccgcggccctgggctgcctggtgaaggactacttccccgagcccgtcacggtgagctggaactccggggccctcaccagcggcgtgcacaccttccccgccgtcctgcagtccagcgggctgtactccctcagctccgtggtgaccgtcccgagctccaacttcggcacgcagacctacacgtgcaacgtggaccacaagcccagcaacaccaaggtggacaagaccgtcgagcggaagtgctgcgtggagtgcccgccctgccccgccccgcccgtggcgggcccctccgtcttcctgttcccgcccaagcccaaggacaccctgatgatcagccgcacccccgaggtgacctgcgtcgtggtggacgtctcccacgaggaccccgaggtgcagttcaactggtacgtggacggggtcgaggtgcacaacgccaagacgaagccccgggaggagcagttcaacagcaccttccgcgtggtctccgtgctcaccgtggtccaccaggactggctgaacggcaaggagtacaagtgcaaggtgagcaacaaggggctgcccgcccccatcgagaagaccatctccaagacgaagggccagccgcgggagccccaggtgtacaccctcccgcccagccgcgaggagatgaccaagaaccaggtctccctgacctgcctggtgaaggggttctaccccagcgacatcgccgtggagtgggagagcaacggccagcccgagaacaactacaagacgacgcccccgatgctcgactccgacggcagcttcttcctgtactccaagctgaccgtcgacaagagccggtggcagcaggggaacgtgttctcctgcagcgtgatgcacgaggccctccacaaccactacacccagaagtccctgagcctgtcccccggcaag

SEQ ID NO: 8610 - RNA, 651 nt, synthetic construct
  misc_feature 1..651: note = derived and/or modified sequence opt1 from Brazikumab_LightChain
  source 1..651: mol_type = other RNA
cagagcgtgctgacccagcccccgtccgtcagcggcgcccccgggcagcgcgtgaccatctcctgcacgggcagctccagcaacaccggggccggctacgacgtgcactggtaccagcaggtccccgggaccgcgcccaagctcctgatctacggctccggcaaccggccgagcggggtgcccgaccgcttctccggcagcaagtccgggaccagcgcctccctggccatcacgggcctccaggccgaggacgaggccgactactactgccagagctacgactccagcctgtccgggtgggtgttcggcggcgggacccggctgaccgtcctcggccagcccaaggcggcccccagcgtgaccctgttcccgccctccagcgaggagctgcaggccaacaaggccacgctcgtgtgcctgatcagcgacttctaccccggggcggtcaccgtggcctggaaggccgactccagccccgtgaaggccggcgtcgagaccaccacgccgtccaagcagagcaacaacaagtacgccgcgtccagctacctgtccctcacccccgagcagtggaagtcccaccgcagctacagctgccaggtgacccacgagggctccaccgtggagaagacggtcgcccccaccgagtgcagc

SEQ ID NO: 8611 - RNA, 363 nt, synthetic construct
  misc_feature 1..363: note = derived and/or modified sequence opt1 from Brolucizumab_HeavyChain
  source 1..363: mol_type = other RNA
agcgaggtgcagctggtcgagtccggcgggggcctcgtgcagcccgggggcagcctgcgcctgtcctgcaccgccagcgggttctccctcaccgactactactacatgacgtgggtgcggcaggccccgggcaagggcctggagtgggtcgggttcatcgaccccgacgacgacccctactacgcgacctgggccaagggccgcttcaccatcagccgggacaactccaagaacaccctgtacctccagatgaacagcctgcgcgccgaggacacggccgtgtactactgcgccgggggcgaccacaactccgggtggggcctggacatctggggccaggggaccctcgtgaccgtcagctcc

SEQ ID NO: 8612 - RNA, 333 nt, synthetic construct
  misc_feature 1..333: note = derived and/or modified sequence opt1 from Brolucizumab_LightChain
  source 1..333: mol_type = other RNA
atggagatcgtgatgacccagagcccctccaccctgagcgcctccgtcggcgaccgcgtgatcatcacgtgccaggccagcgagatcatccactcctggctcgcgtggtaccagcagaagccggggaaggcccccaagctgctgatctacctcgccagcaccctggcctccggcgtgcccagccggttctccgggagcggctccggggccgagttcaccctgaccatcagctccctccagcccgacgacttcgcgacgtactactgccagaacgtctacctggccagcaccaacggcgccaacttcggccaggggaccaagctgaccgtgctc

SEQ ID NO: 8613 - RNA, 1347 nt, synthetic construct
  misc_feature 1..1347: note = derived and/or modified sequence opt1 from Cabiralizumab_HeavyChain
  source 1..1347: mol_type = other RNA
caggtgcagctggtccagagcggcgccgaggtgaagaagcccgggtccagcgtgaaggtctcctgcaaggccagcggctacaccttcaccgacaactacatgatctgggtgcgccaggcgccggggcagggcctcgagtggatgggggacatcaacccctacaacggcggcacgaccttcaaccagaagttcaaggggcgggtgaccatcaccgccgacaagtccacgagcaccgcctacatggagctgtccagcctgcgctccgaggacaccgccgtctactactgcgcccgggagagcccctacttctccaacctctacgtgatggactactggggccaggggaccctggtgacggtcagctccgcgagcaccaagggcccctccgtgttcccgctggccccctgcagccgctccaccagcgagtccaccgccgccctcgggtgcctggtgaaggactacttccccgagcccgtcacggtgagctggaacagcggcgcgctgacctccggcgtgcacaccttcccggccgtcctccagagctccgggctgtacagcctgtccagcgtggtgaccgtcccctccagctccctcggcacgaagacctacacgtgcaacgtggaccacaagcccagcaacaccaaggtggacaagcgggtcgagtccaagtacgggcccccgtgcccgccctgccccgcccccgagttcctgggcggccccagcgtgttcctgttcccgcccaagcccaaggacaccctcatgatctcccgcacccccgaggtgacctgcgtcgtggtcgacgtgagccaggaggaccccgaggtgcagttcaactggtacgtcgacggggtggaggtgcacaacgccaagaccaagccccgggaggagcagttcaactccacgtaccgcgtcgtgagcgtgctgaccgtcctgcaccaggactggctcaacggcaaggagtacaagtgcaaggtgtccaacaaggggctgccgagctccatcgagaagaccatcagcaaggccaagggccagccccgggagccccaggtgtacaccctgcccccgagccaggaggagatgacgaagaaccaggtctccctgacctgcctcgtgaaggggttctaccccagcgacatcgcggtggagtgggagtccaacggccagcccgagaacaactacaagaccaccccgcccgtcctggacagcgacggctccttcttcctctacagccgcctgacggtggacaagtcccggtggcaggaggggaacgtgttcagctgctccgtcatgcacgaggccctgcacaaccactacacccagaagtccctcagcctgagcctgggcaag

SEQ ID NO: 8614 - RNA, 654 nt, synthetic construct
  misc_feature 1..654: note = derived and/or modified sequence opt1 from Cabiralizumab_LightChain
  source 1..654: mol_type = other RNA
gagatcgtgctgacccagagccccgccaccctctccctgagcccgggcgagcgcgccacgctgtcctgcaaggcgagccagtccgtcgactacgacggggacaactacatgaactggtaccagcagaagcccggccaggcgccccggctcctgatctacgccgccagcaacctggagtccgggatccccgcccgcttcagcggctccgggagcggcaccgacttcaccctcaccatctccagcctggagccggaggacttcgccgtgtactactgccacctgtccaacgaggacctcagcacgttcggcgggggcaccaaggtggagatcaagcggaccgtcgccgccccctccgtgttcatcttcccgcccagcgacgagcagctgaagtccgggaccgccagcgtggtctgcctgctcaacaacttctacccccgcgaggcgaaggtgcagtggaaggtggacaacgccctgcagtccggcaacagccaggagagcgtcacggagcaggactccaaggacagcacctactccctgagctccaccctcaccctgagcaaggccgactacgagaagcacaaggtgtacgcctgcgaggtgacgcaccaggggctgtccagccccgtcaccaagtccttcaaccggggcgagtgc

SEQ ID NO: 8615 - RNA, 1329 nt, synthetic construct
  misc_feature 1..1329: note = derived and/or modified sequence opt1 from Camrelizumab_HeavyChain
  source 1..1329: mol_type = other RNA
gaggtgcagctggtcgagagcggcgggggcctcgtgcagcccgggggctccctgcgcctgagctgcgccgcctccgggttcaccttcagctcctacatgatgagctgggtgcggcaggcgccgggcaagggcctcgagtgggtcgccaccatctccgggggcggggccaacacgtactaccccgacagcgtgaagggccgcttcaccatctcccgggacaacgccaagaacagcctgtacctgcagatgaactccctccgcgccgaggacaccgcggtgtactactgcgcccggcagctgtactacttcgactactgggggcagggcaccacggtcaccgtgagctccgccagcaccaagggcccctccgtgttccccctggccccgtgcagccgctccaccagcgagtccacggcggccctcgggtgcctggtcaaggactacttccccgagcccgtgaccgtgagctggaacagcggcgccctgacctccggggtccacaccttccccgccgtgctccagagctccggcctgtacagcctgtccagcgtggtcacggtgccgtccagctccctcggcaccaagacctacacgtgcaacgtggaccacaagcccagcaacaccaaggtcgacaagcgggtggagtccaagtacgggccgccctgcccgccctgccccgcccccgagttcctgggcgggcccagcgtgttcctgttcccgcccaagcccaaggacaccctcatgatctcccgcacccccgaggtgacctgcgtcgtggtcgacgtgagccaggaggaccccgaggtccagttcaactggtacgtggacggcgtggaggtccacaacgcgaagacgaagccccgggaggagcagttcaactccacctaccgcgtggtgagcgtcctgaccgtgctgcaccaggactggctcaacgggaaggagtacaagtgcaaggtgtccaacaagggcctgcccagctccatcgagaagaccatcagcaaggccaagggccagccgcgggagccccaggtctacacgctgccgcccagccaggaggagatgaccaagaaccaggtgtccctgacctgcctcgtgaaggggttctaccccagcgacatcgccgtcgagtgggagtccaacggccagcccgagaacaactacaagaccacgcccccggtgctggacagcgacgggtccttcttcctctacagccgcctgaccgtggacaagtcccggtggcaggagggcaacgtcttcagctgctccgtgatgcacgaggccctgcacaaccactacacccagaagtccctcagcctgagcctggggaag

SEQ ID NO: 8616 - RNA, 642 nt, synthetic construct
  misc_feature 1..642: note = derived and/or modified sequence opt1 from Camrelizumab_LightChain
  source 1..642: mol_type = other RNA
gacatccagatgacccagagcccctccagcctgtccgccagcgtgggcgaccgcgtcaccatcacgtgcctcgcctcccagaccatcgggacctggctgacctggtaccagcagaagccgggcaaggcgcccaagctgctcatctacacggccaccagcctggccgacggggtgccctcccggttcagcggctccgggagcggcaccgacttcaccctgacgatctccagcctccagcccgaggacttcgccacctactactgccagcaggtctactccatcccgtggaccttcggcgggggcaccaaggtggagatcaagcgcacggtggccgcgcccagcgtgttcatcttcccgccctccgacgagcagctcaagagcgggaccgcctccgtcgtgtgcctgctgaacaacttctacccccgggaggccaaggtgcagtggaaggtcgacaacgccctgcagagcggcaactcccaggagagcgtgaccgagcaggacagcaaggactccacctacagcctgtccagcacgctcaccctgtccaaggcggactacgagaagcacaaggtgtacgcctgcgaggtcacccaccaggggctgagctcccccgtgaccaagagcttcaaccgcggcgagtgc

SEQ ID NO: 8617 - RNA, 777 nt, synthetic construct; identical to SEQ ID NO: 7784
  misc_feature 1..777: note = derived and/or modified sequence opt1 from Caplacizumab_HeavyChain
  source 1..777: mol_type = other RNA

SEQ ID NO: 8618 - RNA, 657 nt, synthetic construct
  misc_feature 1..657: note = derived and/or modified sequence opt1 from Citatuzumab_bogatox_HeavyChain
  source 1..657: mol_type = other RNA
gaggtgcagctggtccagagcggccccgggctcgtgcagccgggcgggtccgtgcgcatcagctgcgccgcctccggctacaccttcaccaactacgggatgaactgggtcaagcaggcgcccggcaagggcctggagtggatggggtggatcaacacgtacaccggcgagagcacctacgccgactccttcaaggggcggttcaccttcagcctggacacgtccgccagcgccgcctacctccagatcaactccctgcgcgcggaggacaccgccgtgtactactgcgcccggttcgccatcaagggcgactactgggggcagggcaccctgctcaccgtgagctccgcgagcacgaagggcccctccgtcttccccctggccccgagctccaagagcacctccgggggcaccgccgccctggggtgcctcgtgaaggactacttccccgagcccgtgaccgtcagctggaactccggcgccctgacgagcggcgtgcacaccttccccgcggtgctgcagagctccgggctctacagcctgtccagcgtcgtgaccgtgccgtccagctccctgggcacccagacgtacatctgcaacgtcaaccacaagcccagcaacaccaaggtggacaagaaggtggagcccaagtcctgc

SEQ ID NO: 8619 - RNA, 1356 nt, synthetic construct
  misc_feature 1..1356: note = derived and/or modified sequence opt1 from Cosfroviximab_HeavyChain
  source 1..1356: mol_type = other RNA
gacgtgaagctgctcgagagcggcgggggcctggtccagcccgggggctccctgaagctcagctgcgccgcctccgggttcagcctgtccaccagcggcgtgggcgtggggtggttccgccagccgtccggcaaggggctggagtggctcgcgctgatctggtgggacgacgacaagtactacaaccccagcctgaagtcccagctcagcatctccaaggacttcagccggaaccaggtcttcctgaagatctccaacgtggacatcgccgacaccgccacgtactactgcgcccgccgggaccccttcggctacgacaacgccatggggtactggggccagggcaccagcgtgaccgtctccagcgcgtccaccaaggggcccagcgtgttcccgctggccccctccagcaagagcacgtccggcgggaccgccgccctcggctgcctggtgaaggactacttccccgagcccgtcaccgtgagctggaactccggcgcgctgaccagcggggtgcacacgttcccggccgtcctccagtccagcggcctgtactccctgagctccgtggtgaccgtccccagctccagcctcgggacccagacctacatctgcaacgtgaaccacaagccctccaacacgaaggtggacaagcgcgtcgagcccaagagctgcgacaagacccacacgtgcccgccctgccccgcccccgagctgctgggcgggccgtccgtgttcctcttcccgcccaagcccaaggacaccctgatgatcagccggacccccgaggtgacctgcgtcgtggtggacgtctcccacgaggaccccgaggtgaagttcaactggtacgtcgacggcgtggaggtgcacaacgccaagaccaagccccgcgaggagcagtacaacagcacctaccgggtcgtgtccgtgctgacggtcctccaccaggactggctgaacggcaaggagtacaagtgcaaggtgagcaacaaggccctgcccgcgccgatcgagaagaccatcagcaaggccaaggggcagccccgcgagccccaggtgtacaccctgcccccgtcccgggacgagctcaccaagaaccaggtcagcctgacgtgcctcgtgaagggcttctacccctccgacatcgccgtggagtgggagagcaacgggcagcccgagaacaactacaagaccaccccgcccgtcctggactccgacggcagcttcttcctgtactccaagctcaccgtggacaagagccgctggcagcaggggaacgtgttctcctgcagcgtcatgcacgaggccctgcacaaccactacacgcagaagtccctgagcctctcccccggcaag

SEQ ID NO: 8620 - RNA, 639 nt, synthetic construct
  misc_feature 1..639: note = derived and/or modified sequence opt1 from Cosfroviximab_LightChain
  source 1..639: mol_type = other RNA
gacatcgtgatgacccagagccccctgtccctcagcacctccgtcggcgaccgggtgagcctgacgtgcaaggcctcccagaacgtggggaccgccgtcgcgtggtaccagcagaagccgggccagagccccaagctgctcatctactccgccagcaaccggtacaccggggtgcccgaccgcttcaccggctccgggagcggcacggacttcaccctgaccatctccaacatgcagagcgaggacctggccgactacttctgccagcagtactccagctaccccctcaccttcggcgccgggacgaagctggagctgcggaccgtggccgcgccgtccgtcttcatcttcccgcccagcgacgagcagctcaagtccggcaccgccagcgtggtgtgcctgctgaacaacttctacccccgcgaggccaaggtccagtggaaggtggacaacgccctccagtccgggaacagccaggagagcgtgaccgagcaggactccaaggacagcacgtactccctgagctccaccctgaccctcagcaaggcggactacgagaagcacaaggtctacgcctgcgaggtgacccaccagggcctgtccagccccgtgacgaagtccttcaaccgcggggagtgc

SEQ ID NO: 8621 - RNA, 1344 nt, synthetic construct
  misc_feature 1..1344: note = derived and/or modified sequence opt1 from Crizanlizumab_HeavyChain
  source 1..1344: mol_type = other RNA
caggtgcagctggtccagagcggcgccgaggtgaagaagcccggggcctccgtgaaggtcagctgcaaggtgtccggctacaccttcaccagctacgacatcaactgggtgcgccaggcgccggggaagggcctcgagtggatggggtggatctaccccggcgacggctccatcaagtacaacgagaagttcaaggggcgggtcacgatgaccgtggacaagagcaccgacaccgcctacatggagctgtccagcctgcgctccgaggacacggccgtgtactactgcgcccggcgcggcgagtacgggaactacgagggcgccatggactactgggggcagggcaccctcgtcaccgtgagctccgcgagcaccaagggcccctccgtgttccccctggccccgtgcagccggtccacgagcgagtccaccgccgccctggggtgcctcgtcaaggactacttccccgagcccgtgaccgtgagctggaactccggcgcgctgaccagcggggtccacacgttccccgccgtgctgcagagctccggcctctacagcctgtccagcgtggtcaccgtgacctccagcaacttcggcacccagacgtacacgtgcaacgtggaccacaagccgtccaacaccaaggtcgacaagaccgtggagcgcaagtgctgcgtggagtgcccgccctgccccgccccgcccgtcgccgggcccagcgtgttcctgttcccgcccaagcccaaggacaccctcatgatctcccggacccccgaggtgacctgcgtcgtggtcgacgtgagccacgaggaccccgaggtgcagttcaactggtacgtcgacggcatggaggtgcacaacgccaagaccaagccgcgcgaggagcagttcaactccacgttccgggtggtcagcgtgctgaccgtggtccaccaggactggctgaacgggaaggagtacaagtgcgcggtgtccaacaagggcctccccgcccccatcgagaagaccatcagcaagaccaaggggcagccccgcgagccccaggtgtacacgctgccgccctcccgggaggagatgaccaagaaccaggtcagcctgacctgcctcgtgaagggcttctacccctccgacatcgccgtggagtgggagagcaacggccagcccgagaacaactacaagaccacgccgcccatgctggactccgacgggagcttcttcctgtacagcaagctcaccgtcgacaagtcccgctggcagcagggcaacgtgttcagctgctccgtgatgcacgaggccctgcacaaccactacacccagaagtccctgagcctcagccccgggaag

SEQ ID NO: 8622 - RNA, 654 nt, synthetic construct
  misc_feature 1..654: note = derived and/or modified sequence opt1 from Crizanlizumab_LightChain
  source 1..654: mol_type = other RNA
gacatccagatgacccagagcccctccagcctgtccgccagcgtgggcgaccgcgtcaccatcacgtgcaaggcctcccagagcgtggactacgacgggcactcctacatgaactggtaccagcagaagccgggcaaggcgcccaagctcctgatctacgccgccagcaacctggagtccggggtgcccagccggttctccggcagcgggtccggcaccgacttcaccctcaccatcagctccctgcagcccgaggacttcgccacgtactactgccagcagagcgacgagaacccgctgaccttcggcgggggcaccaaggtcgagatcaagcgcaccgtggccgcgccctccgtgttcatcttcccgcccagcgacgagcagctcaagtccgggacggccagcgtcgtgtgcctgctgaacaacttctacccccgggaggccaaggtgcagtggaaggtcgacaacgccctccagagcggcaactcccaggagagcgtgaccgagcaggactccaaggacagcacctactccctgagctccaccctgacgctcagcaaggcggactacgagaagcacaaggtgtacgcctgcgaggtcacccaccaggggctgtccagccccgtgaccaagtccttcaaccgcggcgagtgc

SEQ ID NO: 8623 - RNA, 1365 nt, synthetic construct
  misc_feature 1..1365: note = derived and/or modified sequence opt1 from Crotedumab_HeavyChain
  source 1..1365: mol_type = other RNA
gaggtgcagctggtcgagagcggcgggggcctcgtgcagcccgggggctccctgcgcctgagctgcgccgcctccgggttcaccttcagcaactacctcatgaactgggtgcggcaggcgcccggcaagggcctggagtggctggccaacatccaggaggacgggatcgagaagtactacgtcgactccgtgaagggccgcttcaccatcagccgggacaacgccaagaactccctctacctgcagatgaacagcctgcgcgccgaggacacggccgtgtactactgcgcgcgggagccctcccactacgacatcctcaccgggtacgactactactacggcatggacgtctgggggcagggcaccaccgtgacggtgagctccgccagcaccaagggcccctccgtcttccccctggccccgtgcagccgctccaccagcgagtccaccgccgcgctggggtgcctcgtgaaggactacttccccgagcccgtgacggtcagctggaactccggcgccctgaccagcggggtgcacaccttccccgccgtgctgcagagctccggcctctacagcctgtccagcgtcgtgaccgtgccgtccagctccctgggcacgaagacctacacgtgcaacgtcgaccacaagcccagcaacaccaaggtggacaagcgggtggagtccaagtacgggccgccctgcccgccctgccccgcccccgagttcctcggcgggccgagcgtcttcctgttcccgcccaagcccaaggacaccctgatgatctcccgcacccccgaggtgacctgcgtggtcgtggacgtcagccaggaggaccccgaggtgcagttcaactggtacgtggacggcgtcgaggtgcacaacgccaagaccaagccccgggaggagcagttcaactccacgtaccgcgtggtcagcgtgctcaccgtgctgcaccaggactggctgaacgggaaggagtacaagtgcaaggtctccaacaagggcctccccagctccatcgagaagaccatcagcaaggcgaagggccagccgcgggagccccaggtgtacaccctgccgccctcccaggaggagatgacgaagaaccaggtgagcctgacctgcctcgtcaaggggttctaccccagcgacatcgccgtggagtgggagtccaacggccagcccgagaacaactacaagaccaccccgcccgtgctggacagcgacgggtccttcttcctgtacagccgcctcacggtcgacaagtcccggtggcaggagggcaacgtgttcagctgctccgtgatgcacgaggccctgcacaaccactacacccagaagtccctgagcctcagcctggggaag

SEQ ID NO: 8624 - RNA, 642 nt, synthetic construct
  misc_feature 1..642: note = derived and/or modified sequence opt1 from Crotedumab_LightChain
  source 1..642: mol_type = other RNA
gacatccagatgacccagagcccctccagcctgtccgccagcgtgggcgaccgcgtcaccatcacgtgccgggcctcccaggggatccgcaacgacctcggctggtaccagcagaagccggggaaggcgcccaagcggctgatctacgccgccagctccctgcagagcggcgtgccctcccgcttcagcgggtccggcagcggcaccgagttcatcctcaccgtgtccagcctgcagcccgaggacttcgccacctactactgcctgcagtacaactccaacccgttcacgttcgggcccggcaccaaggtcgacatcaagcggaccgtggccgcgcccagcgtgttcatcttcccgccctccgacgagcagctcaagagcgggaccgcctccgtcgtgtgcctgctgaacaacttctacccccgcgaggccaaggtgcagtggaaggtcgacaacgccctccagagcggcaacagccaggagtccgtgacggagcaggacagcaaggactccacctacagcctgtccagcaccctgaccctctccaaggcggactacgagaagcacaaggtgtacgcctgcgaggtcacgcaccaggggctgagctcccccgtgaccaagagcttcaaccggggcgagtgc

SEQ ID NO: 8625 - RNA, 1356 nt, synthetic construct
  misc_feature 1..1356: note = derived and/or modified sequence opt1 from Dezamizumab_HeavyChain
  source 1..1356: mol_type = other RNA
caggtgcagctggtccagagcggcgccgaggtgaagaagcccgggtccagcgtgaaggtctcctgcaaggccagcggcttcaccttcgcgacctacaacatgcactgggtgcgccaggccccggggcagggcctcgagtggatggggtacatctaccccggcgacggcaacgccaactacaaccagcagttcaaggggcgggtgacgatcaccgccgacaagtccaccagcaccgcctacatggagctgtccagcctgcgctccgaggacacggcggtctactactgcgcccggggcgacttcgactacgacgggggctactacttcgacagctgggggcagggcaccctcgtgaccgtgtccagcgcctccaccaagggccccagcgtcttccccctggccccgtccagcaagtccacgagcgggggcaccgcggccctggggtgcctcgtgaaggactacttccccgagcccgtgaccgtctcctggaacagcggcgccctgaccagcggcgtgcacacgttccccgccgtgctgcagtccagcgggctctactccctgagctccgtcgtgaccgtgccgagctccagcctgggcacccagacctacatctgcaacgtcaaccacaagccctccaacacgaaggtggacaagaaggtggagcccaagagctgcgacaagacccacacgtgcccgccctgccccgcccccgagctcctcgggggcccctccgtcttcctgttcccgcccaagcccaaggacaccctgatgatcagccgcacccccgaggtgacctgcgtggtcgtggacgtctcccacgaggacccggaggtgaagttcaactggtacgtggacggggtcgaggtgcacaacgcgaagaccaagccccgggaggagcagtacaacagcacctaccgcgtggtctccgtgctgacggtgctgcaccaggactggctcaacggcaaggagtacaagtgcaaggtcagcaacaaggccctgcccgcccccatcgagaagaccatctccaaggccaagggccagccgcgggagccccaggtgtacaccctgccgcccagccgcgacgagctcaccaagaaccaggtgtccctgacgtgcctggtcaaggggttctaccccagcgacatcgccgtggagtgggagagcaacggccagcccgagaacaactacaagaccacgcccccggtgctcgactccgacgggagcttcttcctgtactccaagctgaccgtcgacaagagccggtggcagcagggcaacgtgttctcctgcagcgtgatgcacgaggcgctccacaaccactacacccagaagtccctgagcctgtcccccgggaag

SEQ ID NO: 8626 - RNA, 642 nt, synthetic construct
  misc_feature 1..642: note = derived and/or modified sequence opt1 from Dezamizumab_LightChain
  source 1..642: mol_type = other RNA
gacatccagatgacccagagcccctccagcctgtccgccagcgtgggcgaccgggtcaccatcacgtgccgggcctccgagaacatctacagctacctcgcgtggtaccagcagaagccggggaaggcccccaagctgctgatccacaacgccaagaccctcgccgagggcgtgccctcccgcttcagcgggtccggcagcgggaccgacttcaccctgacgatctccagcctgcagcccgaggacttcgccacctactactgccagcaccactacggcgcgccgctcaccttcggccaggggaccaagctggagatcaagcggacggtggccgccccctccgtcttcatcttcccgcccagcgacgagcagctgaagtccggcaccgccagcgtggtgtgcctcctgaacaacttctacccccgcgaggcgaaggtccagtggaaggtggacaacgccctgcagtccgggaacagccaggagtccgtgaccgagcaggacagcaaggacagcacctactccctcagctccacgctgaccctgagcaaggccgactacgagaagcacaaggtctacgcctgcgaggtgacccaccagggcctctccagccccgtgaccaagtccttcaaccgcggggagtgc

SEQ ID NO: 8627 - RNA, 1506 nt, synthetic construct
  misc_feature 1..1506: note = derived and/or modified sequence opt1 from Duvortuxizumab_Chain1_scFv
  source 1..1506: mol_type = other RNA
gagaacgtgctgacccagagccccgccaccctctccgtcacgccgggcgagaaggccaccatcacgtgccgcgcgagccagtccgtgagctacatgcactggtaccagcagaagcccgggcaggcgccccggctgctgatctacgacgcctccaaccgcgccagcggcgtgccctcccggttcagcgggtccggcagcgggaccgaccacaccctcaccatctccagcctggaggccgaggacgccgccacctactactgcttccagggctccgtctacccgttcaccttcggccaggggacgaagctggagatcaagggcgggggcagcgggggcggcggggaggtgcagctcgtggagtccggcgggggcctggtccagcccggcgggagcctgcgcctctcctgcgccgccagcggcttcaccttctccacctacgcgatgaactgggtgcggcaggcccccgggaagggcctggagtgggtggggcgcatccggagcaagtacaacaactacgccacctactacgccgacagcgtcaagggccgcttcacgatctcccgggacgacagcaagaactccctgtacctccagatgaacagcctgaagaccgaggacaccgccgtgtactactgcgtgcgccacggcaacttcgggaactcctacgtcagctggttcgcgtactggggccaggggaccctggtgacggtgtccagcgcctccaccaagggcgaggtcgccgcctgcgagaaggaggtggccgcgctcgagaaggaggtggccgccctggagaaggaggtcgccgccctggagaagggcgggggcgacaagacccacacgtgcccgccctgccccgcgcccgaggccgccgggggccccagcgtgttcctcttcccgcccaagcccaaggacaccctgatgatctcccggacccccgaggtgacctgcgtcgtggtggacgtcagccacgaggacccggaggtgaagttcaactggtacgtcgacggggtggaggtgcacaacgccaagaccaagccccgcgaggagcagtacaactccacgtaccgggtcgtgagcgtgctgaccgtcctccaccaggactggctgaacggcaaggagtacaagtgcaaggtgtccaacaaggccctgcccgcgcccatcgagaagaccatcagcaaggccaaggggcagccgcgcgagccccaggtgtacaccctcccgccctcccgggaggagatgacgaagaaccaggtcagcctgtggtgcctggtgaagggcttctacccctccgacatcgccgtggagtgggagagcaacggccagcccgagaacaactacaagaccaccccgcccgtcctcgacagcgacgggtccttcttcctgtacagcaagctgaccgtggacaagtcccgctggcagcagggcaacgtgttcagctgctccgtcatgcacgaggccctccacaaccactacacgcagaagtccctgagcctgagccccgggaag

SEQ ID NO: 8628 - RNA, 813 nt, synthetic construct
  misc_feature 1..813: note = derived and/or modified sequence opt1 from Duvortuxizumab_Chain2_scFv
  source 1..813: mol_type = other RNA
caggccgtggtcacccaggagcccagcctgaccgtgtccccgggcgggacggtgaccctgacctgccgcagctccaccggcgccgtcacgaccagcaactacgcgaactgggtgcagcagaagcccgggcaggcgccccggggcctgatcgggggcaccaacaagcgcgccccctggaccccggcccggttctccggcagcctgctcgggggcaaggccgccctgacgatcaccggggcccaggccgaggacgaggccgactactactgcgcgctgtggtactccaacctctgggtgttcggcgggggcaccaagctgaccgtcctgggcgggggcgggagcggcggcgggggccaggtgacgctccgcgagtccgggcccgccctggtgaagcccacccagaccctgaccctcacgtgcaccttcagcggcttctccctgagcacctccgggatgggcgtcggctggatccggcagcccccggggaaggccctggagtggctcgcccacatctggtgggacgacgacaagcgctacaaccccgccctcaagagccggctgaccatctccaaggacacgagcaagaaccaggtgttcctcaccatgaccaacatggaccccgtggacaccgcgacgtactactgcgcccgcatggagctgtggtcctactacttcgactactggggccaggggaccaccgtcaccgtgagctccgccagcacgaagggcaaggtggccgcctgcaaggagaaggtcgcggccctgaaggagaaggtggccgccctcaaggagaaggtggccgcgctgaaggag

SEQ ID NO: 8629 - RNA, 681 nt, synthetic construct
  misc_feature 1..681: note = derived and/or modified sequence opt1 from Duvortuxizumab_Chain3_h-CH2-CH3
  source 1..681: mol_type = other RNA
gacaagacccacacgtgcccgccctgccccgcccccgaggccgcgggcgggcccagcgtgttcctgttcccgcccaagcccaaggacaccctcatgatctcccgcacccccgaggtgacctgcgtcgtggtcgacgtgagccacgaggacccggaggtgaagttcaactggtacgtcgacggcgtggaggtgcacaacgccaagaccaagccccgggaggagcagtacaactccacgtaccgcgtcgtgagcgtgctgaccgtcctgcaccaggactggctcaacgggaaggagtacaagtgcaaggtgtccaacaaggccctgcccgcccccatcgagaagaccatcagcaaggccaagggccagccgcgggagccccaggtgtacaccctgccgccctcccgcgaggagatgacgaagaaccaggtcagcctctcctgcgcggtgaaggggttctaccccagcgacatcgccgtggagtgggagtccaacggccagcccgagaacaactacaagaccaccccgcccgtcctggacagcgacggctccttcttcctggtgagcaagctcaccgtggacaagtcccggtggcagcaggggaacgtcttcagctgctccgtgatgcacgaggccctgcacaaccgctacacgcagaagtccctgagcctcagccccggcaag

SEQ ID NO: 8630 - RNA, 360 nt, synthetic construct
  misc_feature 1..360: note = derived and/or modified sequence opt1 from Efungumab_HeavyChain
  source 1..360: mol_type = other RNA
atggccgaggtgcagctggtcgagagcggcgccgaggtgaagaagcccggggagtccctccgcatcagctgcaagggctccgggtgcatcatcagctcctactggatcagctgggtgcggcagatgccgggcaaggggctggagtggatgggcaagatcgaccccggcgactcctacatcaactacagcccctccttccaggggcacgtcaccatcagcgcggacaagtccatcaacaccgcctacctgcagtggaacagcctcaaggcctccgacacggccatgtactactgcgcccgcggcgggcgggacttcggcgacagcttcgactactgggggcagggcaccctggtgaccgtg

SEQ ID NO: 8631 - RNA, 750 nt, synthetic construct
  misc_feature 1..750: note = derived and/or modified sequence opt1 from Efungumab_HeavyChain_LightChain
  source 1..750: mol_type = other RNA
atggccgaggtgcagctggtcgagagcggcgccgaggtgaagaagcccggggagtccctccgcatcagctgcaagggctccgggtgcatcatcagctcctactggatcagctgggtgcggcagatgccgggcaaggggctggagtggatgggcaagatcgaccccggcgactcctacatcaactacagcccctccttccaggggcacgtcaccatcagcgcggacaagtccatcaacaccgcctacctgcagtggaacagcctcaaggcctccgacacggccatgtactactgcgcccgcggcgggcgggacttcggcgacagcttcgactactgggggcagggcaccctggtgaccgtgtccagcggcgggggcgggtccggcggcgggggcagcgggggcgggggctccgacgtcgtgatgacccagagccccagcttcctgtccgcgttcgtgggcgaccgcatcacgatcacgtgccgggccagctccgggatcagccgctacctcgcctggtaccagcaggccccgggcaaggcgcccaagctgctgatctacgccgcctccaccctccagaccggggtccccagccggttctccggcagcgggtccggcaccgagttcaccctgaccatcaacagcctgcagcccgaggacttcgccacctactactgccagcacctcaactcctacccgctgacgttcggcgggggcaccaaggtggacatcaagcgcgccgcggccctggag

SEQ ID NO: 8632 - RNA, 339 nt, synthetic construct
  misc_feature 1..339: note = derived and/or modified sequence opt1 from Efungumab_LightChain
  source 1..339: mol_type = other RNA
gacgtggtcatgacccagagcccctccttcctgagcgccttcgtgggcgaccgcatcaccatcacgtgccgggcctccagcgggatctcccgctacctcgcgtggtaccagcaggccccgggcaaggcccccaagctgctgatctacgccgccagcaccctccagaccggggtgccctcccggttcagcggctccgggagcggcaccgagttcacgctgaccatcaactccctgcagcccgaggacttcgcgacctactactgccagcacctcaacagctacccgctgaccttcggcgggggcacgaaggtcgacatcaagcgcgccgccgccctggag

SEQ ID NO: 8633 - RNA, 1350 nt, synthetic construct
  misc_feature 1..1350: note = derived and/or modified sequence opt1 from Elezanumab_HeavyChain
  source 1..1350: mol_type = other RNA
gaggtgcagctggtccagagcggcgccgaggtgaagaagcccggggcctccgtgaaggtcagctgcaaggcgtccggctacaccttcaccagccacgggatctcctgggtgcgccaggccccgggccaggggctcgactggatgggctggatcagcccctactccggcaacacgaactacgcccagaagctgcaggggcgggtgaccatgaccaccgacacgagcacctccaccgcctacatggagctgagctccctccgcagcgaggacaccgccgtctactactgcgcgcgggtgggctccgggccctactactacatggacgtgtggggccaggggacgctggtcaccgtgagctccgccagcaccaagggcccctccgtgttcccgctggcccccagctccaagagcaccagcggcgggacggccgcgctcggctgcctggtcaaggactacttccccgagcccgtgaccgtgtcctggaacagcggggccctgacctccggcgtccacaccttcccggccgtgctccagagctccggcctgtacagcctgtccagcgtggtcacggtgccctccagctccctcgggacccagacctacatctgcaacgtgaaccacaagcccagcaacaccaaggtcgacaagaaggtggagcccaagtcctgcgacaagacgcacacgtgcccgccctgccccgcccccgaggccgcgggcgggccgagcgtgttcctgttcccgcccaagcccaaggaccagctgatgatctcccgcacccccgaggtgacctgcgtcgtcgtggacgtgagccacgaggaccccgaggtcaagttcaactggtacgtggacggcgtggaggtccacaacgccaagaccaagccccgggaggagcagtacaactccacctaccgcgtggtgagcgtcctcaccgtgctgcaccaggactggctgaacgggaaggagtacaagtgcaaggtgtccaacaaggccctccccgccccgatcgagaagaccatcagcaaggccaagggccagccccgggagccccaggtctacacgctgcccccgagccgcgaggagatgaccaagaaccaggtgtccctgacctgcctcgtgaagggcttctaccccagcgacatcgcggtcgagtgggagtccaacgggcagcccgagaacaactacaagaccacgccgcccgtgctggacagcgacggctccttcttcctgtacagcaagctcaccgtggacaagtcccggtggcagcaggggaacgtcttcagctgctccgtgctgcacgaggccctgcacaaccactacacccagaagtccctcagcctgagccccggcaag

SEQ ID NO: 8634 - RNA, 645 nt, synthetic construct
  misc_feature 1..645: note = derived and/or modified sequence opt1 from Elezanumab_LightChain
  source 1..645: mol_type = other RNA
cagagcgccctgacccagccccgctccgtgagcggctccccggggcagagcgtcaccatctcctgcacgggcaccagctccagcgtgggggactccatctacgtgagctggtaccagcagcaccccggcaaggcccccaagctcatgctgtacgacgtcaccaagcggccctccggggtgccggaccgcttcagcggctccaagagcggcaacaccgcgtccctgacgatcagcgggctccaggccgaggacgaggccgactactactgctactcctacgccggcaccgacaccctgttcgggggcgggaccaaggtgacggtcctgggccagcccaaggccgcgcccagcgtgaccctcttcccgccctccagcgaggagctgcaggccaacaaggccaccctggtgtgcctcatcagcgacttctaccccggcgccgtcaccgtggcgtggaaggccgactccagccccgtgaaggccggggtcgagacgaccaccccctccaagcagagcaacaacaagtacgccgcctccagctacctgtccctgaccccggagcagtggaagtcccaccggagctacagctgccaggtgacgcacgagggctccaccgtggagaagaccgtcgcgcccaccgagtgcagc

SEQ ID NO: 8635 - RNA, 1359 nt, synthetic construct
  misc_feature 1..1359: note = derived and/or modified sequence opt1 from Emapalumab_HeavyChain
  source 1..1359: mol_type = other RNA
gaggtgcagctgctcgagagcggcgggggcctggtccagcccgggggctccctgcgcctcagctgcgccgcctccgggttcaccttcagctcctacgcgatgagctgggtgcggcaggccccgggcaagggcctggagtgggtgtccgccatcagcgggtccggcgggagcacctactacgccgactccgtcaagggccgcttcacgatcagccgggacaactccaagaacaccctgtacctccagatgaacagcctgcgcgccgaggacaccgcggtgtactactgcgccaaggacgggtccagcggctggtacgtgccccactggttcgacccctggggccaggggaccctggtcacggtgtccagcgcctccaccaagggccccagcgtgttcccgctcgcccccagctccaagagcacctccgggggcaccgcggccctgggctgcctggtcaaggactacttccccgagcccgtgacggtgagctggaactccggggccctcaccagcggcgtccacaccttcccggccgtgctgcagtccagcgggctgtactccctcagctccgtggtcaccgtgcccagctccagcctgggcacgcagacctacatctgcaacgtgaaccacaagccctccaacaccaaggtcgacaagcgggtggagcccaagagctgcgacaagacccacacgtgcccgccctgccccgcccccgagctgctcgggggcccgtccgtgttcctgttcccgcccaagcccaaggacaccctgatgatcagccgcacccccgaggtgacctgcgtcgtggtcgacgtgtcccacgaggaccccgaggtcaagttcaactggtacgtggacggcgtggaggtccacaacgcgaagacgaagccccgggaggagcagtacaacagcacctaccgcgtggtgagcgtcctcaccgtgctgcaccaggactggctgaacgggaaggagtacaagtgcaaggtgtccaacaaggccctccccgccccgatcgagaagaccatcagcaaggccaagggccagccccgggagccccaggtctacacgctgcccccgtcccgcgaggagatgaccaagaaccaggtgagcctgacctgcctcgtgaaggggttctacccctccgacatcgccgtcgagtgggagagcaacggccagcccgagaacaactacaagaccacgccgcccgtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccggcaag

SEQ ID NO: 8636 - RNA, 651 nt, synthetic construct
  misc_feature 1..651: note = derived and/or modified sequence opt1 from Emapalumab_LightChain
  source 1..651: mol_type = other RNA
aacttcatgctgacccagccccacagcgtgtccgagagcccgggcaagaccgtcacgatctcctgcacccgcagctccgggagcatcgcctccaactacgtgcagtggtaccagcagcggcccggcagctcccccaccaccgtgatctacgaggacaaccagcgccccagcggggtcccggaccggttctccggcagcatcgactccagctccaacagcgcctccctcacgatcagcgggctgaagaccgaggacgaggcggactactactgccagtcctacgacggcagcaaccgctggatgttcggcgggggcaccaagctgaccgtgctcgggcagcccaaggccgcccccagcgtgacgctgttcccgccctccagcgaggagctgcaggccaacaaggccaccctcgtctgcctgatctccgacttctaccccggcgcggtgaccgtggcctggaaggccgacagctcccccgtcaaggccggggtggagaccacgacccccagcaagcagtccaacaacaagtacgcggccagctcctacctgagcctcaccccggagcagtggaagtcccaccggagctactcctgccaggtgacccacgagggcagcacggtcgagaagaccgtggcccccaccgagtgctcc

SEQ ID NO: 8637 - RNA, 1341 nt, synthetic construct
  misc_feature 1..1341: note = derived and/or modified sequence opt1 from Enoblituzumab_HeavyChain
  source 1..1341: mol_type = other RNA
caggtggagctggtcgagagcggcgggggcctcgtgcagcccgggggctccctgcgcctgagctgcgccgcctccgggttcaccttcaccagctactggatgtcctgggtgcggcaggcgccgggcaagggcctcgagctggtcagctccatcacgagctacgggtccttcacctactacgccgacagcgtgaagggccgcttcaccatctcccgggacaacagcaagaacaccctgtacctccagatgaactccctgcgcgccgaggacacggccgtgtactactgcgcccggaacatgtacacccacttcgacagctgggggcagggcaccctggtcaccgtgtccagcgcgtccacgaaggggcccagcgtgttccccctcgccccctccagcaagagcacctccggcggcaccgccgccctggggtgcctggtcaaggactacttcccggagcccgtgaccgtgagctggaactccggcgcgctcacgagcggggtccacaccttccccgccgtgctgcagtccagcggcctgtactccctcagctccgtggtcaccgtgcccagctccagcctgggcacccagacgtacatctgcaacgtgaaccacaagccgtccaacaccaaggtcgacaagaaggtggagcccaagagctgcgacaagacccacacgtgcccgccctgccccgcccccgagctgctcgggggcccctccgtgttcctgttcccgcccaagcccaaggacaccctgatgatcagccgcacccccgaggtgacctgcgtcgtggtcgacgtgtcccacgaggaccccgaggtcaagttcaactggtacgtggacggggtggaggtccacaacgccaagaccaagccgcgggaggagcagtacaacagcacgtaccgcgtggtgtccgtcctcaccgtgctgcaccaggactggctgaacggcaaggagtacaagtgcaaggtgagcaacaaggccctccccgcgcccatcgagaagaccatcagcaaggccaaggggcagccccgggagccgcaggtctacaccctgccgccctcccgcgacgagctgacgaagaaccaggtgagcctgacctgcctcgtgaagggcttctacccctccgacatcgccgtcgagtgggagagcaacggccagcccgagaacaactacaagaccaccccgcccgtgctggactccgacgggagcttcttcctctactccaagctgacggtggacaagagccggtggcagcagggcaacgtcttctcctgcagcgtgatgcacgaggccctgcacaaccactacacccagaagtccctcagcctgtcccccgggaag

SEQ ID NO: 8638 - RNA, 648 nt, synthetic construct
  misc_feature 1..648: note = derived and/or modified sequence opt1 from Enoblituzumab_LightChain
  source 1..648: mol_type = other RNA
gacatcgtgctgacccagcccccgagcgtctccggcgcccccgggcagcgcgtgaccatcagctgctccggcagctccagcaacatcgggtccaacagcgtgtcctggtaccagcagctccccggcacggcccccaagctgctgatctacgacaacagcaagcggccgtccggggtccccgaccgcttcagcggctccaagagcggcacctccgcgagcctcgccatcaccgggctgcagtccgaggacgaggccgactactactgccagagccgggacacctacggctactactgggtgttcgggggcgggacgaagctgaccgtgctcggccagcccaaggccgccccctccgtcaccctgttcccgcccagcagcgaggagctgcaggcgaacaaggccaccctcgtgtgcctgatctccgacttctaccccggcgccgtgacggtcgcctggaagggggacagctcccccgtgaaggcgggcgtggagaccaccaccccgagcaagcagtccaacaacaagtacgccgccagctcctacctgagcctcacgcccgagcagtggaagtcccaccgcagctactcctgccaggtcacccacgaggggagcaccgtggagaagaccgtggcccccacggagtgctcc

SEQ ID NO: 8639 - RNA, 1323 nt, synthetic construct
  misc_feature 1..1323: note = derived and/or modified sequence opt1 from Eptinezumab_HeavyChain
  source 1..1323: mol_type = other RNA
gaggtgcagctggtcgagagcggcgggggcctcgtgcagcccgggggctccctgcgcctgagctgcgccgtgtccgggatcgacctcagcggctactacatgaactgggtccggcaggccccgggcaaggggctggagtgggtgggcgtgatcgggatcaacggcgcgacctactacgcctcctgggccaaggggcgcttcaccatcagccgggacaactccaagacgaccgtctacctgcagatgaacagcctccgcgccgaggacaccgccgtgtacttctgcgcgcggggcgacatctggggccaggggaccctggtgacggtctccagcgcctccaccaagggccccagcgtgttccccctggccccctccagcaagtccaccagcgggggcaccgccgcgctcggctgcctggtgaaggactacttcccggagcccgtcacggtgtcctggaacagcggggccctgacctccggcgtgcacaccttccccgccgtcctccagagcagcgggctgtactccctgagctccgtggtgaccgtccccagctccagcctcggcacgcagacctacatctgcaacgtgaaccacaagccgtccaacaccaaggtggacgcccgcgtcgagcccaagagctgcgacaagacccacacgtgcccgccctgcccggcccccgagctgctcgggggcccctccgtgaccctgttcccgcccaagcccaaggacaccctgatgatcagccggacccccgaggtgacgtgcgtcgtggtcgacgtgtcccacgaggaccccgaggtgaagttcaactggtacgtcgacggcgtggaggtgcacaacgcgaagaccaagccgcgcgaggagcagtacgccagcacctaccgggtcgtgtccgtgctgaccgtcctccaccaggactggctgaacgggaaggagtacaagtgcaaggtgagcaacaaggccctgcccgcccccatcgagaagacgatctccaaggccaagggccagccccgcgagccccaggtgtacaccctcccgcccagccgggaggagatgaccaagaaccaggtctccctgacctgcctggtgaaggggttctaccccagcgacatcgcggtggagtgggagtccaacggccagcccgagaacaactacaagacgaccccgcccgtcctcgacagcgacgggagcttcttcctgtactccaagctgaccgtggacaagagccgctggcagcagggcaacgtgttctcctgcagcgtcatgcacgaggccctccacaaccactacacccagaagtccctgagcctgtcccccggcaag

SEQ ID NO: 8640 - RNA, 657 nt, synthetic construct
  misc_feature 1..657: note = derived and/or modified sequence opt1 from Eptinezumab_LightChain
  source 1..657: mol_type = other RNA
caggtgctgacccagagcccctccagcctctccgccagcgtcggcgaccgcgtgaccatcaactgccaggcctcccagagcgtgtaccacaacacgtacctggcgtggtaccagcagaagccggggaaggtccccaagcagctgatctacgacgcctccaccctcgccagcggcgtgccctcccggttcagcgggtccggcagcgggaccgacttcaccctgacgatctccagcctgcagcccgaggacgtggccacctactactgcctcggctcctacgactgcaccaacggcgactgcttcgtcttcgggggcgggaccaaggtggagatcaagcgcacggtggccgcgccgagcgtcttcatcttcccgccctccgacgagcagctcaagagcggcaccgcctccgtggtgtgcctgctgaacaacttctacccccgggaggccaaggtccagtggaaggtggacaacgccctgcagagcgggaacagccaggagtccgtgaccgagcaggacagcaaggactccacctacagcctgtccagcacgctcaccctgtccaaggcggactacgagaagcacaaggtctacgcctgcgaggtgacccaccagggcctgagctcccccgtgaccaagagcttcaaccgcggcgagtgc

SEQ ID NO: 8641 - RNA, 1368 nt, synthetic construct
  misc_feature 1..1368: note = derived and/or modified sequence opt1 from Erenumab_HeavyChain
  source 1..1368: mol_type = other RNA
caggtgcagctggtcgagagcggcgggggcgtggtgcagcccgggcgctccctccggctgagctgcgccgcctccggcttcaccttcagctccttcgggatgcactgggtccgccaggcgccgggcaagggcctggagtgggtggccgtgatcagcttcgacgggtccatcaagtacagcgtcgactccgtgaagggccggttcaccatcagccgcgacaactccaagaacaccctcttcctgcagatgaacagcctgcgggccgaggacaccgccgtgtactactgcgcccgcgaccggctcaactactacgactccagcgggtactaccactacaagtactacggcatggcggtctgggggcagggcaccaccgtgacggtgtccagcgcctccaccaagggccccagcgtcttccccctggccccctgctcccgcagcaccagcgagtccaccgccgcgctggggtgcctcgtgaaggactacttcccggagcccgtgacggtcagctggaactccggcgccctgaccagcggggtgcacaccttccccgccgtgctgcagtccagcggcctctactccctgagctccgtcgtgaccgtgcccagctccaacttcggcacgcagacctacacgtgcaacgtcgaccacaagccgagcaacaccaaggtggacaagacggtggagcggaagtgctgcgtcgagtgcccgccctgccccgccccgcccgtggccgggccctccgtcttcctgttcccgcccaagcccaaggacaccctcatgatcagccgcacccccgaggtgacctgcgtggtcgtggacgtgtcccacgaggaccccgaggtccagttcaactggtacgtggacggcgtggaggtccacaacgcgaagacgaagccgcgggaggagcagttcaacagcaccttccgcgtggtgtccgtcctgaccgtggtgcaccaggactggctgaacgggaaggagtacaagtgcaaggtcagcaacaagggcctccccgcccccatcgagaagaccatctccaagacgaaggggcagccccgggagccccaggtgtacaccctgccgcccagccgcgaggagatgaccaagaaccaggtgagcctgacctgcctcgtcaagggcttctacccctccgacatcgccgtggagtgggagagcaacggccagcccgagaacaactacaagacgaccccgcccatgctggactccgacgggagcttcttcctgtactccaagctcaccgtggacaagagccggtggcagcagggcaacgtcttctcctgcagcgtgatgcacgaggccctgcacaaccactacacccagaagtccctgagcctctcccccgggaag

SEQ ID NO: 8642 - RNA, 648 nt, synthetic construct
  misc_feature 1..648: note = derived and/or modified sequence opt1 from Erenumab_LightChain
  source 1..648: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgatctacgacaacaacaagcgcccgtccggcatccccgaccggttcagcgggtccaagagcggcacctccaccaccctcggcatcacggggctgcagaccggcgacgaggccgactactactgcgggacctgggacagccgcctgtccgccgtcgtgttcggcgggggcaccaagctcacggtgctgggccagcccaaggccaaccccaccgtcaccctgttcccgcccagctccgaggagctccaggccaacaaggcgaccctggtgtgcctgatcagcgacttctaccccggggccgtgacggtcgcctggaaggccgacggctcccccgtgaaggcgggggtggagaccaccaagccgagcaagcagagcaacaacaagtacgccgcctccagctacctctccctgacccccgagcagtggaagtcccaccggagctacagctgccaggtcacgcacgagggctccaccgtggagaagaccgtggcccccaccgagtgcagc

SEQ ID NO: 8643 - RNA, 1344 nt, synthetic construct
  misc_feature 1..1344: note = derived and/or modified sequence opt1 from Fremanezumab_HeavyChain
  source 1..1344: mol_type = other RNA
gaggtgcagctggtcgagagcggcgggggcctcgtgcagcccgggggctccctgcgcctgagctgcgccgcctccgggttcaccttcagcaactactggatctcctgggtgcggcaggcgccgggcaagggcctcgagtgggtcgccgagatccgcagcgagtccgacgccagcgccacccactacgccgaggcggtgaaggggcggttcacgatctcccgcgacaacgccaagaacagcctgtacctgcagatgaactccctccgggccgaggacaccgccgtgtactactgcctggcgtacttcgactacggcctggccatccagaactactgggggcagggcaccctcgtcaccgtgagctccgccagcacgaaggggccctccgtgttccccctggccccctgcagccgctccaccagcgagtccaccgccgcgctgggctgcctcgtcaaggactacttcccggagcccgtgaccgtgagctggaacagcggcgccctgacgtccggggtccacaccttccccgccgtgctgcagagctccggcctctacagcctgtccagcgtggtcaccgtgccctccagcaacttcgggacccagacgtacacgtgcaacgtggaccacaagccgtccaacaccaaggtcgacaagaccgtggagcggaagtgctgcgtggagtgcccgccctgccccgccccgcccgtcgccggccccagcgtgttcctgttcccgcccaagcccaaggacaccctcatgatctcccgcacccccgaggtgacctgcgtcgtggtcgacgtgagccacgaggaccccgaggtgcagttcaactggtacgtcgacggcgtggaggtgcacaacgcgaagaccaagccccgggaggagcagttcaactccacgttccgcgtcgtgagcgtgctgaccgtcgtgcaccaggactggctgaacgggaaggagtacaagtgcaaggtgtccaacaagggcctccccagctccatcgagaagaccatcagcaagaccaaggggcagccccgggagccccaggtctacacgctgccgccctcccgcgaggagatgaccaagaaccaggtgagcctgacctgcctcgtgaagggcttctaccccagcgacatcgccgtcgagtgggagtccaacgggcagcccgagaacaactacaagaccacgccgcccatgctggacagcgacggctccttcttcctgtacagcaagctcaccgtggacaagtcccggtggcagcagggcaacgtgttcagctgctccgtcatgcacgaggccctgcacaaccactacacccagaagtccctgagcctcagccccgggaag

SEQ ID NO: 8644 - RNA, 642 nt, synthetic construct
  misc_feature 1..642: note = derived and/or modified sequence opt1 from Fremanezumab_LightChain
  source 1..642: mol_type = other RNA
gagatcgtgctgacccagagccccgccaccctctccctgagcccgggcgagcgggccacgctgtcctgcaaggcgagcaagcgggtcaccacctacgtgtcctggtaccagcagaagcccgggcaggcgccccgcctcctgatctacggcgccagcaaccggtacctggggatccccgcccgcttctccggcagcgggtccggcaccgacttcacgctcaccatcagctccctggagccggaggacttcgccgtgtactactgcagccagtcctacaactacccctacaccttcggccaggggaccaagctggagatcaagcggacggtcgccgcccccagcgtgttcatcttcccgccctccgacgagcagctcaagagcggcaccgcctccgtggtctgcctgctgaacaacttctacccccgcgaggccaaggtgcagtggaaggtggacaacgcgctccagagcgggaactcccaggagagcgtcaccgagcaggacagcaaggactccacctacagcctgtccagcacgctgaccctctccaaggccgactacgagaagcacaaggtgtacgcctgcgaggtgacccaccagggcctgagctcccccgtcaccaagagcttcaaccgcggggagtgc

SEQ ID NO: 8645 - RNA, 1371 nt, synthetic construct
  misc_feature 1..1371: note = derived and/or modified sequence opt1 from Frunevetmab_HeavyChain
  source 1..1371: mol_type = other RNA
caggtgcagctggtcgagagcggcgccgagctcgtgcagcccggggagtccctgcgcctgacctgcgccgcgagcggcttctccctcaccaacaacaacgtgaactgggtccggcaggcccccgggaagggcctggagtggatgggcggggtgtgggccggcggggccacggactacaacagcgccctgaagtcccgcctcaccatcacccgggacaccagcaagaacacggtgttcctgcagatgcactccctgcagagcgaggacaccgcgacctactactgcgcccgcgacggcgggtactccagctccaccctctacgccatggacgcctggggccaggggacgaccgtcaccgtgagcgcggcctccaccacggcccccagcgtgttccccctggccccctcctgcggcaccaccagcggcgccaccgtcgcgctggcctgcctcgtgctggggtacttcccggagcccgtgacggtctcctggaacagcggcgccctgacctccggggtgcacaccttccccgccgtgctccaggccagcggcctgtacagcctgtccagcatggtcaccgtgccctccagccggtggctctccgacacgttcacgtgcaacgtggcgcacccgcccagcaacaccaaggtcgacaagaccgtgcgcaagaccgaccacccgcccggccccaagccctgcgactgccccaagtgcccgccgcccgagatgctcgggggcccctccatcttcatcttcccgcccaagcccaaggacaccctgagcatctcccggacccccgaggtgacctgcctcgtcgtggacctggggcccgacgacagcgacgtgcagatcacgtggttcgtcgacaacacccaggtgtacaccgccaagaccagcccccgcgaggagcagttcaactccacgtaccgggtcgtgtccgtgctgcccatcctccaccaggactggctgaagggcaaggagttcaagtgcaaggtcaacagcaagtccctgcccagccccatcgagcgcaccatctccaaggccaaggggcagccgcacgagccccaggtgtacgtgctgcccccggcccaggaggagctgagccggaacaaggtctccgtgacctgcctgatcaagagcttccacccgcccgacatcgccgtggagtgggagatcaccggccagcccgagcccgagaacaactaccgcacgaccccgccccagctcgacagcgacggcacctacttcgtctactccaagctgagcgtggaccggtcccactggcagcgcgggaacacctacacgtgcagcgtgtcccacgaggcgctgcacagccaccacacccagaagtccctcacccagagccccggcaag

SEQ ID NO: 8646 - RNA, 651 nt, synthetic construct
  misc_feature 1..651: note = derived and/or modified sequence opt1 from Frunevetmab_LightChain
  source 1..651: mol_type = other RNA
gacatcgagatgacccagagccccctgtccctcagcgtgaccccgggcgagtccgtcagcatctcctgccgcgccagcgaggacatctacaacgccctggcgtggtacctgcagaagcccgggcggagcccccgcctcctgatctacaacacggacaccctgcacaccggcgtgcccgaccggttcagcgggtccggcagcgggaccgacttcacgctcaagatctcccgcgtgcagaccgaggacgtcggcgtgtacttctgccagcactacttccactacccgcggaccttcggccaggggaccaagctggagctgaagcgcagcgacgcccagccctccgtgttcctcttccagcccagcctggacgagctgcacacgggctccgccagcatcgtctgcatcctcaacgacttctaccccaaggaggtgaacgtgaagtggaaggtcgacggggtggtgcagaacaagggcatccaggagtccaccaccgagcagaacagcaaggactccacctacagcctgagctccacgctgaccatgagctccaccgagtaccagagccacgagaagttctcctgcgaggtcacccacaagagcctcgcctccacgctggtgaagtccttcaaccggtccgagtgccagcgcgag

SEQ ID NO: 8647 - RNA, 1341 nt, synthetic construct
  misc_feature 1..1341: note = derived and/or modified sequence opt1 from Gatipotuzumab_HeavyChain
  source 1..1341: mol_type = other RNA
gaggtgcagctggtcgagagcggcgggggcctcgtgcagcccgggggctccatgcgcctgagctgcgtggcctccgggttcccgttcagcaactactggatgaactgggtccggcaggcccccggcaagggcctggagtgggtgggggagatccgcctcaagtccaacaactacaccacccactacgcggagagcgtgaagggccggttcaccatctcccgcgacgacagcaagaactccctgtacctgcagatgaacagcctcaagaccgaggacaccgccgtctactactgcacccggcactactacttcgactactgggggcagggcacgctggtgaccgtgtccagcgcctccaccaaggggcccagcgtcttccccctggccccgtccagcaagtccaccagcggcggcacggccgcgctcgggtgcctggtgaaggactacttccccgagcccgtgaccgtctcctggaacagcggcgccctgaccagcggggtgcacaccttccccgccgtgctccagtccagcggcctgtactccctgagctccgtcgtgacggtgccgagctccagcctcggcacccagacctacatctgcaacgtcaaccacaagccctccaacaccaaggtggacaagaaggtggagcccaagagctgcgacaagacgcacacgtgcccgccctgccccgcccccgagctgctcgggggcccctccgtcttcctgttcccgcccaagcccaaggacaccctgatgatcagccgcacccccgaggtgacctgcgtggtcgtggacgtctcccacgaggacccggaggtgaagttcaactggtacgtggacggggtcgaggtgcacaacgcgaagaccaagccccgggaggagcagtacaacagcacctaccgcgtggtctccgtgctgaccgtgctccaccaggactggctgaacggcaaggagtacaagtgcaaggtcagcaacaaggccctgcccgcccccatcgagaagacgatctccaaggccaaggggcagccgcgggagccccaggtgtacaccctcccgcccagccgcgacgagctgaccaagaaccaggtgtccctgacctgcctcgtcaagggcttctaccccagcgacatcgccgtggagtgggagagcaacggccagcccgagaacaactacaagacgacgcccccggtgctggactccgacgggagcttcttcctgtactccaagctcaccgtcgacaagagccggtggcagcagggcaacgtgttctcctgcagcgtgatgcacgaggggctgcacaaccactacacccagaagtccctgagcctctcccccggcaag

SEQ ID NO: 8648 - RNA, 657 nt, synthetic construct
  misc_feature 1..657: note = derived and/or modified sequence opt1 from Gatipotuzumab_LightChain
  source 1..657: mol_type = other RNA
gacatcgtgatgacccagagccccctgtccaacccggtcacccccggcgagcccgccagcatctcctgccgcagctccaagagcctcctgcactccaacgggatcacgtacttcttctggtacctgcagaagcccggccagagcccgcagctcctgatctaccagatgtccaacctggccagcggggtgcccgaccggttctccggcagcgggtccggcaccgacttcaccctccgcatcagccgggtggaggcggaggacgtcggcgtgtactactgcgcccagaacctggagctgccgcccaccttcgggcagggcacgaaggtggagatcaagcgcaccgtcgccgccccctccgtgttcatcttcccgcccagcgacgagcagctcaagtccgggaccgccagcgtggtctgcctgctgaacaacttctacccccgggaggcgaaggtgcagtggaaggtggacaacgccctccagtccggcaacagccaggagagcgtcaccgagcaggactccaaggacagcacgtactccctgagctccaccctgaccctcagcaaggccgactacgagaagcacaaggtgtacgcctgcgaggtgacccaccaggggctgtccagccccgtcacgaagtccttcaaccgcggcgagtgc

SEQ ID NO: 8649 - RNA, 1365 nt, synthetic construct
  misc_feature 1..1365: note = derived and/or modified sequence opt1 from Gedivumab_HeavyChain
  source 1..1365: mol_type = other RNA
gaggtgcagctggtcgagagcggcgggggcgtggtgcagcccgggaagtccctccgcctgagctgcgccgcctccggcctgaccttcagctcctacgcggtccactgggtgcggcaggccccggggaagggcctcgagtgggtgaccctgatcagctacgacggcgccaaccagtactacgccgactccgtcaaggggcgcttcacgatcagccgggacaactccaagaacaccgtgtacctgcagatgaacagcctccgccccgaggacaccgccgtgtactactgcgcggtccccggccccgtgttcgggatcttcccgccctggtcctacttcgacaactggggccaggggatcctggtgaccgtcagctccgccagcacgaagggcccctccgtgttccccctggccccgagctccaagagcacctccggcgggaccgccgcgctcggctgcctggtgaaggactacttccccgagcccgtcaccgtgagctggaacagcggggccctgacgtccggcgtgcacaccttccccgccgtcctccagagctccggcctgtacagcctgtccagcgtggtgaccgtcccgtccagctccctcgggacccagacgtacatctgcaacgtgaaccacaagcccagcaacaccaaggtggacaagaaggtcgagcccaagtcctgcgacaagacccacacgtgcccgccctgccccgcccccgagctgctgggcgggcccagcgtgttcctcttcccgcccaagcccaaggacaccctgatgatctcccggacccccgaggtgacctgcgtcgtggtcgacgtgagccacgaggacccggaggtgaagttcaactggtacgtcgacggcgtggaggtgcacaacgccaagaccaagccccgcgaggagcagtacaactccacgtaccgggtcgtgagcgtgctgaccgtcctccaccaggactggctgaacgggaaggagtacaagtgcaaggtgtccaacaaggcgctgcccgcccccatcgagaagaccatcagcaaggccaagggccagccgcgcgagccccaggtgtacaccctcccgccctcccgggaggagatgacgaagaaccaggtcagcctgacctgcctggtgaagggcttctaccccagcgacatcgccgtggagtgggagtccaacgggcagcccgagaacaactacaagaccacgcccccggtcctcgacagcgacggctccttcttcctgtacagcaagctgaccgtggacaagtcccgctggcagcaggggaacgtgttcagctgctccgtcatgcacgaggccctccacaaccactacacccagaagtccctgagcctgagccccggcaag

SEQ ID NO: 8650 - RNA, 648 nt, synthetic construct
  misc_feature 1..648: note = derived and/or modified sequence opt1 from Gedivumab_LightChain
  source 1..648: mol_type = other RNA
gagatcgtgctgacccagagccccgccaccctctccgtcagcccgggcgagcgcgccacgctgtcctgccgggcgagccaggtgatctcccacaacctggcctggtaccagcagaagcccgggcaggcgccccgcctcctgatctacggcgccagcacccgggcctccgggatccccgcccgcttcagcggctccgggagcggcaccgactacaccctgacgatcacctccctccagagcgaggacttcgccgtgtactactgccagcactactccaactggccgccccggctgaccttcggcgggggcaccaaggtcgagatcaagcgcacggtggccgcccccagcgtgttcatcttcccgccctccgacgagcagctcaagagcgggaccgcgtccgtcgtgtgcctgctgaacaacttctacccccgggaggccaaggtgcagtggaaggtcgacaacgccctgcagagcggcaactcccaggagagcgtgaccgagcaggacagcaaggactccacctacagcctctccagcacgctgaccctgtccaaggccgactacgagaagcacaaggtgtacgcctgcgaggtcacccaccaggggctcagctcccccgtgaccaagagcttcaaccgcggcgagtgc

SEQ ID NO: 8651 - RNA, 1329 nt, synthetic construct
  misc_feature 1..1329: note = derived and/or modified sequence opt1 from Gemetuzumab_HeavyChain
  source 1..1329: mol_type = other RNA
gaggtgcagctggtccagagcggcgccgaggtgaagaagcccgggtccagcgtgaaggtctcctgcaaggccagcggctacaccatcaccgactccaacatccactgggtgcgccaggcgcccgggcagagcctcgagtggatcggctacatctacccctacaacgggggcacggactacaaccagaagttcaagaaccgggccaccctgaccgtggacaaccccaccaacacggcctacatggagctgtccagcctccgctccgaggacaccgccttctactactgcgtcaacggcaacccctggctggcctactgggggcagggcaccctggtgaccgtgagctccgcgagcacgaaggggccgtccgtcttccccctcgccccctgcagccggtccaccagcgagtccaccgccgccctgggctgcctggtgaaggactacttccccgagccggtgaccgtcagctggaactccggggcgctcacgagcggcgtgcacaccttccccgccgtgctgcagagctccggcctgtacagcctctccagcgtcgtgaccgtgccctccagctccctggggaccaagacgtacacgtgcaacgtcgaccacaagcccagcaacaccaaggtggacaagcgcgtggagtccaagtacggcccgccctgcccgccctgccccgcccccgagttcctcgggggccccagcgtcttcctgttcccgcccaagcccaaggacaccctgatgatctcccggacccccgaggtgacctgcgtggtcgtggacgtcagccaggaggaccccgaggtgcagttcaactggtacgtggacggcgtcgaggtgcacaacgccaagaccaagccgcgcgaggagcagttcaactccacctaccgggtggtcagcgtgctgacggtgctccaccaggactggctgaacgggaaggagtacaagtgcaaggtctccaacaagggcctgcccagctccatcgagaagaccatcagcaaggccaaggggcagccccgcgagccccaggtgtacaccctcccgccctcccaggaggagatgaccaagaaccaggtgagcctgacgtgcctggtcaagggcttctaccccagcgacatcgcggtggagtgggagtccaacgggcagccggagaacaactacaagaccaccccgcccgtgctcgacagcgacggctccttcttcctgtacagccggctgaccgtcgacaagtcccgctggcaggagggcaacgtgttcagctgctccgtgatgcacgaggccctccacaaccactacacgcagaagtccctgagcctgagcctcgggaag

SEQ ID NO: 8652 - RNA, 654 nt, synthetic construct
  misc_feature 1..654: note = derived and/or modified sequence opt1 from Gemetuzumab_LightChain
  source 1..654: mol_type = other RNA
gacatccagctgacccagagcccctccaccctcagcgcctccgtgggcgaccgcgtcacgatcacgtgccgggccagcgagtccctggacaactacgggatccgcttcctgacctggttccagcagaagccgggcaaggcgcccaagctcctgatgtacgccgccagcaaccaggggtccggcgtgcccagccggttctccgggagcggctccggcaccgagttcaccctgaccatcagctccctccagcccgacgacttcgccacctactactgccagcagaccaaggaggtgccgtggagcttcgggcagggcacgaaggtcgaggtgaagcgcaccgtggccgcgccctccgtcttcatcttcccgcccagcgacgagcagctgaagtccgggaccgccagcgtggtgtgcctgctcaacaacttctacccccgggaggccaaggtccagtggaaggtggacaacgccctgcagtccggcaacagccaggagagcgtgaccgagcaggactccaaggacagcacgtactccctgagctccaccctcaccctgagcaaggcggactacgagaagcacaaggtctacgcctgcgaggtgacccaccaggggctgtccagccccgtgacgaagtccttcaaccgcggcgagtgc

SEQ ID NO: 8653 - RNA, 1365 nt, synthetic construct
  misc_feature 1..1365: note = derived and/or modified sequence opt1 from Gilvetmab_HeavyChain
  source 1..1365: mol_type = other RNA
gaggtgcagctggtccagagcggcggggacctcgtgaagcccggcgggtccgtgcgcctgagctgcgtcgcctccggcttcaacatcaagaacacctacatgcactgggtgcggcaggcccccgggaagggcctgcagtggatcggccgcatcgcgcccgccaacgtggacaccaagtacgcccccaagttccaggggaaggccacgatcagcgccgacaccgcgaagaacaccgcctacatgcagctcaactccctgcgggccgaggacaccgccgtctactactgcgtgctgatctactacgactacgacggcgacatcgacgtgtgggggcagggcacgctcgtcaccgtgagctccgcgagcaccaccgccccctccgtgttcccgctggcccccagctgcgggtccacgagcggctccaccgtcgccctggcctgcctcgtgagcggctacttccccgagcccgtgaccgtctcctggaacagcgggtccctgaccagcggcgtgcacacgttcccgtccgtgctgcagagcagcgggctctactccctgagctccatggtcaccgtgcccagctcccgctggcccagcgagaccttcacgtgcaacgtggcgcaccccgcctccaagaccaaggtcgacaagccggtgcccaagcgggagaacggccgcgtgccccggcccccggactgccccaagtgccccgcccccgagatgctgggcgggccgagcgtcttcatcttcccgcccaagcccaaggacaccctcctgatcgcccgcacccccgaggtgacctgcgtcgtggtggccctggaccccgaggaccccgaggtccagatctcctggttcgtggacggcaagcagatgcagacggcgaagacccagccccgggaggagcagttcgccgggacctaccgcgtggtcagcgtgctcccgatcggccaccaggactggctgaaggggaagcagttcacgtgcaaggtgaacaacaaggccctgccctcccccatcgagcggaccatcagcaaggcccgcggccaggcccaccagccgtccgtctacgtgctcccgcccagccgggaggagctgtccaagaacaccgtgagcctgacctgcctcatcaaggacttcttcccgcccgacatcgacgtcgagtggcagtccaacggccagcaggagcccgagagcaagtaccgcaccacgccgccccagctggacgaggacgggtcctacttcctgtacagcaagctcagcgtggacaagtcccggtggcagcgcggcgacaccttcatctgcgcggtgatgcacgaggccctgcacaaccactacacccaggagagcctgtcccacagccccgggaag

SEQ ID NO: 8654 - RNA, 654 nt, synthetic construct
  misc_feature 1..654: note = derived and/or modified sequence opt1 from Gilvetmab_LightChain
  source 1..654: mol_type = other RNA
gacatcgtgatgacccagacgcccctgagcctctccgtcagcctgggcgagccggcctccatcagctgccacgcctcccagaacatcaacgtgtggctgagctggtaccgccagaagcccgggcagatcccccagctcctgatctacaaggcgtcccacctccacaccggcgtgcccgaccggttcagcgggtccggcagcgggaccgacttcaccctgcgcatctcccgggtcgaggccgacgacgccggcgtgtactactgccagcagggccagagctggccgctgaccttcgggcagggcacgaaggtggagatcaagcgcaacgacgcccagcccgccgtctacctgttccagccctcccccgaccagctccacaccgggagcgcgtccgtggtgtgcctgctgaacagcttctacccgaaggacatcaacgtcaagtggaaggtggacggcgtgatccaggacaccgggatccaggagtccgtcaccgagcaggacagcaaggactccacgtacagcctcagctccaccctgaccatgagctccaccgagtacctgagccacgagctctactcctgcgagatcacgcacaagagcctgccctccaccctgatcaagagcttccagcggtccgagtgccagcgcgtggac

SEQ ID NO: 8655 - RNA, 1344 nt, synthetic construct; identical to SEQ ID NO: 7938
  misc_feature 1..1344: note = derived and/or modified sequence opt1 from Ifabotuzumab_HeavyChain
  source 1..1344: mol_type = other RNA

SEQ ID NO: 8656 - RNA, 642 nt, synthetic construct; identical to SEQ ID NO: 7939
  misc_feature 1..642: note = derived and/or modified sequence opt1 from Ifabotuzumab_LightChain
  source 1..642: mol_type = other RNA

SEQ ID NO: 8657 - RNA, 1323 nt, synthetic construct
  misc_feature 1..1323: note = derived and/or modified sequence opt1 from Iratumumab_HeavyChain
  source 1..1323: mol_type = other RNA
caggtgcagctgcagcagtggggcgccgggctcctgaagcccagcgagaccctgtccctgacctgcgccgtctacggcgggagcttctccgcgtactactggagctggatccgccagccgcccggcaaggggctggagtggatcggcgacatcaaccacggcgggggcacgaactacaacccctccctcaagagccgggtgaccatctccgtggacaccagcaagaaccagttctccctcaagctgaacagcgtcaccgccgccgacacggccgtgtactactgcgcctccctgaccgcgtactgggggcagggcagcctcgtgaccgtctccagcgcctccaccaaggggcccagcgtgttcccgctggccccctccagcaagtccacgagcggcggcaccgccgcgctggggtgcctcgtgaaggactacttccccgagcccgtcaccgtgagctggaactccggcgccctgaccagcggggtgcacacgttcccggccgtcctgcagtccagcggcctctactccctgagctccgtggtgaccgtccccagctccagcctgggcacccagacctacatctgcaacgtgaaccacaagccctccaacacgaaggtggacaagaaggtcgagcccaagagctgcgacaagacccacacgtgcccgccctgccccgcccccgagctcctcgggggcccgtccgtgttcctgttcccgcccaagcccaaggacaccctgatgatcagccgcacccccgaggtgacctgcgtcgtggtggacgtctcccacgaggaccccgaggtgaagttcaactggtacgtcgacggggtggaggtgcacaacgccaagaccaagccccgggaggagcagtacaacagcacctaccgcgtcgtgtccgtgctgacggtcctgcaccaggactggctcaacggcaaggagtacaagtgcaaggtgagcaacaaggcgctgcccgccccgatcgagaagaccatctccaaggccaaggggcagccccgggagccccaggtgtacaccctgcccccgagccgcgacgagctcaccaagaaccaggtcagcctgacgtgcctggtgaagggcttctacccctccgacatcgccgtggagtgggagagcaacggccagcccgagaacaactacaagaccaccccgcccgtcctcgactccgacgggagcttcttcctgtactccaagctgaccgtggacaagagccggtggcagcagggcaacgtgttctcctgcagcgtcatgcacgaggccctccacaaccacacgcagaagtccctgagcctgtcccccgggaag

SEQ ID NO: 8658 - RNA, 642 nt, synthetic construct
  misc_feature 1..642: note = derived and/or modified sequence opt1 from Iratumumab_LightChain
  source 1..642: mol_type = other RNA
gacatccagatgacccagagccccacctccctgagcgcctccgtgggcgaccgcgtcacgatcacgtgccgggccagccaggggatctccagctggctcacctggtaccagcagaagccggagaaggcgcccaagtccctgatctacgccgccagctccctgcagagcggcgtgccctcccgcttcagcgggtccggcagcgggaccgacttcacgctcaccatctccagcctgcagcccgaggacttcgccacctactactgccagcagtacgactcctacccgatcaccttcggccagggcacgcggctggagatcaagcgcaccgtggccgcgcccagcgtcttcatcttcccgccctccgacgagcagctcaagagcgggaccgccagcgtggtgtgcctgctgaacaacttctacccccgggaggccaaggtccagtggaaggtggacaacgccctccagtccggcaacagccaggagtccgtgaccgagcaggacagcaaggactccacgtacagcctgtccagcaccctgaccctctccaaggcggactacgagaagcacaaggtctacgcctgcgaggtgacccaccaggggctgagctcccccgtgaccaagagcttcaaccgcggcgagtgc

SEQ ID NO: 8659 - RNA, 1344 nt, synthetic construct
  misc_feature 1..1344: note = derived and/or modified sequence opt1 from Lacnotuzumab_HeavyChain
  source 1..1344: mol_type = other RNA
caggtgcagctgcaggagagcggccccgggctcgtcaagccgtcccagaccctgagcctgacctgcacggtgtccgactacagcatcacctccgactacgcctggaactggatccgccagttccccggcaaggggctcgagtggatgggctacatcagctactccgggagcacctcctacaaccccagcctgaagtcccggatcaccatcagccgcgacacgtccaagaaccagttcagcctgcagctcaactccgtgaccgccgcggacaccgccgtctactactgcgccagcttcgactacgcccacgccatggactactggggccagggcaccacggtgaccgtgtccagcgcgtccaccaaggggcccagcgtcttcccgctggcccccagctccaagagcacctccggcgggacggccgccctgggctgcctcgtgaaggactacttccccgagcccgtgaccgtcagctggaactccggggcgctgaccagcggcgtgcacaccttcccggccgtgctgcagtccagcggcctctactccctgagctccgtcgtgacggtgcccagctccagcctggggacccagacctacatctgcaacgtcaaccacaagccctccaacaccaaggtggacaagcgggtggagcccaagagctgcgacaagacgcacacgtgcccgccctgccccgcccccgagctcctgggcgggccgtccgtcttcctgttcccgcccaagcccaaggacaccctcatgatcagccgcacccccgaggtgacctgcgtggtcgtggacgtgtcccacgaggaccccgaggtcaagttcaactggtacgtggacggcgtcgaggtgcacaacgccaagaccaagccccgggaggagcagtacaacagcacctaccgcgtggtcagcgtgctgaccgtgctgcaccaggactggctcaacggcaaggagtacaagtgcaaggtctccaacaaggccctgcccgcgccgatcgagaagacgatcagcaaggccaaggggcagccccgggagccccaggtgtacaccctgcccccgtcccgcgaggagatgaccaagaaccaggtgagcctgacctgcctcgtcaagggcttctacccctccgacatcgccgtggagtgggagagcaacgggcagcccgagaacaactacaagacgaccccgcccgtgctggactccgacggcagcttcttcctctactccaagctgaccgtcgacaagagccggtggcagcaggggaacgtgttctcctgcagcgtgatgcacgaggccctgcacaaccactacacccagaagtccctcagcctgtcccccggcaag

SEQ ID NO: 8660 - RNA, 642 nt, synthetic construct
  misc_feature 1..642: note = derived and/or modified sequence opt1 from Lacnotuzumab_LightChain
  source 1..642: mol_type = other RNA
gacatcgtgctgacccagagccccgccttcctctccgtcaccccgggcgagaaggtgacgttcacgtgccaggccagccagtccatcgggaccagcatccactggtaccagcagaagaccgaccaggcgcccaagctgctgatcaagtacgcctccgagagcatctccggcatccccagccggttctccgggagcggctccgggaccgacttcaccctcaccatcagctccgtggaggccgaggacgccgccgactactactgccagcagatcaacagctggcccaccacgttcggcggcgggaccaagctggagatcaagcggaccgtcgcggccccgtccgtgttcatcttcccgcccagcgacgagcagctgaagtccggcaccgccagcgtggtctgcctcctgaacaacttctacccccgcgaggccaaggtgcagtggaaggtggacaacgcgctgcagtccgggaacagccaggagagcgtcacggagcaggactccaaggacagcacctactccctcagctccaccctgaccctgagcaaggccgactacgagaagcacaaggtgtacgcctgcgaggtgacgcaccagggcctctccagccccgtcaccaagtccttcaaccgcggggagtgc

SEQ ID NO: 8661 - RNA, 1347 nt, synthetic construct
  misc_feature 1..1347: note = derived and/or modified sequence opt1 from Larcaviximab_HeavyChain
  source 1..1347: mol_type = other RNA
gaggtgcagctgcaggagagcggccccgagctcgagatgccgggggcctccgtcaagatcagctgcaaggcctccggcagctccttcaccgggttcagcatgaactgggtgaagcagtccaacggcaagagcctggagtggatcgggaacatcgacacctactacggcggcacgacctacaaccagaagttcaaggggaaggcgaccctgaccgtggacaagtccagctccacggcctacatgcagctcaagagcctgacctccgaggacagcgccgtctactactgcgcccgctccgcctactacggcagcaccttcgcgtactgggggcagggcaccctggtgacggtgtccgccgccagcaccaaggggccctccgtcttccccctcgcccccagcagcaagtccaccagcggcggcaccgcggccctggggtgcctggtgaaggactacttcccggagcccgtgacggtctcctggaacagcggcgccctcacctccggggtgcacaccttccccgccgtgctgcagagctccggcctgtacagcctctccagcgtcgtgaccgtgccctccagctccctgggcacgcagacctacatctgcaacgtcaaccacaagccgagcaacaccaaggtggacaagcgggtggagcccaagtcctgcgacaagacccacacgtgcccgccctgcccggcccccgagctgctcgggggccccagcgtcttcctgttcccgcccaagcccaaggacaccctgatgatctcccgcacccccgaggtgacctgcgtggtcgtggacgtgagccacgaggaccccgaggtcaagttcaactggtacgtggacggggtcgaggtgcacaacgcgaagacgaagccgcgggaggagcagtacaactccacctaccgcgtggtcagcgtgctcaccgtgctgcaccaggactggctgaacggcaaggagtacaagtgcaaggtcagcaacaaggccctccccgcccccatcgagaagaccatctccaaggccaaggggcagccccgggagccccaggtgtacacgctgccgcccagccgcgacgagctgaccaagaaccaggtgtccctgacctgcctcgtcaagggcttctaccccagcgacatcgccgtggagtgggagtccaacggccagcccgagaacaactacaagaccacgccgcccgtgctggacagcgacgggtccttcttcctctacagcaagctgaccgtcgacaagtcccggtggcagcagggcaacgtgttcagctgctccgtgatgcacgaggcgctgcacaaccactacacccagaagtccctcagcctgagccccgggaag

SEQ ID NO: 8662 - RNA, 642 nt, synthetic construct
  misc_feature 1..642: note = derived and/or modified sequence opt1 from Larcaviximab_LightChain
  source 1..642: mol_type = other RNA
gacatccagatgacccagagccccgcctccctgagcgcctccgtgggcgagaccgtcacgatcacgtgccgcgcgagcgagaacatctactcctacctcgcctggtaccagcagaagcagggcaagagcccgcagctgctggtgtacaacgccaagaccctcatcgagggggtgccctcccggttcagcgggtccggcagcgggacccagttctccctgaagatcaacagcctgcagcccgaggacttcggctcctacttctgccagcaccacttcggcacccccttcaccttcgggagcggcaccgagctcgagatcaagcgcaccgtcgccgccccgtccgtgttcatcttcccgcccagcgacgagcagctgaagtccgggacggcgagcgtggtctgcctgctcaacaacttctacccccgggaggccaaggtgcagtggaaggtggacaacgccctgcagtccggcaacagccaggagagcgtcaccgagcaggactccaaggacagcacctactccctgagctccaccctcacgctgagcaaggccgactacgagaagcacaaggtgtacgcgtgcgaggtgacccaccaggggctgtccagccccgtcaccaagtccttcaaccgcggcgagtgc

SEQ ID NO: 8663 - RNA, 1338 nt, synthetic construct
  misc_feature 1..1338: note = derived and/or modified sequence opt1 from Lendalizumab_HeavyChain
  source 1..1338: mol_type = other RNA
caggtgcagctggtccagagcggcgccgaggtgaagaagcccggggcctccgtgaaggtcagctgcaaggcgtccggctacaccttcaccgactacagcatggactgggtgcgccaggcccccgggcagggcctcgagtggatgggggccatccacctgaacacgggctacaccaactacaaccagaagttcaagggccgggtgaccatgacccgcgacacgtccaccagcaccgtctacatggagctgtccagcctccggtccgaggacaccgccgtgtactactgcgcccgcgggttctacgacggctacagccccatggactactgggggcagggcacgaccgtgaccgtctccagcgcgtccaccaaggggcccagcgtgttccccctggccccgtgctcccggagcacgtccgagagcaccgccgccctgggctgcctcgtgaaggactacttccccgagcccgtcaccgtgtcctggaacagcggcgcgctgaccagcggggtgcacacgttccccgccgtcctgcagtccagcggcctctactccctgagctccgtggtgaccgtcccgagctccaacttcgggacccagacctacacgtgcaacgtggaccacaagcccagcaacaccaaggtggacaagaccgtcgagcgcaagtgctgcgtggagtgcccgccctgcccggccccgcccgtggccggcccctccgtcttcctgttcccgcccaagcccaaggacaccctcatgatcagccggacgcccgaggtgacctgcgtcgtggtggacgtctcccaggaggaccccgaggtgcagttcaactggtacgtggacggcgtcgaggtgcacaacgccaagaccaagccccgcgaggagcagttcaacagcacctaccgggtggtctccgtgctgacggtgctgcaccaggactggctcaacgggaaggagtacaagtgcaaggtcagcaacaagggcctgccctccagcatcgagaagaccatctccaaggcgaaggggcagccccgcgagccccaggtgtacaccctgccgcccagccaggaggagatgaccaagaaccaggtgtccctcacgtgcctggtcaagggcttctaccccagcgacatcgccgtggagtgggagagcaacgggcagcccgagaacaactacaagaccaccccgcccgtgctggactccgacggcagcttcttcctctactcccggctgaccgtcgacaagagccgctggcaggagggcaacgtgttctcctgcagcgtgatgcacgaggccctgcacaaccactacacgcagaagtccctcagcctgtccctggggaag

SEQ ID NO: 8664 - RNA, 654 nt, synthetic construct
  misc_feature 1..654: note = derived and/or modified sequence opt1 from Lendalizumab_LightChain
  source 1..654: mol_type = other RNA
gacatccagatgacccagagcccctccagcctgtccgccagcgtgggcgaccgcgtcaccatcacgtgccgggcctccgagagcgtggactcctacgggaacagcttcatgcactggtaccagcagaagccgggcaaggcgcccaagctcctgatctaccgcgcctccaacctggagagcggggtgccctcccggttcagcggctccgggagcggcaccgacttcaccctcaccatctccagcctgcagcccgaggacttcgccacgtactactgccagcagtccaacgaggacccgtacaccttcggcgggggcaccaaggtcgagatcaagcgcaccgtggccgcccccagcgtgttcatcttcccgccctccgacgagcagctcaagagcgggacggcgagcgtcgtgtgcctgctgaacaacttctacccccgggaggccaaggtgcagtggaaggtcgacaacgccctgcagtccggcaacagccaggagtccgtgaccgagcaggacagcaaggactccacctacagcctctccagcaccctgacgctgtccaaggccgactacgagaagcacaaggtgtacgcgtgcgaggtcacccaccaggggctcagctcccccgtgaccaagagcttcaaccgcggcgagtgc

SEQ ID NO: 8665 - RNA, 1359 nt, synthetic construct
  misc_feature 1..1359: note = derived and/or modified sequence opt1 from Lesofavumab_HeavyChain
  source 1..1359: mol_type = other RNA
gaggtgcagctggtccagagcggcgccgaggtgaagaagcccggggagtccctcaagatcagctgcaaggtgtccggctacagcttcacctcccagtggatcgggtgggtccgccagatgcccggcaaggggctggagtggatcggcatgatgtaccccggcgagagcgagaccatctactcccccagcttccagggccaggtgacgatctccgccgacaacagcatctccaccgcgtacctgcagtggagctccctcaaggccagcgacaccgccatctactactgcgcctccgggcccgggtacagcggctaccactacgggtggttcgacacctggggccagggcacgctggtgaccgtctccagcgcctccaccaaggggccgagcgtgttccccctggcgcccagctccaagagcacctccggcgggacggccgccctcggctgcctggtgaaggactacttccccgagccggtcaccgtgagctggaactccggcgccctgaccagcggggtgcacaccttccccgcggtcctccagtccagcggcctgtactccctgagctccgtggtgacggtccccagctccagcctcgggacccagacctacatctgcaacgtgaaccacaagccctccaacaccaaggtggacaagaaggtcgagcccaagagctgcgacaagacgcacacgtgcccgccctgccccgccccggagctgctgggcgggccctccgtgttcctcttcccgcccaagcccaaggacaccctgatgatcagccggacccccgaggtgacctgcgtcgtggtggacgtctcccacgaggaccccgaggtgaagttcaactggtacgtcgacggcgtggaggtgcacaacgccaagaccaagccccgcgaggagcagtacaacagcacctaccgggtcgtgagcgtgctgaccgtcctccaccaggactggctgaacggcaaggagtacaagtgcaaggtgtccaacaaggccctgccggcccccatcgagaagacgatcagcaaggcgaaggggcagccccgcgagccccaggtgtacaccctcccgccctcccgggaggagatgaccaagaaccaggtcagcctgacctgcctggtgaagggcttctacccctccgacatcgccgtggagtgggagagcaacgggcagccggagaacaactacaagacgaccccgcccgtcctcgactccgacggcagcttcttcctgtactccaagctgaccgtggacaagagccgctggcagcaggggaacgtgttctcctgcagcgtcatgcacgaggccctccacaaccactacacccagaagtccctgagcctgtcccccggcaag

SEQ ID NO: 8666 - RNA, 657 nt, synthetic construct
  misc_feature 1..657: note = derived and/or modified sequence opt1 from Lesofavumab_LightChain
  source 1..657: mol_type = other RNA
gacatcgtgatgacccagagccccctgtccctcccggtcacccccggcgagcccgccagcatctcctgccgcagctcccagagcctgctgcggtccaacgggtacaactacctcgactggtacctgcagaagcccggccagagcccgcagctgctcatctacctggggtccaaccgcgccagcggcgtgcccgaccggttctccgggagcggctccggcacggacttcaccctgaagatcagccgcgtggaggcggaggacgtcggggtgtactactgcatgcaggccctccagaccccctacaccttcggccaggggacgaagctggagatcaagcggaccgtggccgccccctccgtcttcatcttcccgcccagcgacgagcagctgaagtccggcaccgccagcgtggtgtgcctcctgaacaacttctacccccgcgaggcgaaggtccagtggaaggtggacaacgccctgcagtccgggaacagccaggagagcgtgaccgagcaggactccaaggacagcacgtactccctcagctccaccctgaccctgagcaaggccgactacgagaagcacaaggtctacgcctgcgaggtgacccaccagggcctctccagccccgtgacgaagtccttcaaccggggcgagtgc

SEQ ID NO: 8667 - RNA, 1059 nt, synthetic construct
  misc_feature 1..1059: note = derived and/or modified sequence opt1 from Letolizumab_HeavyChain
  source 1..1059: mol_type = other RNA
gaggtgcagctgctcgagagcggcgggggcctggtccagcccgggggctccctgcgcctcagctgcgccgcctccgggttcaccttcaactgggagctgatgggctgggcgcggcaggcccccggcaaggggctggagtgggtgagcggcatcgaggggcccggcgacgtgacctactacgccgactccgtcaaggggcgcttcacgatcagccgggacaactccaagaacaccctctacctgcagatgaacagcctgcgcgccgaggacaccgccgtgtactactgcgtgaaggtcggcaaggacgcgaagtccgactaccggggccaggggaccctcgtgacggtgagctccgccagcaccgagcccaagtccagcgacaagacccacaccagcccgcccagccccgcccccgagctgctgggcgggtccagcgtcttcctcttcccgcccaagcccaaggacacgctgatgatctcccgcacccccgaggtgacctgcgtggtcgtggacgtgagccacgaggaccccgaggtcaagttcaactggtacgtggacggcgtggaggtccacaacgccaagaccaagccgcgggaggagcagtacaacagcacgtaccgcgtggtgtccgtcctgaccgtgctccaccaggactggctgaacggcaaggagtacaagtgcaaggtgagcaacaaggcgctgcccgcccccatcgagaagaccatctccaaggccaaggggcagccccgggagccgcaggtctacaccctcccgcccagccgcgacgagctgacgaagaaccaggtgtccctgacctgcctcgtcaagggcttctaccccagcgacatcgccgtggagtgggagtccaacgggcagcccgagaacaactacaagaccaccccgcccgtgctggacagcgacggctccttcttcctgtacagcaagctcacggtcgacaagtcccggtggcagcaggggaacgtgttcagctgctccgtgatgcacgaggccctgcacaaccactacacccagaagtccctgtccctcagccccggcaag

SEQ ID NO: 8668 - RNA, 1338 nt, synthetic construct
  misc_feature 1..1338: note = derived and/or modified sequence opt1 from Losatuxizumab_HeavyChain
  source 1..1338: mol_type = other RNA
gaggtgcagctgcaggagagcggccccgggctcgtcaagccgtcccagaccctgagcctgacctgcacggtgtccggctacagcatctcccgcgacttcgcctggaactggatccggcagccgcccgggaagggcctcgagtggatggggtacatcagctacaacggcaacacccgctaccagccctccctcaagagccggatcaccatctcccgcgacaccagcaagaaccagttcttcctgaagctgaactccgtgacggccgcggacaccgccacctactactgcgtcaccgccagccggggcttcccgtactgggggcagggcacgctggtgaccgtgtccagcgcctccaccaaggggcccagcgtcttccccctggccccctccagcaagtccaccagcggcgggacggcggccctcggctgcctggtgaaggactacttcccggagcccgtgaccgtcagctggaactccggcgccctgaccagcggggtgcacaccttccccgccgtgctccagtccagcggcctgtactccctgagctccgtcgtgacggtgcccagctccagcctcgggacccagacctacatctgcaacgtcaaccacaagccgtccaacaccaaggtggacaagaaggtggagcccaagagctgcgacaagacgcacacgtgcccgccctgccccgcgcccgagctgctgggcggcccctccgtcttcctcttcccgcccaagcccaaggacaccctgatgatcagccgcacccccgaggtgacctgcgtggtcgtggacgtgtcccacgaggaccccgaggtcaagttcaactggtacgtggacggggtcgaggtgcacaacgccaagaccaagccgcgggaggagcagtacaacagcacctaccgcgtggtctccgtgctgaccgtgctccaccaggactggctgaacggcaaggagtacaagtgcaaggtcagcaacaaggccctgcccgcccccatcgagaagacgatctccaaggccaaggggcagccccgggagccccaggtgtacaccctcccgcccagccgcgaggagatgaccaagaaccaggtgagcctgacctgcctggtcaagggcttctacccctccgacatcgcggtggagtgggagagcaacgggcagcccgagaacaactacaagacgaccccgcccgtgctcgactccgacggcagcttcttcctgtactccaagctgaccgtcgacaagagccggtggcagcagggcaacgtgttctcctgcagcgtgatgcacgaggccctccacaaccactacacccagaagtccctgagcctgtcccccgggaag

SEQ ID NO: 8669 - RNA, 642 nt, synthetic construct; identical to SEQ ID NO: 7847
  misc_feature 1..642: note = derived and/or modified sequence opt1 from Losatuxizumab_LightChain
  source 1..642: mol_type = other RNA

SEQ ID NO: 8670 - RNA, 1338 nt, synthetic construct
  misc_feature 1..1338: note = derived and/or modified sequence opt1 from Lupartumab_HeavyChain
  source 1..1338: mol_type = other RNA
gaggtgcagctgctcgagagcggcgggggcctggtccagcccgggggctccctgcgcctcagctgcgccgcctccgggttcaccttcagcaacgcgtggatgtcctgggtgcggcaggccccgggcaagggcctggagtgggtgagctacatctccagctccgggagcaccatctactacgccgactccgtcaagggccgcttcacgatcagccgggacaactccaagaacaccctgtacctccagatgaacagcctgcgcgccgaggacaccgccgtgtactactgcgcgcgggaggggctgtgggccttcgactactggggccaggggaccctcgtgacggtctccagcgcctccaccaagggccccagcgtgttccccctggccccctccagcaagagcacctccggcgggaccgcggccctgggctgcctcgtgaaggactacttcccggagcccgtcacggtgagctggaactccggggccctgaccagcggcgtgcacaccttccccgccgtcctgcagtccagcggcctctactccctgagctccgtggtgaccgtccccagctccagcctggggacgcagacctacatctgcaacgtgaaccacaagccgtccaacaccaaggtggacaagaaggtcgagcccaagagctgcgacaagacccacacgtgcccgccctgcccggcccccgagctcctgggcgggccctccgtgttcctgttcccgcccaagcccaaggacaccctcatgatcagccgcacccccgaggtgacctgcgtcgtggtggacgtctcccacgaggaccccgaggtgaagttcaactggtacgtcgacggcgtggaggtgcacaacgcgaagacgaagccgcgggaggagcagtacaacagcacctaccgcgtcgtgtccgtgctgaccgtcctgcaccaggactggctcaacgggaaggagtacaagtgcaaggtgagcaacaaggccctgcccgcccccatcgagaagaccatcagcaaggccaagggccagccccgggagccccaggtgtacacgctgccgccctcccgcgacgagctcaccaagaaccaggtcagcctgacctgcctggtgaagggcttctacccctccgacatcgccgtggagtgggagagcaacgggcagcccgagaacaactacaagaccacgccgcccgtcctcgactccgacggcagcttcttcctgtactccaagctgaccgtggacaagagccggtggcagcaggggaacgtgttctcctgcagcgtcatgcacgaggcgctccacaaccactacacccagaagtccctgagcctgtcccccggc

SEQ ID NO: 8671 - RNA, 651 nt, synthetic construct
  misc_feature 1..651: note = derived and/or modified sequence opt1 from Lupartumab_LightChain
  source 1..651: mol_type = other RNA
gagagcgtgctgacccagcccccgtccgtcagcggcgcccccgggcagcgcgtgaccatctcctgcacgggcagctccagcaacatcggggccggctacgtggtccactggtaccagcagctccccgggaccgcgcccaagctgctgatctacgacaacaacaagcggccgtccggcgtgcccgaccgcttcagcggctccaagagcgggacctccgccagcctcgccatctccggcctgcggagcgaggacgaggccgactactactgcgccgcgtgggacgaccgcctgaacgggcccgtgttcggcgggggcaccaagctcacggtcctgggccagcccaaggccgccccgtccgtgaccctgttcccgcccagctccgaggagctccaggccaacaaggcgaccctggtgtgcctgatcagcgacttctaccccggggccgtcaccgtggcctggaaggccgactccagccccgtgaaggccggcgtcgagacgaccacccccagcaagcagtccaacaacaagtacgcggccagctcctacctcagcctgacccccgagcagtggaagtcccaccggagctactcctgccaggtgacgcacgaggggagcaccgtggagaagaccgtcgcccccaccgagtgctcc

SEQ ID NO: 8672 - RNA, 1731 nt, synthetic construct
  misc_feature 1..1731: note = derived and/or modified sequence opt1 from Lutikizumab_HeavyChain
  source 1..1731: mol_type = other RNA
gaggtgcagctggtcgagagcggcgggggcgtggtgcagcccgggcgctccctccggctgagctgctccgccagcggcttcatcttctcccgctacgacatgagctgggtccggcaggccccggggaagggcctggagtgggtggcgtacatctcccacggcggggccggcacctactaccccgacagcgtgaaggggcgcttcaccatctcccgggacaacagcaagaacaccctcttcctgcagatggactccctgcgccccgaggacaccggcgtctacttctgcgcccgcgggggcgtgaccaagggctacttcgacgtgtgggggcagggcacccccgtcacggtgagctccgccagcaccaaggggccccaggtgcagctcgtcgagtccggcggcggggtggtgcagcccggccggagcctgcggctgtcctgcaccgccagcgggttcaccttctccatgttcggcgtccactgggtgcgccaggcgcccgggaagggcctcgagtgggtggccgccgtcagctacgacggcagcaacaagtactacgccgagtccgtgaaggggcggttcacgatcagccgcgacaactccaagaacatcctgttcctgcagatggacagcctccggctggaggacaccgcggtgtactactgcgcccgcggccggcccaaggtcgtgatcccggcgcccctggcccactgggggcagggcaccctcgtgaccttctccagcgcctccacgaaggggcccagcgtcttccccctggccccgtccagcaagtccaccagcggcggcaccgccgccctggggtgcctcgtgaaggactacttccccgagcccgtcaccgtgtcctggaacagcggcgccctgacgtccggggtgcacaccttccccgccgtcctgcagagctccggcctctacagcctgtccagcgtggtgaccgtcccgagctccagcctggggacccagacgtacatctgcaacgtgaaccacaagccctccaacaccaaggtggacaagaaggtcgagcccaagagctgcgacaagacccacacgtgcccgccgtgccccgcgcccgaggccgccggcggcccctccgtgttcctcttcccgcccaagcccaaggacacgctgatgatcagccgcacccccgaggtgacctgcgtcgtggtggacgtctcccacgaggacccggaggtgaagttcaactggtacgtggacggggtcgaggtgcacaacgccaagaccaagccccgggaggagcagtacaacagcacgtaccgcgtggtctccgtgctgaccgtgctccaccaggactggctgaacggcaaggagtacaagtgcaaggtcagcaacaaggccctgcccgcgccgatcgagaagaccatctccaaggccaaggggcagccccgggagccccaggtgtacaccctcccgcccagccgcgaggagatgacgaagaaccaggtgtccctgacctgcctggtcaagggcttctaccccagcgacatcgccgtggagtgggagtccaacggccagcccgagaacaactacaagaccacgcccccggtgctcgacagcgacgggtccttcttcctgtacagcaagctgaccgtcgacaagagccggtggcagcagggcaacgtgttctcctgcagcgtgatgcacgaggccctccacaaccactacacccagaagtccctgagcctgtcccccgggaag

SEQ ID NO: 8673 - RNA, 981 nt, synthetic construct
  misc_feature 1..981: note = derived and/or modified sequence opt1 from Lutikizumab_LightChain
  source 1..981: mol_type = other RNA
gacatccagatgacccagagcccctccagcctgtccgccagcgtgggcgaccgggtcaccatcacgtgccgggcctccgggaacatccacaactacctcacctggtaccagcagaccccgggcaaggcgcccaagctgctgatctacaacgccaagaccctcgccgacggggtgcccagccgcttctccggcagcgggtccggcacggactacaccttcaccatcagctccctgcagcccgaggacatcgccacctactactgccagcacttctggagcatcccgtacacgttcggccaggggaccaagctgcagatcacccggaccgtggccgcgcccgacatccagatgacgcagtcccccagctccgtcagcgcctccgtgggcgaccgcgtgaccatcacgtgccgggccagccaggggatctccagctggctcgcctggtaccagcagaagcccggcaaggcgccgaagctgctgatctacgaggccagcaacctcgagaccggggtcccctcccgcttcagcggctccggcagcgggtccgacttcaccctgaccatcagctccctgcagcccgaggacttcgccacctactactgccagcagaccagctccttcctcctgagcttcggcgggggcacgaaggtggagcacaagcggaccgtggccgccccctccgtcttcatcttcccgcccagcgacgagcagctgaagtccggcaccgcgagcgtggtgtgcctcctgaacaacttctacccccgcgaggccaaggtccagtggaaggtggacaacgccctgcagtccgggaacagccaggagtccgtgaccgagcaggacagcaaggactccacgtacagcctcagctccaccctgaccctgagcaaggccgactacgagaagcacaaggtctacgcctgcgaggtgacccaccagggcctctccagccccgtgacgaagtccttcaaccgcggggagtgc

SEQ ID NO: 8674 - RNA, 1341 nt, synthetic construct
  misc_feature 1..1341: note = derived and/or modified sequence opt1 from Oleclumab_HeavyChain
  source 1..1341: mol_type = other RNA
gaggtgcagctgctcgagagcggcgggggcctggtccagcccgggggctccctgcgcctcagctgcgccgcctccgggttcaccttcagctcctacgcgtacagctgggtgcggcaggccccgggcaagggcctggagtgggtgtccgccatcagcgggtccggcgggcgcacctactacgccgacagcgtcaagggccggttcacgatctcccgcgacaacagcaagaacaccctgtacctccagatgaactccctgcgggccgaggacaccgcggtgtactactgcgcccgcctggggtacggccgggtggacgagtggggccgcgggaccctcgtcacggtgagctccgccagcaccaagggcccctccgtgttccccctggcccccagctccaagagcaccagcgggggcaccgcggccctgggctgcctcgtcaaggactacttcccggagcccgtgacggtgtcctggaacagcggggccctgacctccggcgtccacaccttccccgccgtgctgcagagctccgggctctacagcctgtccagcgtggtcaccgtgccctccagctccctgggcacgcagacctacatctgcaacgtgaaccacaagccgagcaacaccaaggtcgacaagcgggtggagcccaagtcctgcgacaagacccacacgtgcccgccctgccccgcccccgagttcgagggcgggcccagcgtgttcctcttcccgcccaagcccaaggacaccctgatgatctcccgcacccccgaggtgacctgcgtcgtggtcgacgtgagccacgaggaccccgaggtcaagttcaactggtacgtggacggcgtggaggtccacaacgcgaagacgaagccgcgggaggagcagtacaactccacctaccgcgtggtgagcgtcctgaccgtgctccaccaggactggctgaacgggaaggagtacaagtgcaaggtgtccaacaaggccctgcccgccagcatcgagaagaccatcagcaaggccaagggccagccccgggagccccaggtctacacgctcccgccctcccgcgaggagatgaccaagaaccaggtgagcctgacctgcctggtgaaggggttctacccctccgacatcgccgtcgagtgggagagcaacggccagcccgagaacaactacaagaccacgccgcccgtgctcgactccgacgggagcttcttcctgtactccaagctgaccgtggacaagagccggtggcagcagggcaacgtcttctcctgcagcgtgatgcacgaggcgctccacaaccactacacccagaagtccctgagcctgtcccccggcaag

SEQ ID NO: 8675 - RNA, 648 nt, synthetic construct
  misc_feature 1..648: note = derived and/or modified sequence opt1 from Oleclumab_LightChain
  source 1..648: mol_type = other RNA
cagagcgtgctgacccagcccccgtccgccagcggcacccccgggcagcgcgtcacgatctcctgcagcggctccctcagcaacatcgggcggaaccccgtgaactggtaccagcagctgcccggcaccgccccgaagctgctcatctacctggacaacctgcgcctctccggggtgcccgaccggttcagcggctccaagagcggcacctccgcgagcctggccatctccgggctgcagagcgaggacgaggccgactactactgcgccacctgggacgactcccaccccggctggacgttcgggggcgggaccaagctcaccgtcctgggccagcccaaggccgcgccgagcgtgaccctgttcccgccctccagcgaggagctccaggccaacaaggccacgctggtgtgcctgatctccgacttctaccccggcgccgtcaccgtggcgtggaaggccgacagcagccccgtgaaggccggggtcgagaccaccacgccctccaagcagagcaacaacaagtacgccgcctccagctacctctccctgacccccgagcagtggaagtcccaccgcagctacagctgccaggtgacccacgagggctccaccgtggagaagacggtcgcgcccaccgagtgcagc

SEQ ID NO: 8676 - RNA, 1449 nt, synthetic construct; identical to SEQ ID NO: 8291
  misc_feature 1..1449: note = derived and/or modified sequence opt1 from Otlertuzumab_HeavyChain
  source 1..1449: mol_type = other RNA

SEQ ID NO: 8677 - RNA, 339 nt, synthetic construct
  misc_feature 1..339: note = derived and/or modified sequence opt1 from Ozoralizumab_HeavyChain
  source 1..339: mol_type = other RNA
gaggtgcagctggtcgagagcggcgggggcctcgtgcagcccgggggctccctgcgcctgagctgcgccgcctccgggttcaccttcagcgactactggatgtactgggtgcggcaggcgccgggcaagggcctcgagtgggtctccgagatcaacaccaacgggctgatcacgaagtaccccgacagcgtgaagggccgcttcaccatctcccgggacaacgccaagaacaccctgtacctccagatgaacagcctgcgccccgaggacaccgccgtgtactactgcgcccggtcccccagcgggttcaaccgcggccaggggacgctggtcaccgtg

SEQ ID NO: 8678 - RNA, 1089 nt, synthetic construct; identical to SEQ ID NO: 8296
  misc_feature 1..1089: note = derived and/or modified sequence opt1 from Ozoralizumab_HeavyChain_HeavyChain_HeavyChain
  source 1..1089: mol_type = other RNA

SEQ ID NO: 8679 - RNA, 1494 nt, synthetic construct
  misc_feature 1..1494: note = derived and/or modified sequence opt1 from Pasotuxizumab_HeavyChain_LightChain_HeavyChain_LightChain
  source 1..1494: mol_type = other RNA
caggtgcagctggtcgagagcggcgggggcctcgtgaagcccggggagtccctgcgcctgagctgcgccgcctccggcttcaccttcagcgactactacatgtactgggtgcggcaggcgccggggaagggcctcgagtgggtcgccatcatctccgacggcgggtactacacctactacagcgacatcatcaagggccgcttcacgatctcccgggacaacgccaagaacagcctgtacctgcagatgaactccctcaaggccgaggacaccgccgtgtactactgcgcgcgcgggttccccctgctgcggcacggcgccatggactactgggggcagggcaccctcgtgaccgtcagctccggcgggggcgggagcggcggcgggggctccgggggcgggggcagcgacatccagatgacgcagtcccccagctccctgagcgcctccgtgggcgaccgcgtgaccatcacgtgcaaggccagccagaacgtcgacaccaacgtggcgtggtaccagcagaagcccgggcaggcccccaagagcctgatctactccgccagctaccggtactccgacgtgcccagccgcttctccggcagcgcctccgggaccgacttcaccctcaccatcagctccgtccagagcgaggacttcgccacctactactgccagcagtacgactcctacccctacacgttcggcgggggcaccaagctggagatcaagagcggcgggggcgggtccgaggtgcagctggtggagagcggcgggggcctcgtccagcccggcgggtccctgaagctgagctgcgcggcctccggcttcaccttcaacaagtacgccatgaactgggtgcggcaggccccggggaagggcctcgagtgggtggcccgcatccggagcaagtacaacaactacgcgacctactacgccgactccgtcaaggaccgcttcacgatcagccgggacgacagcaagaacaccgcctacctgcagatgaacaacctgaagaccgaggacaccgccgtgtactactgcgtgcgccacggcaacttcgggaactcctacatcagctactgggcctactggggccaggggacgctcgtcaccgtgtccagcggcgggggcggctccgggggcgggggcagcgggggcggcgggtcccagaccgtggtcacccaggagcccagcctgacggtgtcccccggcgggaccgtcaccctgacctgcggcagctccacgggggcggtgaccagcggcaactaccccaactgggtgcagcagaagccgggccaggccccgcgggggctcatcggcgggaccaagttcctggcccccggcacccccgcccgcttctccgggagcctgctcggcggcaaggccgcgctgacgctgtccggggtccagccggaggacgaggccgagtactactgcgtgctctggtacagcaaccggtgggtgttcggcgggggcaccaagctgaccgtcctg

SEQ ID NO: 8680 - RNA, 357 nt, synthetic construct
  misc_feature 1..357: note = derived and/or modified sequence opt1 from Pasotuxizumab_HeavyChain1
  source 1..357: mol_type = other RNA
caggtgcagctggtcgagagcggcgggggcctcgtgaagcccggggagtccctgcgcctgagctgcgccgcctccggcttcaccttcagcgactactacatgtactgggtgcggcaggcgccggggaagggcctcgagtgggtcgccatcatctccgacggcgggtactacacctactacagcgacatcatcaagggccgcttcacgatctcccgggacaacgccaagaacagcctgtacctgcagatgaactccctcaaggccgaggacaccgccgtgtactactgcgcgcgcgggttccccctgctgcggcacggcgccatggactactgggggcagggcaccctcgtgaccgtc

SEQ ID NO: 8681 - RNA, 369 nt, synthetic construct
  misc_feature 1..369: note = derived and/or modified sequence opt1 from Pasotuxizumab_HeavyChain2
  source 1..369: mol_type = other RNA
gaggtgcagctggtcgagagcggcgggggcctcgtgcagcccgggggctccctgaagctgagctgcgccgcctccgggttcaccttcaacaagtacgcgatgaactgggtgcgccaggccccgggcaagggcctcgagtgggtcgcccggatccgcagcaagtacaacaactacgccacctactacgccgactccgtgaaggaccggttcacgatcagccgcgacgactccaagaacaccgcgtacctgcagatgaacaacctgaagaccgaggacaccgccgtgtactactgcgtccggcacgggaacttcggcaacagctacatctcctactgggcctactgggggcagggcacgctcgtgaccgtg

SEQ ID NO: 8682 - RNA, 321 nt, synthetic construct
  misc_feature 1..321: note = derived and/or modified sequence opt1 from Pasotuxizumab_LightChain1
  source 1..321: mol_type = other RNA
gacatccagatgacccagagcccctccagcctgtccgccagcgtgggcgaccgcgtcaccatcacgtgcaaggcctcccagaacgtggacaccaacgtggcgtggtaccagcagaagccggggcaggcccccaagagcctcatctactccgccagctaccggtactccgacgtccccagccgcttctccggcagcgcctccgggaccgacttcaccctgacgatcagctccgtgcagagcgaggacttcgccacctactactgccagcagtacgactcctacccctacaccttcggcgggggcaccaagctggagatcaag

SEQ ID NO: 8683 - RNA, 327 nt, synthetic construct
  misc_feature 1..327: note = derived and/or modified sequence opt1 from Pasotuxizumab_LightChain2
  source 1..327: mol_type = other RNA
cagaccgtggtcacccaggagcccagcctgacggtgtccccgggcgggaccgtgaccctgacctgcggcagctccacgggggccgtcaccagcggcaactaccccaactgggtgcagcagaagcccgggcaggcgccccgcggcctcatcggcgggaccaagttcctggccccgggcacccccgcccggttctccgggagcctcctgggcgggaaggccgccctgacgctctccggcgtgcagcccgaggacgaggccgagtactactgcgtcctgtggtacagcaaccgctgggtgttcggcgggggcaccaagctgaccgtgctc

SEQ ID NO: 8684 - RNA, 1023 nt, synthetic construct; identical to SEQ ID NO: 8340
  misc_feature 1..1023: note = derived and/or modified sequence opt1 from Placulumab_HeavyChain
  source 1..1023: mol_type = other RNA

SEQ ID NO: 8685 - RNA, 1353 nt, synthetic construct
  misc_feature 1..1353: note = derived and/or modified sequence opt1 from Porgaviximab_HeavyChain
  source 1..1353: mol_type = other RNA
gaggtgcagctgcaggagagcggcgggggcctcatgcagcccgggggctccatgaagctgagctgcgtcgcctccgggttcaccttcagcaactactggatgaactgggtgcgccagtccccggagaagggcctggagtgggtggccgagatccggctcaagagcaacaactacgcgacccactacgccgagtccgtcaagggccgcttcacgatcagccgggacgactccaagcgcagcgtgtacctgcagatgaacaccctgcgggccgaggacaccgggatctactactgcacccgcggcaacgggaactaccgggccatggactactggggccaggggacgtccgtgaccgtcagctccgccagcaccaagggcccctccgtgttccccctcgcgcccagctccaagagcacctccggcgggacggccgccctgggctgcctggtgaaggactacttcccggagcccgtcaccgtgagctggaacagcggggccctcacctccggcgtgcacaccttccccgcggtcctgcagagctccggcctgtacagcctctccagcgtggtgacggtcccctccagctccctggggacccagacctacatctgcaacgtgaaccacaagccgagcaacaccaaggtggacaagcgcgtcgagcccaagtcctgcgacaagacgcacacgtgcccgccctgcccggcccccgagctgctcggcgggcccagcgtgttcctgttcccgcccaagcccaaggacaccctgatgatctcccggacccccgaggtgacctgcgtcgtggtggacgtcagccacgaggaccccgaggtgaagttcaactggtacgtcgacggcgtggaggtgcacaacgccaagaccaagccgcgcgaggagcagtacaactccacctaccgggtcgtgagcgtgctcaccgtcctgcaccaggactggctgaacgggaaggagtacaagtgcaaggtgtccaacaaggccctccccgcccccatcgagaagacgatcagcaaggcgaagggccagccccgcgagccccaggtgtacaccctgccgccctcccgggacgagctgaccaagaaccaggtcagcctgacctgcctcgtgaagggcttctaccccagcgacatcgccgtggagtgggagtccaacgggcagcccgagaacaactacaagacgaccccgcccgtcctggacagcgacggctccttcttcctctacagcaagctgaccgtggacaagtcccgctggcagcaggggaacgtgttcagctgctccgtcatgcacgaggccctgcacaaccactacacccagaagtccctcagcctgagccccggcaag

SEQ ID NO: 8686 - RNA, 642 nt, synthetic construct
  misc_feature 1..642: note = derived and/or modified sequence opt1 from Porgaviximab_LightChain
  source 1..642: mol_type = other RNA
gacatccagatgacccagagccccgcctccctgagcgtgtccgtcggcgagaccgtgagcatcacgtgccgcgcctccgagaacatctacagctccctcgcgtggtaccagcagaagcagggcaagagcccgcagctgctggtgtactccgccaccatcctcgccgacggggtccccagccggttctccgggagcggctccgggacccagtacagcctgaagatcaactccctgcagagcgaggacttcggcacctactactgccagcacttctggggcacgccctacaccttcgggggcgggaccaagctcgagatcaagcgcaccgtggccgccccctccgtgttcatcttcccgcccagcgacgagcagctgaagtccggcacggcgagcgtcgtgtgcctgctcaacaacttctacccccgggaggccaaggtgcagtggaaggtcgacaacgccctgcagagcgggaactcccaggagagcgtgaccgagcaggactccaaggacagcacctactccctgagctccaccctcacgctgagcaaggccgactacgagaagcacaaggtgtacgcgtgcgaggtcacccaccagggcctgtccagccccgtgaccaagtccttcaaccgcggcgagtgc

SEQ ID NO: 8687 - RNA, 1341 nt, synthetic construct
  misc_feature 1..1341: note = derived and/or modified sequence opt1 from Prezalumab_HeavyChain
  source 1..1341: mol_type = other RNA
gaggtgcagctggtcgagagcggcgggggcctcgtgcagcccgggggctccctgcgcctgagctgcgccgcctccgggttcaccttcagctcctactggatgagctgggtgcggcaggcgccgggcaagggcctcgagtgggtcgcctacatcaagcaggacgggaacgagaagtactacgtggactccgtgaagggccgcttcaccatcagccgggacaacgccaagaactccctgtacctgcagatgaacagcctccgcgccgaggacacggccgtctactactgcgcgcgggaggggatcctgtggttcggcgacctgcccaccttctgggggcagggcaccctcgtgaccgtgtccagcgcctccacgaagggccccagcgtcttccccctggccccgtgctcccgcagcacctccgagagcaccgccgcgctggggtgcctcgtgaaggactacttccccgagcccgtgaccgtctcctggaacagcggcgccctgacgagcggggtgcacaccttccccgccgtgctgcagtccagcggcctctactccctgagctccgtcgtgaccgtgccgagctccaacttcggcacccagacgtacacgtgcaacgtcgaccacaagcccagcaacaccaaggtggacaagaccgtggagcggaagtgctgcgtcgagtgcccgccctgccccgccccgcccgtggccgggccctccgtgttcctgttcccgcccaagcccaaggacaccctcatgatcagccgcacccccgaggtgacctgcgtcgtcgtggacgtgtcccacgaggaccccgaggtccagttcaactggtacgtggacggcgtggaggtccacaacgcgaagaccaagccccgggaggagcagttcaacagcacgttccgcgtggtgtccgtcctgaccgtggtgcaccaggactggctgaacgggaaggagtacaagtgcaaggtcagcaacaagggcctccccgcccccatcgagaagaccatctccaagaccaaggggcagccgcgggagccccaggtgtacacgctgccgcccagccgcgaggagatgaccaagaaccaggtgtccctgacctgcctcgtcaagggcttctaccccagcgacatcgccgtggagtgggagtccaacggccagcccgagaacaactacaagaccacgcccccgatgctggacagcgacgggagcttcttcctgtactccaagctcaccgtggacaagagccggtggcagcagggcaacgtcttctcctgcagcgtgatgcacgaggccctgcacaaccactacacccagaagtccctgagcctctcccccgggaag

SEQ ID NO: 8688 - RNA, 642 nt, synthetic construct
  misc_feature 1..642: note = derived and/or modified sequence opt1 from Prezalumab_LightChain
  source 1..642: mol_type = other RNA
gacatccagatgacccagagcccctccagcctgtccgccagcgtgggcgaccgcgtcaccatcacgtgccgggcctcccaggggatcagcaactggctcgcgtggtaccagcagaagccggagaaggcccccaagtccctgatctacgccgccagctccctgcagagcggcgtgccctcccgcttcagcgggtccggcagcgggaccgacttcaccctcaccatctccagcctgcagcccgaggacttcgccacgtactactgccagcagtacgactcctacccgcggaccttcggccagggcaccaaggtggagatcaagcgcaccgtcgcggcccccagcgtgttcatcttcccgccctccgacgagcagctcaagagcgggacggccagcgtggtctgcctgctgaacaacttctacccccgggaggccaaggtgcagtggaaggtggacaacgcgctgcagtccggcaacagccaggagtccgtcaccgagcaggacagcaaggactccacctacagcctctccagcaccctgacgctgtccaaggccgactacgagaagcacaaggtgtacgcctgcgaggtgacccaccaggggctcagctcccccgtcaccaagagcttcaaccgcggcgagtgc

SEQ ID NO: 8689 - RNA, 342 nt, synthetic construct
  misc_feature 1..342: note = derived and/or modified sequence opt1 from Radretumab_HeavyChain
  source 1..342: mol_type = other RNA
gaggtgcagctgctcgagagcggcgggggcctggtccagcccgggggctccctgcgcctcagctgcgccgcctccgggttcaccttcagctccttcagcatgtcctgggtgcggcaggcgccgggcaagggcctggagtgggtgagctccatcagcgggtccagcggcaccacgtactacgccgactccgtcaaggggcgcttcaccatcagccgggacaactccaagaacaccctgtacctccagatgaacagcctgcgcgccgaggacaccgccgtgtactactgcgccaagcccttcccctacttcgactactggggccaggggacgctggtgaccgtc

SEQ ID NO: 8690 - RNA, 1071 nt, synthetic construct; identical to SEQ ID NO: 8359
  misc_feature 1..1071: note = derived and/or modified sequence opt1 from Radretumab_HeavyChain_LightChain
  source 1..1071: mol_type = other RNA

SEQ ID NO: 8691 - RNA, 693 nt, synthetic construct
  misc_feature 1..693: note = derived and/or modified sequence opt1 from Radretumab_LightChain
  source 1..693: mol_type = other RNA
gccagcgagatcgtgctgacccagtcccccggcaccctcagcctgtccccgggggagcgggccacgctgagctgccgggcgtcccagagcgtctccagctccttcctcgcctggtaccagcagaagcccggccaggcgccccgcctgctgatctactacgccagctcccgggccaccgggatccccgaccgcttcagcggctccgggagcggcaccgacttcaccctcacgatctcccggctggagccggaggacttcgccgtgtactactgccagcagaccggccgcatcccgcccaccttcgggcagggcaccaaggtggagatcaagagcgggggctccgggggcccccgggccgcccccgaggtctacgccttcgcgacgcccgagtggcccggcagccgcgacaagcggaccctggcctgcctcatccagaacttcatgcccgaggacatctccgtgcagtggctgcacaacgaggtgcagctgccggacgcccgccacagcaccacccagccccggaagacgaaggggagcggcttcttcgtcttctcccgcctcgaggtgacccgggccgagtgggagcagaaggacgagttcatctgccgcgccgtgcacgaggcggccagcccctcccagaccgtccagcgggccgtgagcgtgaaccccgagtccagccgccgcgggggctgc

SEQ ID NO: 8692 - RNA, 1359 nt, synthetic construct
  misc_feature 1..1359: note = derived and/or modified sequence opt1 from Ranevetmab_HeavyChain1
  source 1..1359: mol_type = other RNA
gaggtgcagctggtcgagagcggcgggggcctcgtgcagcccgggggctccctgcgcctgagctgcgtggcctccgggttcagcctcaccaacaacaacgtcaactgggtgcggcaggccccgggcaagggcctggagtgggtcgggggcgtgtgggccgggggcgcgaccgactacaactccgccctcaagagccgcttcacgatctcccgggacaacgccaagaacaccgtgttcctccagatgcacagcctgcgctccgaggacaccgccgtgtactactgcgcgcgggacgggggctacagctccagcaccctgtacgccatggacgcctggggccaggggacgtccgtcaccgtgagctccgccagcaccaccgcgccctccgtgttccccctcgcccccagctgcggctccacgagcgggagcaccgtcgccctggcctgcctggtgtccggctacttcccggagcccgtgaccgtcagctggaactccggcagcctgacctccggggtgcacacgttccccagcgtgctgcagtccagcggcctgcactccctcagctccatggtcaccgtgcccagctcccgctggccgagcgagaccttcacgtgcaacgtggtccaccccgcctccaacaccaaggtggacaagcccgtgttcaacgagtgccggtgcaccgacacgcccccgtgccccgtccccgagcccctcgggggcccgagcgtgctgatcttcccgcccaagcccaaggacatcctgcgcatcacccggacccccgaggtgacctgcgtcgtgctggacctggggcgcgaggaccccgaggtccagatctcctggttcgtggacggcaaggaggtgatcaccgcgaagacccagagccgggagcagcagttcaacggcacgtaccaggtcgtgtccgtgctccccatcgagcaccaggactggctgaccgggaaggagttcaagtgccgcgtcaaccacatcgacctgcccagcccgatcgagcggaccatcagcaaggcccgcggccgggcccacaagccctccgtgtacgtgctcccgcccagccccaaggagctgtccagctccgacaccgtcagcatcacgtgcctgatcaaggacttctacccgcccgacatcgacgtggagtggcagtccgtggggcagcaggagcccgagcgcaagcaccggatgaccccgccccagctcgacgaggacggcagctacttcctgtactccaagctgagcgtcgacaagtcccgctggcagcagggggaccccttcacgtgcgccgtgatgcacgagaccctccagaaccactacaccgacctgagcctgtcccacagccccggcaag

SEQ ID NO: 8693 - RNA, 1359 nt, synthetic construct
  misc_feature 1..1359: note = derived and/or modified sequence opt1 from Ranevetmab_HeavyChain2
  source 1..1359: mol_type = other RNA
gaggtgcagctggtcgagagcggcgggggcctcgtgcagcccgggggctccctgcgcctgagctgcgtggcctccgggttcagcctcaccaacaacaacgtcaactgggtgcggcaggccccgggcaagggcctggagtgggtcgggggcgtgtgggccgggggcgcgaccgactacaactccgccctcaagagccgcttcacgatctcccgggacaacgccaagaacaccgtgttcctccagatgcacagcctgcgctccgaggacaccgccgtgtactactgcgcgcgggacgggggctacagctccagcaccctgtacgccatggacgcctggggccaggggacgtccgtcaccgtgagctccgccagcaccaccgcgccctccgtgttccccctcgcccccagctgcggctccacgagcgggagcaccgtcgccctggcctgcctggtgtccggctacttcccggagcccgtgaccgtcagctggaactccggcagcctgacctccggggtgcacacgttccccagcgtgctgcagtccagcggcctgcactccctcagctccatggtcaccgtgcccagctcccgctggccgagcgagaccttcacgtgcaacgtggtccaccccgcctccaacaccaaggtggacaagcccgtgttcaacgagtgccggtgcaccgacacgcccccgtgccccgtccccgagcccctcgggggcccgagcgtgctgatcttcccgcccaagcccaaggacatcctgcgcatcacccggacccccgaggtgacctgcgtcgtgctggacctggggcgcgaggaccccgaggtccagatctcctggttcgtggacggcaaggaggtgctcaccgcgaagacccagagccgggagcagcagttcaacggcacgtaccaggtcgtgtccgtgctgcccatcgagcaccaggactggctgaccgggaaggagttcaagtgccgcgtcaaccacatcgacctccccagcccgatcgagcggaccatcagcaaggcccgcggccgggcccacaagccctccgtgtacgtgctgccgcccagccccaaggagctgtccagctccgacaccgtcagcatcacgtgcctcatcaaggacttctacccgcccgacatcgacgtggagtggcagtccgtggggcagcaggagcccgagcgcaagcaccggatgaccccgccccagctggacgaggacggcagctacttcctgtactccaagctcagcgtcgacaagtcccgctggcagcagggggaccccttcacgtgcgccgtgatgcacgagaccctgcagaaccactacaccgacctgagcctctcccacagccccggcaag

SEQ ID NO: 8694 - RNA, 651 nt, synthetic construct
  misc_feature 1..651: note = derived and/or modified sequence opt1 from Ranevetmab_LightChain
  source 1..651: mol_type = other RNA
gacatcgtgatgacccagagccccgcctccctgagcctctcccagggcgagaccgtcacgatcacgtgccgcgccagcgaggacatctacaacgcgctggcctggtaccagcagaagccggggcaggcccccaagctgctcatctacaacaccgacaccctgcacaccggcgtgccctcccggttcagcgggtccggcagcgggaccgacttctccctgaccatcagctccctcgagcccgaggacgtggccgtctactactgccagcactacttccactacccgcgcaccttcggccagggcacgaaggtggagctgaagcggaacgacgcccagcccgcggtgtacctgttccagcccagccccgaccagctccacaccgggtccgccagcgtcgtgtgcctgctgaactccttctacccgaaggacatcaacgtgaagtggaaggtcgacggcgtgatccaggacaccgggatccaggagagcgtgaccgagcaggacaaggactccacgtacagcctctccagcaccctgaccatgagctccaccgagtacctgagccacgagctctactcctgcgagatcacgcacaagagcctgccctccaccctgatcaagagcttccagcgctccgagtgccagcgggtcgac

SEQ ID NO: 8695 - RNA, 1761 nt, synthetic construct
  misc_feature 1..1761: note = derived and/or modified sequence opt1 from Remtolumab_HeavyChain
  source 1..1761: mol_type = other RNA
gaggtgcagctggtcgagagcggcgggggcctcgtgcagcccgggcgctccctgcggctgagctgcgccgcctccggcttcaccttcgacgactacgcgatgcactgggtgcgccaggccccggggaagggcctcgagtgggtcagcgccatcacctggaactccggccacatcgactacgccgacagcgtggaggggcggttcacgatctcccgcgacaacgccaagaacagcctgtacctgcagatgaactccctccgggcggaggacaccgccgtgtactactgcgccaaggtcagctacctgtccaccgccagctccctggactactggggccaggggaccctcgtgacggtgagctccggcgggggcggcagcgggggcgggggctccgaggtccagctggtgcagagcggcgcggaggtgaagaagcccgggtccagcgtcaaggtgagctgcaaggcctccggcgggagcttcggcgggtacggcatcggctgggtgcgccaggcccccgggcagggcctggagtggatgggcgggatcacccccttcttcgggttcgccgactacgcccagaagttccagggccgggtcaccatcaccgcggacgagtccacgaccaccgcctacatggagctcagcggcctgacctccgacgacacggccgtgtactactgcgcccgcgacccgaacgagttctggaacgggtactacagcacccacgacttcgactcctggggccaggggaccaccgtgacggtcagctccgccagcaccaagggcccctccgtgttccccctggcgcccagctccaagagcacctccgggggcaccgccgccctcggctgcctggtgaaggactacttcccggagcccgtcacggtgagctggaactccggggccctgaccagcggcgtgcacaccttccccgccgtcctccagtccagcgggctgtacagcctgtccagcgtggtcaccgtgccctccagctccctcggcacgcagacctacatctgcaacgtgaaccacaagccgagcaacaccaaggtcgacaagaaggtggagcccaagtcctgcgacaagacccacacgtgcccgccctgcccggcgcccgagctgctgggcgggcccagcgtgttcctcttcccgcccaagcccaaggacaccctgatgatctcccggacccccgaggtgacctgcgtcgtggtcgacgtgagccacgaggaccccgaggtgaagttcaactggtacgtcgacggcgtggaggtgcacaacgccaagacgaagccgcgcgaggagcagtacaactccacctaccgggtcgtgagcgtgctgaccgtcctccaccaggactggctgaacgggaaggagtacaagtgcaaggtgtccaacaaggccctgcccgcccccatcgagaagaccatcagcaaggccaagggccagccccgcgagccccaggtgtacacgctcccgccctcccgggacgagctgaccaagaaccaggtcagcctgacctgcctcgtgaaggggttctacccctccgacatcgcggtggagtgggagagcaacggccagcccgagaacaactacaagaccaccccgcccgtcctggacagcgacggctccttcttcctgtacagcaagctcacggtggacaagtcccgctggcagcaggggaacgtgttcagctgctccgtcatgcacgaggccctgcacaaccactacacccagaagtccctgagcctcagccccggcaag

SEQ ID NO: 8696 - RNA, 993 nt, synthetic construct
  misc_feature 1..993: note = derived and/or modified sequence opt1 from Remtolumab_LightChain
  source 1..993: mol_type = other RNA
gacatccagatgacccagagcccctccagcctgtccgccagcgtgggcgaccgcgtcaccatcacgtgccgggcctcccaggggatccgcaactacctcgcgtggtaccagcagaagccgggcaaggcccccaagctgctgatctacgccgccagcaccctccagtccggggtgcccagccggttctccggcagcgggtccggcaccgacttcaccctgacgatcagctccctgcagcccgaggacgtggccacctactactgccagcgctacaaccgggcgccgtacaccttcggccaggggaccaaggtcgagatcaagcgcggcgggagcggcgggggcggctccggggagatcgtgctcacgcagagccccgacttccagtccgtgacccccaaggagaaggtcaccatcacgtgccgggccagccaggacatcggctccgagctgcactggtaccagcagaagcccgaccagccgcccaagctgctcatcaagtacgccagccacagcacctccggggtgcccagccgcttctccggcagcggctccgggaccgacttcaccctgaccatcaacggcctggaggccgaggacgcggggacgtactactgccaccagaccgacagcctcccctacaccttcggcccggggaccaaggtggacatcaagcggacggtcgccgccccctccgtgttcatcttcccgcccagcgacgagcagctgaagtccggcaccgccagcgtggtctgcctgctcaacaacttctacccccgcgaggccaaggtgcagtggaaggtggacaacgcgctgcagtccggcaacagccaggagtccgtcaccgagcaggacagcaaggactccacctacagcctgtccagcacgctcaccctgtccaaggccgactacgagaagcacaaggtgtacgcctgcgaggtgacccaccaggggctgagcagccccgtcaccaagtccttcaaccggggcgagtgc

SEQ ID NO: 8697 - RNA, 1341 nt, synthetic construct
  misc_feature 1..1341: note = derived and/or modified sequence opt1 from Rosmantuzumab_HeavyChain
  source 1..1341: mol_type = other RNA
caggtgcagctggtccagagcggcgccgaggtgaagaagcccggggcctccgtgaaggtcagctgcaaggcgtccggctacaccttcaccgactacagcatccactgggtgcgccaggccccggggcagggcctcgagtggatcgggtacatctacccctccaacggcgacagcggctacaaccagaagttcaagaaccgggtgaccatgacccgcgacacctccaccagcacggcctacatggagctgtcccggctgcgcagcgaggacaccgccgtctactactgcgccacctacttcgcgaacaacttcgactactgggggcagggcaccacgctcaccgtgtccagcgcctccaccaaggggcccagcgtgttccccctggccccgtccagcaagtccaccagcggcgggacggccgcgctgggctgcctcgtcaaggactacttccccgagcccgtgaccgtgtcctggaacagcggcgccctgaccagcggggtccacaccttccccgccgtgctgcagtccagcggcctctactccctgagctccgtggtcacggtgccgagctccagcctggggacccagacctacatctgcaacgtgaaccacaagccctccaacaccaaggtcgacaagcgggtggagcccaagagctgcgacaagacgcacacgtgcccgccctgccccgcccccgagctcctgggcggcccctccgtgttcctgttcccgcccaagcccaaggacaccctcatgatcagccgcacccccgaggtgacctgcgtcgtggtcgacgtgtcccacgaggacccggaggtcaagttcaactggtacgtggacggggtggaggtccacaacgccaagaccaagccccgggaggagcagtacaacagcacctaccgcgtggtgtccgtcctgaccgtgctgcaccaggactggctcaacggcaaggagtacaagtgcaaggtgagcaacaaggcgctgcccgcccccatcgagaagacgatctccaaggccaaggggcagccgcgggagccccaggtctacaccctgccgcccagccgcgaggagatgaccaagaaccaggtgtccctgacctgcctcgtgaagggcttctaccccagcgacatcgccgtcgagtgggagagcaacgggcagcccgagaacaactacaagacgacgcccccggtgctggactccgacggcagcttcttcctctactccaagctgaccgtggacaagagccggtggcagcagggcaacgtcttctcctgcagcgtgatgcacgaggccctgcacaaccactacacccagaagtccctcagcctgtcccccgggaag

SEQ ID NO: 8698 - RNA, 654 nt, synthetic construct
  misc_feature 1..654: note = derived and/or modified sequence opt1 from Rosmantuzumab_LightChain
  source 1..654: mol_type = other RNA
gacatccagatgacccagagcccctccagcctgtccgccagcgtgggcgaccgcgtcaccatcacgtgcaaggcctcccagagcgtggactacgacggggactcctacatgaactggtaccagcagaagccgggcaaggcgcccaagctcctgatctacgccgccagcaacctggagtccggggtgcccagccggttctccggcagcgggtccggcaccgacttcaccctcaccatcagccccgtccaggccgaggacttcgccacgtactactgccagcagtccaacgaggacccgctgaccttcggcgcggggaccaagctggagctcaagcgcaccgtggccgcccccagcgtgttcatcttcccgccctccgacgagcagctcaagagcggcacggcctccgtcgtgtgcctgctgaacaacttctacccccgggaggcgaaggtgcagtggaaggtcgacaacgccctgcagagcgggaacagccaggagtccgtgaccgagcaggacagcaaggactccacctacagcctgtccagcaccctcacgctgtccaaggccgactacgagaagcacaaggtgtacgcctgcgaggtcacccaccagggcctgagctcccccgtgaccaagagcttcaaccgcggggagtgc

SEQ ID NO: 8699 - RNA, 1332 nt, synthetic construct
  misc_feature 1..1332: note = derived and/or modified sequence opt1 from Rozanolixizumab_HeavyChain
  source 1..1332: mol_type = other RNA
gaggtgcccctggtcgagagcggcgggggcctcgtgcagcccgggggctccctgcgcctgagctgcgccgtgtccgggttcaccttcagcaactacggcatggtctgggtgcggcaggcccccggcaaggggctcgagtgggtggcgtacatcgactccgacggcgacaacacctactaccgcgacagcgtcaaggggcggttcacgatctcccgcgacaacgccaagagctccctgtacctgcagatgaacagcctccgggccgaggacaccgccgtgtactactgcaccaccggcatcgtgcgccccttcctgtactgggggcagggcacgctggtcaccgtgtccagcgcctccaccaagggccccagcgtgttcccgctcgcgccctgctcccggagcacctccgagagcacggccgccctggggtgcctggtcaaggactacttccccgagcccgtgaccgtgtcctggaacagcggcgccctcaccagcggggtccacaccttcccggcggtgctgcagtccagcggcctgtactccctcagctccgtggtcacggtgcccagctccagcctgggcaccaagacctacacgtgcaacgtggaccacaagccctccaacaccaaggtcgacaagcgcgtggagagcaagtacgggcccccgtgcccgccctgccccgccccggagttcctgggcgggccctccgtgttcctcttcccgcccaagcccaaggacaccctgatgatcagccggacccccgaggtgacctgcgtcgtcgtggacgtgtcccaggaggaccccgaggtccagttcaactggtacgtggacggcgtggaggtccacaacgccaagacgaagccccgcgaggagcagttcaacagcacctaccgggtggtgtccgtcctgaccgtgctccaccaggactggctgaacgggaaggagtacaagtgcaaggtgagcaacaagggcctgccgtccagcatcgagaagaccatctccaaggccaagggccagccccgcgagccccaggtctacacgctcccgcccagccaggaggagatgaccaagaaccaggtgagcctgacctgcctggtgaaggggttctacccctccgacatcgccgtcgagtgggagagcaacggccagcccgagaacaactacaagaccacgccgcccgtgctcgactccgacgggagcttcttcctgtactcccggctgaccgtggacaagagccgctggcaggagggcaacgtcttctcctgcagcgtgatgcacgaggcgctccacaaccactacacccagaagtccctgagcctgtccctcgggaag

SEQ ID NO: 8700 - RNA, 657 nt, synthetic construct
  misc_feature 1..657: note = derived and/or modified sequence opt1 from Rozanolixizumab_LightChain
  source 1..657: mol_type = other RNA
gacatccagatgacccagagcccctccagcctgtccgccagcgtgggcgaccgcgtcaccatcacgtgcaagtccagccagtccctcgtgggggccagcggcaagacctacctgtactggctgttccagaagccggggaaggcgcccaagcggctcatctacctggtgtccaccctggacagcggcatcccctcccgcttcagcgggtccggcagcggcaccgagttcacgctcaccatctccagcctgcagcccgaggacttcgccacctactactgcctgcaggggacccacttcccgcacacgttcggccaggggaccaagctcgagatcaagcggaccgtcgccgccccctccgtgttcatcttcccgcccagcgacgagcagctgaagtccggcaccgccagcgtggtctgcctgctcaacaacttctacccccgcgaggcgaaggtgcagtggaaggtggacaacgccctgcagagcgggaactcccaggagagcgtcacggagcaggactccaaggacagcacctactccctgagctccaccctcaccctgagcaaggccgactacgagaagcacaaggtgtacgcctgcgaggtgacgcaccagggcctgtccagccccgtcaccaagtccttcaaccggggcgagtgc

SEQ ID NO: 8701 - RNA, 1329 nt, synthetic construct
  misc_feature 1..1329: note = derived and/or modified sequence opt1 from Sapelizumab_HeavyChain
  source 1..1329: mol_type = other RNA
caggtgcagctgcaggagagcggccccgggctcgtcaagccctccgagaccctgagcctgacctgcgccgtgtccggccacagcatctcccacgaccacgcctggagctgggtgcgccagccgcccggggagggcctcgagtggatcgggttcatctcctacagcggcatcacgaactacaacccctccctgcagggccgggtcaccatcagccgcgacaactccaagaacaccctgtacctccagatgaacagcctgcgggcggaggacaccgccgtgtactactgcgcccgctccctggcccggacgaccgccatggactactggggcgaggggaccctcgtgaccgtcagctccgcgagcacgaaggggccctccgtgttccccctggcccccagctccaagagcaccagcggcgggaccgccgccctgggctgcctcgtgaaggactacttccccgagccggtcaccgtgtcctggaacagcggcgcgctgacgtccggggtgcacaccttccccgccgtcctgcagagctccggcctctacagcctgtccagcgtggtgaccgtcccctccagcaacttcgggacccagacgtacacgtgcaacgtggaccacaagccctccaacaccaaggtggacaagaccgtcgagcgcaagagctgcgtggagtgcccgccctgccccgcgcccccggtggccggcccctccgtcttcctgttcccgcccaagcccaaggacaccctcatgatcagccggacccccgaggtgacctgcgtggtcgtggacgtctcccaggaggaccccgaggtgcagttcaactggtacgtggacggcgtcgaggtgcacaacgccaagaccaagccccgcgaggagcagttcaacagcacgttccgggtggtctccgtgctgaccgtggtccaccaggactggctgaacgggaaggagtacaagtgcaaggtgagcaacaagggcctcccggcccccatcgagaagaccatctccaagaccaaggggcagccccgcgagccccaggtgtacacgctgccgcccagccaggaggagatgaccaagaaccaggtcagcctgacctgcctcgtgaagggcttctacccctccgacatcgccgtggagtgggagagcaacgggcagccggagaacaactacaagaccacgccgcccatgctggactccgacggcagcttcttcctgtactccaagctcaccgtcgacaagagccggtggcaggagggcaacgtgttctcctgcagcgtgatgcacgaggccctgcacgcccactacacccagaagtccctgagcctctccccc

SEQ ID NO: 8702 - RNA, 642 nt, synthetic construct
  misc_feature 1..642: note = derived and/or modified sequence opt1 from Sapelizumab_LightChain
  source 1..642: mol_type = other RNA
gacatccagatgacccagagcccctccagcctgtccgccagcgtgggcgactccgtcaccatcacgtgccaggccagcaccgacatctccagccacctcaactggtaccagcagaagccggggaaggcgcccgagctgctgatctactacggctcccacctcctgagcggggtgccctcccgcttcagcggctccgggagcggcaccgacttcaccttcacgatctccagcctggaggccgaggacgccgccacctactactgcggccaggggaaccggctcccctacaccttcggccaggggaccaaggtggagatcgagcgcacggtcgccgcgccgtccgtgttcatcttcccgcccagcgacgagcagctgaagtccggcaccgccagcgtggtctgcctgctcaacaacttctacccccgggaggccaaggtgcagtggaaggtggacaacgccctgcagagcgggaactcccaggagagcgtcaccgagcaggactccaaggacagcacctactccctgagctccacgctcaccctgagcaaggcggactacgagaagcacaaggtgtacgcctgcgaggtgacccaccagggcctgtccagccccgtcaccaagtccttcaaccgcggcgagtgc

SEQ ID NO: 8703 - RNA, 1356 nt, synthetic construct
  misc_feature 1..1356: note = derived and/or modified sequence opt1 from Selicrelumab_HeavyChain
  source 1..1356: mol_type = other RNA
caggtgcagctggtccagagcggcgccgaggtgaagaagcccggggcctccgtgaaggtcagctgcaaggcgtccggctacaccttcaccgggtactacatgcactgggtgcgccaggccccgggccaggggctcgagtggatgggctggatcaaccccgacagcggcgggacgaactacgcccagaagttccagggccgggtgaccatgacccgcgacacctccatcagcacggcctacatggagctgaaccggctgcgctccgacgacaccgccgtctactactgcgcgcgggaccagcccctcgggtactgcaccaacggcgtgtgcagctacttcgactactgggggcagggcaccctggtgacggtctccagcgcctccaccaagggccccagcgtgttcccgctggccccctgctcccgcagcacctccgagagcaccgccgcgctcgggtgcctggtgaaggactacttccccgagcccgtcacggtgtcctggaacagcggcgccctgacctccggggtgcacaccttcccggccgtcctccagagcagcggcctgtactccctgagctccgtggtgaccgtccccagctccaacttcggcacgcagacctacacgtgcaacgtggaccacaagcccagcaacaccaaggtggacaagaccgtcgagcggaagtgctgcgtggagtgcccgccctgccccgccccgcccgtggccgggccctccgtcttcctcttcccgcccaagcccaaggacaccctgatgatcagccgcacccccgaggtgacctgcgtcgtggtggacgtctcccacgaggaccccgaggtgcagttcaactggtacgtggacggcgtcgaggtgcacaacgcgaagacgaagccccgggaggagcagttcaacagcaccttccgcgtggtctccgtgctgaccgtggtccaccaggactggctcaacgggaaggagtacaagtgcaaggtgagcaacaagggcctgcccgccccgatcgagaagaccatctccaagacgaaggggcagccccgggagccccaggtgtacaccctgcccccgagccgcgaggagatgaccaagaaccaggtctccctgacctgcctcgtgaagggcttctaccccagcgacatcgccgtggagtgggagtccaacggccagcccgagaacaactacaagacgaccccgcccatgctggacagcgacgggtccttcttcctctacagcaagctgaccgtcgacaagagccggtggcagcagggcaacgtgttctcctgcagcgtgatgcacgaggccctgcacaaccactacacccagaagtccctcagcctgtcccccgggaag

SEQ ID NO: 8704 - RNA, 642 nt, synthetic construct
  misc_feature 1..642: note = derived and/or modified sequence opt1 from Selicrelumab_LightChain
  source 1..642: mol_type = other RNA
gacatccagatgacccagagcccctccagcgtgtccgccagcgtcggcgaccgcgtgaccatcacgtgccgggcctcccaggggatctacagctggctggcgtggtaccagcagaagccgggcaaggcccccaacctcctgatctacaccgcctccaccctgcagagcggggtgccctcccgcttcagcggctccgggagcggcaccgacttcacgctcaccatctccagcctgcagcccgaggacttcgccacctactactgccagcaggccaacatcttcccgctgaccttcggcgggggcacgaaggtcgagatcaagcggaccgtggcggccccctccgtgttcatcttcccgcccagcgacgagcagctcaagtccgggaccgccagcgtcgtgtgcctgctgaacaacttctacccccgcgaggccaaggtgcagtggaaggtcgacaacgcgctccagtccggcaacagccaggagagcgtgaccgagcaggactccaaggacagcacgtactccctgagctccaccctgaccctcagcaaggccgactacgagaagcacaaggtgtacgcctgcgaggtcacccaccaggggctgtccagccccgtgacgaagtccttcaaccggggcgagtgc

SEQ ID NO: 8705 - RNA, 354 nt, synthetic construct
  misc_feature 1..354: note = derived and/or modified sequence opt1 from Solitomab_HeavyChain1
  source 1..354: mol_type = other RNA
gaggtgcagctgctcgagcagagcggcgccgagctggtccgccccgggacctccgtgaagatcagctgcaaggcctccggctacgcgttcaccaactactggctggggtgggtgaagcagcggccgggccacgggctcgagtggatcggcgacatcttccccggcagcgggaacatccactacaacgagaagttcaagggcaaggccacgctgaccgccgacaagtccagctccaccgcctacatgcagctgagctccctcaccttcgaggacagcgccgtctacttctgcgcgcgcctgcggaactgggacgagcccatggactactgggggcagggcacgaccgtgaccgtg

SEQ ID NO: 8706 - RNA, 375 nt, synthetic construct
  misc_feature 1..375: note = derived and/or modified sequence opt1 from Solitomab_HeavyChain2
  source 1..375: mol_type = other RNA
gacgtgcagctggtccagagcggcgccgaggtgaagaagcccggggcctccgtgaaggtcagctgcaaggcgtccggctacaccttcacccgctacacgatgcactgggtgcggcaggccccggggcagggcctcgagtggatcgggtacatcaaccccagccgcggctacaccaactacgccgactccgtgaagggccggttcaccatcaccacggacaagagcacctccaccgcctacatggagctgagctccctgcgcagcgaggacaccgccacgtactactgcgcgcggtactacgacgaccactactgcctcgactactgggggcagggcaccaccgtcaccgtgtccagcggggagggcacgtccacc

SEQ ID NO: 8707 - RNA, 1488 nt, synthetic construct
  misc_feature 1..1488: note = derived and/or modified sequence opt1 from Solitomab_LightChain_HeavyChain_HeavyChain_LightChain
  source 1..1488: mol_type = other RNA
gagctggtgatgacccagagcccctccagcctcaccgtcacggccggcgagaaggtgaccatgtcctgcaagagctcccagagcctgctgaactccgggaaccagaagaactacctcacctggtaccagcagaagccgggccagccgcccaagctgctgatctactgggccagcacccgcgagtccggggtgcccgaccggttcacgggcagcgggtccggcaccgacttcaccctcaccatcagctccgtccaggcggaggacctggccgtgtactactgccagaacgactacagctaccccctgacgttcggcgccgggaccaagctcgagatcaagggcgggggcgggtccggcggcgggggcagcgggggcggcgggtccgaggtgcagctgctggagcagagcggcgccgagctcgtccgccccgggacctccgtgaagatcagctgcaaggccagcggctacgcgttcaccaactactggctggggtgggtgaagcagcggcccggccacggcctggagtggatcggggacatcttccccggctccgggaacatccactacaacgagaagttcaagggcaaggccacgctcaccgccgacaagagctccagcaccgcctacatgcagctgtccagcctgaccttcgaggactccgcggtctacttctgcgcccgcctccggaactgggacgagccgatggactactgggggcagggcacgaccgtgaccgtgagctccggcgggggcgggagcgacgtccagctggtgcagtccggcgccgaggtgaagaagcccggggccagcgtcaaggtgtcctgcaaggccagcggctacaccttcacgcgctacaccatgcactgggtgcggcaggcgcccggccaggggctggagtggatcggctacatcaacccctcccgcgggtacaccaactacgccgacagcgtcaagggccggttcaccatcacgaccgacaagtccaccagcaccgcctacatggagctctccagcctgcgcagcgaggacacggccacctactactgcgcccggtactacgacgaccactactgcctggactactggggccaggggaccaccgtgacggtgtccagcggcgaggggacctccaccggcagcgggggctccggcgggagcggcggggcggacgacatcgtcctcacccagtccccggccacgctgagcctgtcccccggcgagcgcgccaccctcagctgccgggcctcccagagcgtgtcctacatgaactggtaccagcagaagcccgggaaggcccccaagcgctggatctacgacaccagcaaggtggcgtccggcgtcccggcccggttcagcggctccgggagcggcaccgactacagcctgaccatcaactccctggaggccgaggacgccgccacgtactactgccagcagtggagctccaaccccctcaccttcgggggcgggaccaaggtggagatcaag

SEQ ID NO: 8708 - RNA, 339 nt, synthetic construct
  misc_feature 1..339: note = derived and/or modified sequence opt1 from Solitomab_LightChain1
  source 1..339: mol_type = other RNA
gagctggtgatgacccagagcccctccagcctcaccgtcacggccggcgagaaggtgaccatgtcctgcaagagctcccagagcctgctgaactccgggaaccagaagaactacctcacctggtaccagcagaagccgggccagccgcccaagctgctgatctactgggccagcacccgcgagtccggggtgcccgaccggttcacgggcagcgggtccggcaccgacttcaccctcaccatcagctccgtccaggcggaggacctggccgtgtactactgccagaacgactacagctaccccctgacgttcggcgccgggaccaagctcgagatcaag

SEQ ID NO: 8709 - RNA, 324 nt, synthetic construct
  misc_feature 1..324: note = derived and/or modified sequence opt1 from Solitomab_LightChain2
  source 1..324: mol_type = other RNA
gccgacgacatcgtgctgacccagagccccgccaccctctccctgagcccgggcgagcgcgcgacgctgtcctgccgggccagccagtccgtcagctacatgaactggtaccagcagaagcccgggaaggcccccaagcgctggatctacgacacctccaaggtggccagcggcgtgcccgcccggttctccgggagcggctccgggaccgactacagcctcaccatcaactccctggaggcggaggacgccgccacgtactactgccagcagtggagctccaacccgctgaccttcggcggcgggaccaaggtcgagatcaag

SEQ ID NO: 8710 - RNA, 1359 nt, synthetic construct
  misc_feature 1..1359: note = derived and/or modified sequence opt1 from Suptavumab_HeavyChain2
  source 1..1359: mol_type = other RNA
gaggtgcagctggtcgagagcggcggggacctcgtgcagcccggccgctccctgcggctgagctgcgtggcctccgggttcaccttcgacgactacgccatgcactgggtccgccaggcgccgggcaaggggctcgagtgggtgagcggcgtgtcctggagcggctccaccgtcgggtacgccgacagcgtgaagggccggttcacggtgtcccgcgacaacgcccagaagtccctgtacctgcagatgaacagcctccgggccgaggacaccgccctgtactactgcgtcaaggacgcgtacaagttcaactactactactacgggctggacgtgtggggccaggggaccaccgtgacggtcagctccgccagcaccaagggcccctccgtgttccccctcgcccccagctccaagagcacctccggcgggaccgccgcgctgggctgcctggtgaaggactacttcccggagcccgtcacggtgagctggaacagcggggccctcacctccggcgtgcacaccttccccgccgtcctgcagagctccggcctgtacagcctctccagcgtggtgaccgtcccctccagctccctggggacgcagacctacatctgcaacgtgaaccacaagccgagcaacaccaaggtggacaagaaggtcgagcccaagtcctgcgacaagacccacacgtgcccgccctgcccggcccccgagctgctcggcgggcccagcgtgttcctgttcccgcccaagcccaaggacaccctgatgatctcccgcacccccgaggtgacctgcgtcgtggtcgacgtgagccacgaggaccccgaggtgaagttcaactggtacgtcgacggcgtggaggtgcacaacgccaagacgaagccgcgggaggagcagtacaactccacctaccgcgtcgtgagcgtgctcaccgtcctgcaccaggactggctgaacgggaaggagtacaagtgcaaggtgtccaacaaggcgctccccgcccccatcgagaagaccatcagcaaggccaagggccagccccgggagccccaggtgtacacgctgccgccctcccgcgacgagctgaccaagaaccaggtcagcctgacctgcctcgtgaagggcttctaccccagcgacatcgccgtggagtgggagtccaacgggcagcccgagaacaactacaagaccacgccgcccgtcctggacagcgacggctccttcttcctctacagcaagctgaccgtggacaagtcccggtggcagcaggggaacgtgttcagctgctccgtcatgcacgaggccctgcacaaccactacacccagaagtccctcagcctgagccccggcaag

SEQ ID NO: 8711 - RNA, 1356 nt, synthetic construct
  misc_feature 1..1356: note = derived and/or modified sequence opt1 from Suvratoxumab_HeavyChain
  source 1..1356: mol_type = other RNA
gaggtgcagctggtcgagagcggcgggggcctcgtgcagcccgggggctccctgcgcctgagctgcgccgcctccgggttcaccttcagctcccacgacatgcactgggtgcggcaggcgaccggcaagggcctcgagtgggtcagcgggatcggcacggccggggacacctactacccggactccgtgaagggccgcttcaccatcagccgggagaacgccaagaactccctgtacctgcagatgaacagcctccgcgccggggacaccgccgtgtactactgcgcgcgggaccgctactcccccacgggccactactacggcatggacgtctgggggcagggcaccaccgtgaccgtgagctccgccagcacgaaggggccctccgtcttccccctggccccgagctccaagagcacctccggcggcaccgccgcgctggggtgcctcgtgaaggactacttccccgagcccgtgaccgtcagctggaacagcggcgccctgacgtccggggtgcacaccttccccgccgtgctgcagagctccggcctctacagcctgtccagcgtcgtgaccgtgccgtccagctccctggggacccagacgtacatctgcaacgtcaaccacaagcccagcaacaccaaggtggacaagcgggtggagcccaagtcctgcgacaagacccacacgtgcccgccctgccccgcccccgagctcctgggcggccccagcgtcttcctgttcccgcccaagcccaaggacaccctctacatcacccgcgagcccgaggtgacctgcgtggtcgtggacgtctcccacgaggacccggaggtgaagttcaactggtacgtggacggggtcgaggtgcacaacgccaagaccaagccccgggaggagcagtacaacagcacgtaccgcgtggtctccgtgctgaccgtgctgcaccaggactggctcaacggcaaggagtacaagtgcaaggtcagcaacaaggcgctgcccgcccccatcgagaagaccatctccaaggccaaggggcagccgcgggagccccaggtgtacaccctgccgcccagccgcgaggagatgacgaagaaccaggtgtccctgacctgcctcgtcaagggcttctaccccagcgacatcgccgtggagtgggagagcaacgggcagcccgagaacaactacaagaccacgcccccggtgctggactccgacggcagcttcttcctctactccaagctgaccgtcgacaagagccggtggcagcagggcaacgtgttctcctgcagcgtgatgcacgaggccctgcacaaccactacacccagaagtccctcagcctgtcccccgggaag

SEQ ID NO: 8712 - RNA, 639 nt, synthetic construct
  misc_feature 1..639: note = derived and/or modified sequence opt1 from Suvratoxumab_LightChain
  source 1..639: mol_type = other RNA
gacatccagatgacccagagcccctccaccctgagcgcctccgtgggcgaccgcgtcacgatcacgtgccgggccagccagtccatcagctcctggctcgcgtggtaccagcagaagccggggaaggcccccaagctgctgatctacaaggccagctccctcgagagcggcgtgccctcccgcttcagcgggtccggcagcgggaccgagttcaccctgaccatctccagcctgcagcccgacgacttcgccacctactactgcaagcagtacgccgactactggaccttcggccagggcaccaaggtggagatcaagcggacggtcgcggccccgtccgtgttcatcttcccgcccagcgacgagcagctcaagtccgggaccgccagcgtggtctgcctgctgaacaacttctacccccgcgaggccaaggtgcagtggaaggtggacaacgcgctccagagcggcaactcccaggagagcgtcaccgagcaggactccaaggacagcacctactccctgagctccacgctgaccctcagcaaggccgactacgagaagcacaaggtgtacgcctgcgaggtgacccaccaggggctgtccagccccgtcaccaagtccttcaaccggggcgagtgc

SEQ ID NO: 8713 - RNA, 642 nt, synthetic construct
  misc_feature 1..642: note = derived and/or modified sequence opt1 from Tadocizumab_LightChain
  source 1..642: mol_type = other RNA
gacatccagatgacccagacccccagcacgctgtccgccagcgtgggcgaccgggtcaccatctcctgccgggccagccaggacatcaacaactacctcaactggtaccagcagaagccggggaaggcgcccaagctgctgatctactacacctccaccctccacagcggcgtgccctcccgcttcagcgggtccggcagcgggacggactacaccctgaccatctccagcctgcagcccgacgacttcgccacctacttctgccagcagggcaacacgctcccgtggaccttcggccaggggaccaaggtggaggtcaagcggaccgtggccgccccctccgtgttcatcttcccgcccagcgacgagcagctgaagtccggcacggccagcgtcgtgtgcctgctcaacaacttctacccccgcgaggcgaaggtgcagtggaaggtcgacaacgccctgcagtccgggaacagccaggagtccgtgaccgagcaggacagcaaggacagcacctactccctgagctccaccctcacgctgagcaaggccgactacgagaagcacaaggtgtacgcctgcgaggtcacccaccagggcctgtccagccccgtgaccaagtccttcaaccgcggggagtgc

SEQ ID NO: 8714 - RNA, 1341 nt, synthetic construct
  misc_feature 1..1341: note = derived and/or modified sequence opt1 from Tanezumab_HeavyChain
  source 1..1341: mol_type = other RNA
caggtgcagctgcaggagagcggccccgggctcgtcaagccgtccgagaccctgagcctgacctgcacggtgtccggcttcagcctcatcgggtacgacctgaactggatccgccagccgcccggcaaggggctggagtggatcggcatcatctggggcgacgggaccaccgactacaactccgccgtcaagagccgggtgaccatctccaaggacacgagcaagaaccagttctccctcaagctgagctccgtgaccgccgcggacaccgccgtgtactactgcgcccgcggcgggtactggtacgccaccagctactacttcgactactggggccaggggacgctggtcaccgtgtccagcgcctccaccaagggccccagcgtgttccccctcgcgccctgctcccggagcacctccgagagcacggccgccctgggctgcctggtcaaggactacttccccgagcccgtgaccgtgagctggaactccggggccctcaccagcggcgtccacaccttcccggcggtgctgcagtccagcgggctgtactccctcagctccgtggtcacggtgcccagctccaacttcggcacccagacctacacgtgcaacgtggaccacaagcccagcaacaccaaggtcgacaagaccgtggagcgcaagtgctgcgtggagtgcccgccctgccccgccccgcccgtcgccggcccctccgtgttcctgttcccgcccaagcccaaggacaccctgatgatcagccggacccccgaggtgacgtgcgtcgtggtcgacgtgtcccacgaggaccccgaggtgcagttcaactggtacgtcgacggggtggaggtgcacaacgccaagaccaagccccgcgaggagcagttcaacagcaccttccgggtcgtgtccgtgctcaccgtcgtgcaccaggactggctgaacggcaaggagtacaagtgcaaggtgagcaacaaggggctgccctccagcatcgagaagacgatctccaagaccaagggccagccgcgcgagccccaggtctacaccctcccgcccagccgggaggagatgaccaagaaccaggtgagcctgacgtgcctggtgaaggggttctacccctccgacatcgccgtcgagtgggagagcaacggccagcccgagaacaactacaagaccacgcccccgatgctcgactccgacggcagcttcttcctgtactccaagctgaccgtggacaagagccgctggcagcaggggaacgtgttctcctgcagcgtcatgcacgaggcgctccacaaccactacacccagaagtccctgagcctgtcccccggcaag

SEQ ID NO: 8715 - RNA, 642 nt, synthetic construct
  misc_feature 1..642: note = derived and/or modified sequence opt1 from Tanezumab_LightChain
  source 1..642: mol_type = other RNA
gacatccagatgacgcagagcccctccagcctgtccgccagcgtgggcgaccgcgtcaccatcacgtgccgggcctcccagagcatctccaacaacctcaactggtaccagcagaagccggggaaggcgcccaagctgctgatctactacaccagccgcttccactccggcgtgcccagccggttctccgggagcggctccgggaccgacttcaccttcacgatcagctccctccagcccgaggacatcgccacctactactgccagcaggagcacaccctgccgtacaccttcggccagggcacgaagctggagatcaagcgcaccgtggccgcccccagcgtcttcatcttcccgccctccgacgagcagctcaagagcgggaccgcctccgtggtgtgcctgctgaacaacttctacccccgggaggcgaaggtccagtggaaggtggacaacgccctccagagcggcaacagccaggagtccgtgaccgagcaggacagcaaggactccacgtacagcctgtccagcaccctgaccctctccaaggccgactacgagaagcacaaggtctacgcctgcgaggtgacccaccaggggctgagctcccccgtgaccaagagcttcaaccgcggcgagtgc

SEQ ID NO: 8716 - RNA, 1353 nt, synthetic construct
  misc_feature 1..1353: note = derived and/or modified sequence opt1 from Tavolixizumab_HeavyChain
  source 1..1353: mol_type = other RNA
caggtgcagctgcaggagagcggccccgggctcgtcaagccctcccagaccctgagcctgacctgcgccgtgtacggcgggtccttcagctccggctactggaactggatccgcaagcaccccgggaagggcctcgagtacatcggctacatcagctacaacgggatcacgtaccacaacccctccctcaagagccggatcaccatcaaccgcgacacctccaagaaccagtacagcctgcagctgaactccgtgacccccgaggacacggccgtctactactgcgcgcggtacaagtacgactacgacggcgggcacgccatggactactggggccaggggaccctggtgaccgtgagctccgccagcaccaagggcccgtccgtcttccccctggcccccagctccaagagcacgtccggcgggaccgccgcgctcggctgcctggtgaaggactacttccccgagccggtgaccgtcagctggaacagcggggccctgacctccggcgtgcacacgttccccgccgtgctccagagctccggcctgtacagcctgtccagcgtcgtgaccgtgccctccagctccctcgggacccagacctacatctgcaacgtcaaccacaagcccagcaacacgaaggtggacaagcgcgtggagccgaagtcctgcgacaagacccacacgtgcccgccctgccccgcccccgagctgctgggcgggcccagcgtcttcctcttcccgcccaagcccaaggacaccctgatgatctcccggacccccgaggtgacctgcgtggtcgtggacgtgagccacgaggaccccgaggtcaagttcaactggtacgtggacggcgtcgaggtgcacaacgcgaagaccaagccccaggaggagcagtacaactccacctaccgcgtggtcagcgtgctgacggtgctccaccaggactggctgaacgggaaggagtacaagtgcaaggtctccaacaaggccctgccggcccccatcgagaagaccatcagcaaggccaagggccagccccgggagccccaggtgtacaccctcccgccctcccgcgaggagatgaccaagaaccaggtgagcctgacgtgcctggtcaagggcttctaccccagcgacatcgccgtggagtgggagtccaacgggcagccggagaacaactacaagaccaccccgcccgtgctcgacagcgacggctccttcttcctgtacagcaagctgaccgtcgacaagtcccggtggcagcaggggaacgtgttcagctgctccgtgatgcacgaggcgctccacaaccactacacgcagaagtccctgagcctgagccccggcaag

SEQ ID NO: 8717 - RNA, 642 nt, synthetic construct
  misc_feature 1..642: note = derived and/or modified sequence opt1 from Tavolixizumab_LightChain
  source 1..642: mol_type = other RNA
gacatccagatgacccagagcccctccagcctgtccgccagcgtgggcgaccgggtcaccatcacgtgccgggcctcccaggacatcagcaactacctcaactggtaccagcagaagccggggaaggcgcccaagctgctgatctactacacctccaagctccacagcggcgtgccctcccgcttcagcgggtccggcagcgggaccgactacaccctgacgatctccagcctgcagcccgaggacttcgccacctactactgccagcagggctccgccctcccgtggaccttcggccaggggaccaaggtggagatcaagcggacggtcgccgcccccagcgtgttcatcttcccgccctccgacgagcagctcaagagcggcaccgcgtccgtggtctgcctgctgaacaacttctacccccgcgaggccaaggtgcagtggaaggtggacaacgccctgcagagcgggaacagccaggagtccgtcaccgagcaggacagcaaggactccacctacagcctgtccagcacgctcaccctgtccaaggccgactacgagaagcacaaggtgtacgcgtgcgaggtgacccaccagggcctgagctcccccgtcaccaagagcttcaaccgcggggagtgc

SEQ ID NO: 8718 - RNA, 1335 nt, synthetic construct
  misc_feature 1..1335: note = derived and/or modified sequence opt1 from Telisotuzumab_HeavyChain
  source 1..1335: mol_type = other RNA
caggtgcagctggtccagagcggcgccgaggtgaagaagcccggggcctccgtgaaggtcagctgcaaggcgtccggctacatcttcaccgcctacaccatgcactgggtgcgccaggccccggggcagggcctcgagtggatggggtggatcaagcccaacaacggcctggccaactacgcccagaagttccagggccgggtgacgatgacccgcgacaccagcatctccaccgcgtacatggagctgagccggctccgctccgacgacacggccgtctactactgcgcccggagcgagatcaccaccgagttcgactactgggggcagggcaccctggtgacggtgtccagcgcctccaccaaggggcccagcgtcttccccctggcgccgtccagcaagtccaccagcggcgggaccgccgccctcggctgcctggtgaaggactacttccccgagcccgtgacggtctcctggaacagcggcgccctgacctccggggtgcacaccttccccgccgtgctccagagcagcggcctgtactccctgagctccgtcgtgaccgtgccgagctccagcctcgggacgcagacctacatctgcaacgtcaaccacaagccctccaacaccaaggtggacaagcgcgtggagcccaagagctgcgactgccactgcccgccctgccccgcgcccgagctgctgggcggcccctccgtcttcctcttcccgcccaagcccaaggacaccctgatgatcagccggacgcccgaggtgacctgcgtggtcgtggacgtctcccacgaggacccggaggtgaagttcaactggtacgtggacggggtcgaggtgcacaacgccaagaccaagccccgcgaggagcagtacaacagcacctaccgggtggtctccgtgctgacggtgctccaccaggactggctgaacggcaaggagtacaagtgcaaggtcagcaacaaggccctgcccgcccccatcgagaagaccatctccaaggccaaggggcagccgcgcgagccccaggtgtacaccctcccgcccagccgggaggagatgaccaagaaccaggtgtccctgacgtgcctggtcaagggcttctaccccagcgacatcgcggtggagtgggagtccaacgggcagcccgagaacaactacaagaccacgcccccggtgctcgacagcgacggcagcttcttcctgtactccaagctgaccgtcgacaagagccgctggcagcagggcaacgtgttctcctgcagcgtgatgcacgaggccctccacaaccactacacccagaagtccctgagcctgtcccccggg

SEQ ID NO: 8719 - RNA, 654 nt, synthetic construct
  misc_feature 1..654: note = derived and/or modified sequence opt1 from Telisotuzumab_LightChain
  source 1..654: mol_type = other RNA
gacatcgtgatgacccagagccccgactccctggccgtcagcctcggcgagcgcgccaccatcaactgcaagtccagcgagtccgtggacagctacgcgaactccttcctgcactggtaccagcagaagccggggcagccgcccaagctgctcatctaccgggccagcacgcgcgagtccggcgtgcccgaccggttcagcgggtccggcagcgggaccgacttcaccctgaccatctccagcctgcaggccgaggacgtcgccgtgtactactgccagcagtccaaggaggaccccctcacgttcggcggcgggaccaaggtggagatcaagcgcaccgtcgccgcgcccagcgtgttcatcttcccgccctccgacgagcagctcaagagcggcaccgcctccgtggtctgcctgctgaacaacttctacccccgggaggccaaggtgcagtggaaggtggacaacgccctgcagagcgggaacagccaggagtccgtcacggagcaggacagcaaggactccacctacagcctgtccagcaccctcaccctgtccaaggcggactacgagaagcacaaggtgtacgcctgcgaggtgacgcaccagggcctgagctcccccgtcaccaagagcttcaaccgcggggagtgc

SEQ ID NO: 8720 - RNA, 1335 nt, synthetic construct; identical to SEQ ID NO: 8718
  misc_feature 1..1335: note = derived and/or modified sequence opt1 from Telisotuzumab_vedotin_HeavyChain
  source 1..1335: mol_type = other RNA

SEQ ID NO: 8721 - RNA, 654 nt, synthetic construct; identical to SEQ ID NO: 8719
  misc_feature 1..654: note = derived and/or modified sequence opt1 from Telisotuzumab_vedotin_LightChain
  source 1..654: mol_type = other RNA

SEQ ID NO: 8722 - RNA, 1350 nt, synthetic construct
  misc_feature 1..1350: note = derived and/or modified sequence opt1 from Timigutuzumab_HeavyChain
  source 1..1350: mol_type = other RNA
gaggtgcagctggtcgagagcggcgggggcctcgtgcagcccgggggctccctgcgcctgagctgcgccgcctccgggttcaacatcaaggacacctacatccactgggtgcggcaggcgccgggcaagggcctcgagtgggtcgcccgcatctaccccaccaacgggtacacgcggtacgccgacagcgtgaagggccgcttcaccatctccgccgacaccagcaagaacaccgcctacctgcagatgaactccctgcgggcggaggacacggccgtgtactactgcagccgctggggcggggacgggttctacgccatggactactggggccagggcaccctcgtcaccgtgtccagcgcctccaccaaggggcccagcgtgttccccctggcgccgtccagcaagtccacgagcggcgggaccgccgccctgggctgcctcgtcaaggactacttccccgagcccgtgaccgtgtcctggaacagcggcgccctgacctccggggtccacacgttccccgccgtgctgcagagcagcggcctctactccctgagctccgtggtcaccgtgccgagctccagcctggggacccagacctacatctgcaacgtgaaccacaagccctccaacacgaaggtcgacaagaaggtggagcccaagagctgcgacaagacccacacgtgcccgccctgccccgcgcccgagctcctgggcgggccctccgtgttcctgttcccgcccaagcccaaggacaccctcatgatcagccggacccccgaggtgacctgcgtcgtggtcgacgtgtcccacgaggacccggaggtcaagttcaactggtacgtggacggcgtggaggtccacaacgccaagaccaagccccgcgaggagcagtacaacagcacctaccgggtggtgtccgtcctgacggtgctgcaccaggactggctcaacggcaaggagtacaagtgcaaggtgagcaacaaggccctgcccgcccccatcgagaagaccatctccaaggccaaggggcagccgcgcgagccccaggtctacaccctgccgcccagccgggacgagctcaccaagaaccaggtgtccctgacgtgcctggtgaagggcttctaccccagcgacatcgcggtcgagtgggagtccaacgggcagcccgagaacaactacaagaccacgcccccggtgctcgacagcgacggcagcttcttcctgtactccaagctgaccgtggacaagagccgctggcagcaggggaacgtcttctcctgcagcgtgatgcacgagggcctccacaaccactacacccagaagtccctgagcctgtcccccggcaag

SEQ ID NO: 8723 - RNA, 642 nt, synthetic construct; identical to SEQ ID NO: 8384
  misc_feature 1..642: note = derived and/or modified sequence opt1 from Timigutuzumab_LightChain
  source 1..642: mol_type = other RNA

SEQ ID NO: 8724 - RNA, 1332 nt, synthetic construct; identical to SEQ ID NO: 7768
  misc_feature 1..1332: note = derived and/or modified sequence opt1 from Timolumab_HeavyChain
  source 1..1332: mol_type = other RNA

SEQ ID NO: 8725 - RNA, 642 nt, synthetic construct; identical to SEQ ID NO: 7769
  misc_feature 1..642: note = derived and/or modified sequence opt1 from Timolumab_LightChain
  source 1..642: mol_type = other RNA

SEQ ID NO: 8726 - RNA, 1347 nt, synthetic construct
  misc_feature 1..1347: note = derived and/or modified sequence opt1 from Tomuzotuximab_HeavyChain
  source 1..1347: mol_type = other RNA
caggtgcagctgaagcagagcggccccgggctcgtccagccgtcccagagcctgtccatcacgtgcaccgtgagcggcttctccctgaccaactacggggtgcactgggtccgccagagccccggcaaggggctcgagtggctgggcgtgatctggtccggcgggaacaccgactacaacacccccttcaccagccggctgtccatcaacaaggacaacagcaagtcccaggtgttcttcaagatgaacagcctccagtccaacgacacggccatctactactgcgcccgcgcgctgacctactacgactacgagttcgcctactggggccaggggaccctggtcaccgtgagcacggcctccaccaagggccccagcgtgttcccgctcgccccctccagcaagtccaccagcgggggcaccgccgcgctgggctgcctggtcaaggactacttccccgagcccgtgacggtgagctggaactccggggccctcaccagcggcgtccacaccttcccggccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgccccgcccccgagctgctcggcgggccgtccgtgttcctgttcccgcccaagcccaaggacaccctgatgatcagccggacccccgaggtgacctgcgtcgtggtcgacgtgtcccacgaggaccccgaggtcaagttcaactggtacgtggacggcgtggaggtccacaacgcgaagacgaagccccgcgaggagcagtacaacagcacctaccgggtggtgtccgtcctcaccgtgctgcaccaggactggctgaacgggaaggagtacaagtgcaaggtgagcaacaaggccctccccgccccgatcgagaagaccatctccaaggccaagggccagccccgcgagccccaggtctacacgctgcccccgagccgggacgagctgaccaagaaccaggtgagcctgacctgcctcgtgaaggggttctacccctccgacatcgccgtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgagggcctgcacaaccactacacccagaagtccctcagcctgtcccccgggaag

SEQ ID NO: 8727 - RNA, 642 nt, synthetic construct; identical to SEQ ID NO: 7799
  misc_feature 1..642: note = derived and/or modified sequence opt1 from Tomuzotuximab_LightChain
  source 1..642: mol_type = other RNA

SEQ ID NO: 8728 - RNA, 1347 nt, synthetic construct; identical to SEQ ID NO: 8527
  misc_feature 1..1347: note = derived and/or modified sequence opt1 from Trastuzumab_duocarmazine_HeavyChain
  source 1..1347: mol_type = other RNA

SEQ ID NO: 8729 - RNA, 642 nt, synthetic construct; identical to SEQ ID NO: 8384
  misc_feature 1..642: note = derived and/or modified sequence opt1 from Trastuzumab_duocarmazine_LightChain
  source 1..642: mol_type = other RNA

SEQ ID NO: 8730 - RNA, 1368 nt, synthetic construct
  misc_feature 1..1368: note = derived and/or modified sequence opt1 from Varisacumab_HeavyChain
  source 1..1368: mol_type = other RNA
caggtgcagctggtccagagcggcgccgaggtgaagaagcccggggcctccgtgaaggtcagctgcaaggcgtccggcgggaccttcagctcctacgccatcagctgggtgcgccaggccccgggccaggggctcgagtggatgggcggcttcgaccccgaggacggggagaccatctacgcccagaagttccagggccgggtgacgatgaccgaggacacctccaccgacacggcctacatggagctgagctccctgcgcagcgaggacaccgcggtctactactgcgccaccgggcggtccatggtgcgcggcgtgatcatccccttcaacgggatggacgtctggggccagggcaccacggtgaccgtgagctccgccagcaccaaggggccctccgtcttcccgctcgcccccagctccaagagcacctccggcgggacggcggccctgggctgcctggtgaaggactacttccccgagcccgtgaccgtcagctggaacagcggcgccctcacctccggggtgcacaccttcccggccgtgctgcagagctccggcctgtacagcctctccagcgtcgtgacggtgccctccagctccctggggacccagacctacatctgcaacgtcaaccacaagcccagcaacaccaaggtggacaagaaggtggagcccaagtcctgcgacaagacgcacacgtgcccgccctgccccgcccccgagctgctcggcgggccgagcgtcttcctgttcccgcccaagcccaaggacaccctgatgatctcccggacccccgaggtgacctgcgtcgtggtggacgtcagccacgaggaccccgaggtgaagttcaactggtacgtggacggcgtcgaggtgcacaacgcgaagaccaagccccgcgaggagcagtacaactccacctaccgggtggtcagcgtgctcaccgtgctgcaccaggactggctgaacggcaaggagtacaagtgcaaggtctccaacaaggccctccccgccccgatcgagaagacgatcagcaaggccaaggggcagccccgcgagccccaggtgtacaccctgcccccgtcccgggacgagctgaccaagaaccaggtgagcctgacctgcctcgtcaagggcttctaccccagcgacatcgccgtggagtgggagtccaacgggcagcccgagaacaactacaagacgaccccgcccgtgctggacagcgacggctccttcttcctctacagcaagctgaccgtcgacaagtcccgctggcagcaggggaacgtgttcagctgctccgtgatgcacgaggcgctgcacaaccactacacccagaagtccctcagcctgagccccggcaag

SEQ ID NO: 8731 - RNA, 642 nt, synthetic construct
  misc_feature 1..642: note = derived and/or modified sequence opt1 from Varisacumab_LightChain
  source 1..642: mol_type = other RNA
gacatccgcatgacccagagcccctccagcctgtccgccagcgtgggcgaccgggtcaccatcacgtgccgcgcctcccagagcatctccagctacctcaactggtaccagcagaagccggggaaggcgcccaagctgctgatctacgccgcctccagcctccagtccggcgtgcccagccggttctccgggagcggctccgggaccgacttcaccctgaccatcagctccctgcagcccgaggacttcgccacgtactactgccagcagagctactccaccccgctcaccttcggcggcgggaccaaggtggagatcaagcgcacggtcgccgcgcccagcgtgttcatcttcccgcccagcgacgagcagctgaagtccggcaccgccagcgtggtctgcctgctcaacaacttctacccccgggaggccaaggtgcagtggaaggtggacaacgccctgcagtccgggaacagccaggagtccgtcaccgagcaggacagcaaggactccacctacagcctgtccagcacgctcaccctgtccaaggcggactacgagaagcacaaggtgtacgcctgcgaggtgacccaccagggcctgagctcccccgtcaccaagagcttcaaccgcggggagtgc

SEQ ID NO: 8732 - RNA, 1359 nt, synthetic construct
  misc_feature 1..1359: note = derived and/or modified sequence opt1 from Vunakizumab_HeavyChain
  source 1..1359: mol_type = other RNA
gaggtgcagctggtccagagcggcgccgaggtgaagaagcccggggcctccgtgaaggtcagctgcaaggcgtccggctacaccttcaccgactacgaggtgcactgggtgcgccaggccccggggcagggcctcgagtggatgggggtcatcgaccccggcacgggcggggtggcctacaaccagaagttcgagggccgggtgaccatgaccgccgacaccagcacgtccaccgcctacatggagctgcgcagcctgcggtccgacgacaccgcggtctactactgcacccgctacagcctcttctacgggtccagcccctacgccatggactactggggccaggggacgctggtgaccgtgtccagcgcctccaccaagggccccagcgtcttcccgctggccccctccagcaagtccaccagcggcgggacggcggccctcggctgcctggtgaaggactacttccccgagcccgtgaccgtctcctggaacagcggggccctgaccagcggcgtgcacaccttcccggccgtgctccagtccagcggcctgtactccctgagctccgtcgtgacggtgcccagctccagcctcgggacccagacctacatctgcaacgtcaaccacaagccctccaacaccaaggtggacaagaaggtggagcccaagagctgcgacaagacgcacacgtgcccgccctgccccgcccccgagctgctgggcgggccgtccgtcttcctcttcccgcccaagcccaaggacaccctgatgatcagccggacccccgaggtgacctgcgtcgtggtggacgtctcccacgaggaccccgaggtgaagttcaactggtacgtggacggcgtcgaggtgcacaacgcgaagaccaagccccgcgaggagcagtacaacagcacctaccgggtggtctccgtgctgaccgtgctccaccaggactggctgaacgggaaggagtacaagtgcaaggtcagcaacaaggccctgcccgccccgatcgagaagacgatctccaaggccaagggccagccccgcgagccccaggtgtacaccctcccgcccagccgggaggagatgaccaagaaccaggtgtccctgacctgcctggtcaagggcttctaccccagcgacatcgccgtggagtgggagagcaacgggcagcccgagaacaactacaagacgaccccgcccgtgctcgactccgacggcagcttcttcctgtactccaagctgaccgtcgacaagagccgctggcagcaggggaacgtgttctcctgcagcgtgatgcacgaggcgctccacaaccactacacccagaagtccctgagcctgtcccccggcaag

SEQ ID NO: 8733 - RNA, 639 nt, synthetic construct
  misc_feature 1..639: note = derived and/or modified sequence opt1 from Vunakizumab_LightChain
  source 1..639: mol_type = other RNA
gagatcgtgctgacccagagccccgacttccagtccgtcaccccgaaggagaaggtgacgatcacgtgcagcgcctccagctccgtgaactacatgcactggttccagcagaagcccgaccagagccccaagctctggatctaccgcacctccaacctggccagcggcgtcccctcccggttcagcgggtccggcagcgggaccgactacacgctgaccatcaactccctcgaggcggaggacgccgccacctactactgccagcagcgcagctcctacccgtggaccttcggccaggggacgaagctggagatcaagcggaccgtggccgcccccagcgtgttcatcttcccgccctccgacgagcagctcaagagcggcaccgcgtccgtcgtgtgcctgctgaacaacttctacccccgcgaggccaaggtgcagtggaaggtcgacaacgccctgcagagcggcaacagccaggagtccgtgaccgagcaggacagcaaggactccacgtacagcctctccagcaccctgaccctgtccaaggccgactacgagaagcacaaggtgtacgcgtgcgaggtcacccaccaggggctcagctcccccgtgaccaagagcttcaaccggggcgagtgc

SEQ ID NO: 8734 - RNA, 1341 nt, synthetic construct; identical to SEQ ID NO: 8637
  misc_feature 1..1341: note = derived and/or modified sequence opt1 from Xentuzumab_HeavyChain
  source 1..1341: mol_type = other RNA

SEQ ID NO: 8735 - RNA, 648 nt, synthetic construct; identical to SEQ ID NO: 8638
  misc_feature 1..648: note = derived and/or modified sequence opt1 from Xentuzumab_LightChain
  source 1..648: mol_type = other RNA

SEQ ID NO: 8736 - RNA, 726 nt, synthetic construct
  misc_feature 1..726: note = derived and/or modified sequence opt1 from anti-rabies_SO57_LightChain
  source 1..726: mol_type = other RNA
atgagcgtgcccaccatggcctgggccctgctcctgctgtccctcctgacccagggcacggggagctgggcgcagtccgccctgacccagccgcgcagcgtctccggcagccccgggcagtccgtgaccatcagctgcaccggcacgtccagcgacatcgggggctacaacttcgtgtcctggtaccagcagcaccccggcaaggcccccaagctcatgatctacgacgccaccaagcggccgagcggggtccccgaccgcttctccggcagcaagtccgggaacaccgccagcctgaccatctccggcctgcaggcggaggacgaggccgactactactgctgcagctacgccggggactacacgcccggcgtggtgttcggcgggggcaccaagctcaccgtcctggggcagcccaaggccgcgccgtccgtgaccctgttcccgcccagcagcgaggagctccaggccaacaaggccacgctggtgtgcctgatctccgacttctaccccggcgccgtcaccgtggcctggaaggcggacagctcccccgtgaaggccggcgtcgagaccaccacgcccagcaagcagtccaacaacaagtacgccgccagctcctacctcagcctgacccccgagcagtggaagtcccaccggagctactcctgccaggtgacccacgaggggagcaccgtggagaagacggtcgcccccaccgagtgctcc

SEQ ID NO: 8737 - RNA, 1428 nt, synthetic construct
  misc_feature 1..1428: note = derived and/or modified sequence opt1 from anti-rabies_SO57_HeavyChain
  source 1..1428: mol_type = other RNA
atggactggacctggcgcttcctgttcgtggtcgccgccgcgaccggcgtgcagagccaggtgcagctcgtccagtccggggccgaggtgaagaagcccggcagctccgtgaaggtcagctgcaaggcctccgggggcacgttcaaccggtacaccgtgaactgggtgcgccaggccccggggcagggcctggagtggatgggcgggatcatccccatcttcggcaccgccaactacgcgcagcggttccaggggcgcctgaccatcacggccgacgagagcacctccaccgcctacatggagctcagctccctgcggagcgacgacaccgccgtctacttctgcgcgcgcgagaacctggacaactccggcacgtactactacttcagcgggtggttcgacccctggggccagggcaccctcgtgaccgtgtccagcgcctccaccaaggggcccagcgtcttcccgctggccccctccagcaagtccacgagcggcgggaccgccgccctgggctgcctcgtgaaggactacttccccgagcccgtgaccgtcagctggaactccggcgcgctgaccagcggggtgcacacgttcccggccgtgctgcagtccagcggcctctactccctgagctccgtcgtgaccgtgcccagctccagcctggggacccagacctacatctgcaacgtcaaccacaagccctccaacacgaaggtggacaagcgggtggagcccaagagctgcgacaagacccacacgtgcccgccctgccccgcccccgagctcctgggcgggccgtccgtcttcctgttcccgcccaagcccaaggacaccctcatgatcagccgcacccccgaggtgacctgcgtcgtggtggacgtctcccacgaggaccccgaggtgaagttcaactggtacgtggacggcgtcgaggtgcacaacgccaagaccaagccccgggaggagcagtacaacagcacctaccgcgtggtctccgtgctgacggtgctgcaccaggactggctcaacggcaaggagtacaagtgcaaggtcagcaacaaggccctgcccgcgccgatcgagaagaccatctccaaggccaaggggcagccccgggagccccaggtgtacaccctgcccccgagccgcgaggagatgaccaagaaccaggtgagcctcacgtgcctggtcaagggcttctacccctccgacatcgccgtggagtgggagagcaacgggcagcccgagaacaactacaagaccaccccgcccgtgctggactccgacggcagcttcttcctctactccaagctgaccgtcgacaagagccggtggcagcaggggaacgtgttctcctgcagcgtgatgcacgaggccctgcacaaccactacacgcagaagtccctcagcctgtcccccggcaag

SEQ ID NO: 8738 - RNA, 696 nt, synthetic construct
  misc_feature 1..696: note = derived and/or modified sequence opt1 from anti-rabies_SOJB_LightChain
  source 1..696: mol_type = other RNA
atggcctggaccgtgctgctcctgggcctgctcagccactgcaccgggtccgtcacgagctacgtgctgacccagcccccgtccgtgagcgtcgcccccggcaagaccgcgcgcatcaactgcgggggcaacaacatcgagtaccggtccgtgcactggtaccagcagaagtccgggcaggcccccgtggccgtcatctacgacaacagcgaccgccccagcggcatcccggagcggttctccggcagcaagtccgggaacaccgccacgctgaccatcagccgcgtggaggccggcgacgaggcggactactactgccaggtgtgggacatctccagcgacgtcgtgttcgggggcgggaccaagctcaccgtgctgggccagcccaaggccgccccctccgtcacgctgttcccgcccagctccgaggagctccaggccaacaaggcgaccctggtgtgcctgatcagcgacttctaccccggcgccgtgaccgtcgcctggaaggccgactccagccccgtgaaggccggggtggagaccacgacccccagcaagcagtccaacaacaagtacgcggccagctcctacctcagcctgaccccggagcagtggaagtcccaccggagctactcctgccaggtcacccacgagggcagcacggtggagaagaccgtggcccccaccgagtgctcc

SEQ ID NO: 8739 - RNA, 1554 nt, synthetic construct
  misc_feature 1..1554: note = derived and/or modified sequence opt1 from anti-rabies_SOJB_HeavyChain
  source 1..1554: mol_type = other RNA
atggacaccctgtgcagcaccctcctgctgctcacgatcccctcctgggtgctgagccagatcaccctgaaggagaccggccccaccctcgtcaagcccacgcagaccctgaccctgacctgcacgttctccgggttcagcctctccaccagcggcgtgggggtgggctggatccgccagccgcccgggaaggccctggagtgggtcaccctgatctactgggacgacgacaagcggtactccccgagcctcgagaaccgcgtgaccatccggaaggacacgtccaagaaccaggtggccctgaccatgaccaacatggaccccctggacaccggcacgtactactgcgcgcaccgccagcacatcagctccttcccctggttcgacagctggggccaggggaccctcgtcaccgtgtccagcgcctccaccaagggccccagcgtgttcccgctggccccctgctcccggagcacgtccgggggcaccgccgccctggggtgcctcgtcaaggactacttccccgagcccgtgaccgtgagctggaacagcggcgcgctgacctccggcgtccacacgttcccggccgtgctgcagagctccgggctctacagcctgtccagcgtggtcaccgtgccctccagctccctgggcacccagacctacacgtgcaacgtgaaccacaagcccagcaacaccaaggtcgacaagcgcgtggagctcaagacgcccctgggggacaccacccacacgtgcccgcggtgccccgagcccaagtcctgcgacacgcccccgccctgcccccgctgccccgagcccaagagctgcgacacgcccccgccctgcccccggtgccccgagcccaagtcctgcgacaccccgccgccctgcccccgctgccccgcccccgagctgctcggcggccccagcgtgttcctgttcccgcccaagcccaaggacaccctgatgatctcccggacccccgaggtgacctgcgtcgtggtcgacgtgagccacgaggaccccgaggtccagttcaagtggtacgtggacggggtggaggtccacaacgccaagaccaagccgcgcgaggagcagttcaactccaccttccgggtggtgagcgtcctcaccgtgctgcaccaggactggctgaacggcaaggagtacaagtgcaaggtgtccaacaaggcgctccccgcccccatcgagaagaccatcagcaagaccaaggggcagccccgcgagccgcaggtctacaccctgccgcccagccgggaggagatgaccaagaaccaggtgtccctgacctgcctcgtgaagggcttctaccccagcgacatcgccgtcgagtgggagtccagcgggcagcccgagaacaactacaacaccacgccgcccatgctggactccgacggcagcttcttcctgtactccaagctcaccgtggacaagagccgctggcagcagggcaacatcttctcctgcagcgtgatgcacgaggccctgcacaaccggttcacccagaagtccctgagcctctcccccgggaag

SEQ ID NO: 8740 - RNA, 702 nt, synthetic construct
  misc_feature 1..702: note = derived and/or modified sequence opt1 from anti-rabies_SOJA_LightChain
  source 1..702: mol_type = other RNA
atggaggcccccgcccagctcctgttcctgctgctcctgtggctgccggacaccaccggcgagatcgtgctcacgcagagccccgcgaccctgtccctgagccccggggagcgggccaccctcgcctgccgggcctcccagaccgccagccgctacctggcgtggtaccagcagaagcccggccaggccccgcggctgctcatctacgacacgtccaaccgcgccaccgggatccccgcccggttcagcggctccgggagcggcaccgacttcaccctgtccatcagctccctggagcccgaggacttcgcggtctactactgccagcagcgcttcaactggccctggacgttcggccaggggaccaaggtggagttcaagcggaccgtggccgccccgagcgtcttcatcttcccgccctccgacgagcagctcaagagcggcaccgcctccgtggtgtgcctgctgaacaacttctacccccgcgaggccaaggtccagtggaaggtggacaacgcgctccagagcgggaactcccaggagagcgtgacggagcaggactccaaggacagcacctacagcctgtccagcaccctgaccctctccaaggccgactacgagaagcacaaggtctacgcctgcgaggtgacgcaccagggcctgagctcccccgtgaccaagagcttcaaccgcggggagtgc

SEQ ID NO: 8741 - RNA, 1422 nt, synthetic construct
  misc_feature 1..1422: note = derived and/or modified sequence opt1 from anti-rabies_SOJA_HeavyChain
  source 1..1422: mol_type = other RNA
atggagttcggcctgagctggctgttcctggtggccatcctgaagggggtccagtgcgaggtgcagctcctggagtccggcgggggcctggtgcagcccgggggcagcctccgcctgtcctgcgccgcgagcggcttcaccttctccaactacgccatgagctgggtccggcaggccccggggaagggcctggagtgggtgtccgccatcagcgcctccgggcacagcacctacctcgcggactccgtgaagggccgcttcacgatcagccgggacaactccaagaacaccctgtacctgcagatgaacagcctccgcgccgaggacaccgccgtctactactgcgccaaggaccgggaggtgaccatgatcgtggtcctgaacgggggcttcgactactggggccaggggacgcgcgtgaccgtgtccagcgcgtccaccaagggccccagcgtcttccccctggccccctccagcaagagcacctccgggggcacggccgccctcggctgcctggtgaaggactacttcccggagcccgtgaccgtcagctggaactccggggccctgaccagcggcgtgcacaccttccccgcggtgctccagtccagcgggctgtactccctgagctccgtcgtgacggtgcccagctccagcctcggcacccagacctacatctgcaacgtcaaccacaagccgtccaacaccaaggtggacaagcgggtggagcccaagagctgcgacaagacgcacacgtgcccgccctgcccggcccccgagctgctcgggggcccctccgtcttcctcttcccgcccaagcccaaggacaccctgatgatcagccgcacccccgaggtgacctgcgtcgtggtggacgtctcccacgaggaccccgaggtgaagttcaactggtacgtggacggcgtcgaggtgcacaacgccaagaccaagccgcgggaggagcagtacaacagcacctaccgcgtggtctccgtgctgaccgtgctccaccaggactggctgaacgggaaggagtacaagtgcaaggtcagcaacaaggccctgcccgcccccatcgagaagacgatcagcaaggcgaagggccagccccgggagccccaggtgtacaccctcccgccctcccgcgaggagatgaccaagaaccaggtgagcctgacctgcctggtcaaggggttctacccctccgacatcgccgtggagtgggagagcaacggccagcccgagaacaactacaagacgaccccgcccgtgctcgactccgacgggagcttcttcctgtactccaagctgaccgtcgacaagagccggtggcagcagggcaacgtgttctcctgcagcgtgatgcacgaggccctccacaaccactacacccagaagtccctgagcctgtcccccggcaag

SEQ ID NO: 8742 - RNA, 321 nt, synthetic construct
  misc_feature 1..321: note = derived and/or modified sequence opt1 from anti-rabies_LightChain
  source 1..321: mol_type = other RNA
gtgatgacccagagccccgccaccctgtccctcagcccgggcgagcgcgccacgctgtcctgccgggcgagccagtccgtccgcaactacctggcctggtaccagcagaagcccgggcaggcgccccggctcctgatctacggcgccagcaaccgcgccaccgggatccccgcccggttctccggcagcgggtccggcaccgacttcaccctgacgatcagctccctcgagccggaggacttcgccgtgtactactgccagcagcgcagcgactggcccctgtccttcggccaggggaccaagctggagatcaagcggacc

SEQ ID NO: 8743 - RNA, 333 nt, synthetic construct
  misc_feature 1..333: note = derived and/or modified sequence opt1 from anti-rabies_HeavyChain
  source 1..333: mol_type = other RNA
ggccccgcctgggaggtgccggagaccctgcccgtccagcccctcgacagcccctccgtggccatggcgtgcaccggggtgcgccaggccccgggcaaggggctggagtgggtcgccgtgatcagctacgacggctccaacaagtactacgccgacagcgtgaaggggcggttcacgatctcccgcgacaacagcaagaacaccctgtacctccagatgaactccctgcgggccgaggacaccgcggtctactactgcgccaaggacagcaactccggcagctactacgcccacgacctgggctactgggggcagggcaccctcgtgacggtg

SEQ ID NO: 8744 - RNA, 342 nt, synthetic construct
  misc_feature 1..342: note = derived and/or modified sequence opt1 from anti-rabies_LightChain
  source 1..342: mol_type = other RNA
gagctggtgatgacccagagccccctctccctgccggtcaccctgggccagcccgccagcatctcctgccgcagctcccagagcctcatccactccaacgggaacacgtacctgaactggttccagcagcggcccggccagagcccccgccggctgatctacaaggtgtccgaccgcgacagcggggtgccggaccggttctccggcagcgggtccggcaccgacttcaccctcaagatcagccgcgtcgaggccgaggacgtgggcgtgtactactgcctgcaggggacccactggccccggacgttcggccaggggaccaagctggagatcaagcgcacc

SEQ ID NO: 8745 - RNA, 351 nt, synthetic construct
  misc_feature 1..351: note = derived and/or modified sequence opt1 from anti-rabies_HeavyChain
  source 1..351: mol_type = other RNA
gtggtccagcccggccgcagcctgcggctctcctgcgccgccagcgggttcaccttctccagctacgcgatgcactgggtgcgccaggccccgggcaaggggctggagtgggtggccgtcatctcctacgacggcagcaacaagtactacgccgactccgtgaaggggcggttcaccatcagccgcgacaactccaagaacacgctgtacctccagatgaacagcctgcgggccgaggacaccgcggtgtactactgcgcccgcgacaaggccctggccgcgcggcgcggctactactactactacggcaccgacgtctgggggcagggcaccctcgtgacggtgtccagc

SEQ ID NO: 8746 - RNA, 648 nt, synthetic construct
  misc_feature 1..648: note = derived and/or modified sequence opt1 from anti-RSV_5ITB_LightChain
  source 1..648: mol_type = other RNA
agcgacatccagatgacccagtcccccagcaccctgtccgccagcgtgggcgaccgcgtcacgatcacgtgccgggcctcccagagcatctccagctggctcgcgtggtaccagcagaagccggggaaggcccccaagctgctgatctacgacgcctccagcctcgagtccggcgtgcccagccgcttctccgggagcggctccgggaccgagttcaccctgaccatcagctccctgcagcccgacgacttcgccacctactactgccagcagtacaacacctacagctggtggaccttcggccagggcacgaaggtggacatcaagcggaccgtcgccgcgccgtccgtgttcatcttcccgcccagcgacgagcagctcaagagcgggaccgcctccgtggtctgcctgctgaacaacttctacccccgcgaggccaaggtgcagtggaaggtggacaacgccctccagagcggcaactcccaggagagcgtcaccgagcaggactccaaggacagcacgtactccctgagctccaccctgaccctcagcaaggcggactacgagaagcacaaggtgtacgcctgcgaggtgacccaccaggggctgtccagccccgtcacgaagtccttcaaccggggcgagtgc

SEQ ID NO: 8747 - RNA, 660 nt, synthetic construct
  misc_feature 1..660: note = derived and/or modified sequence opt1 from anti-RSV_5ITB_HeavyChain
  source 1..660: mol_type = other RNA
gtggagagcggcgggggcctgatccagcccgggggctccctccgcctgagctgcgccgtctccgggttcaccgtgagctccaagtacatgacctgggtgcggcaggccccgggcaagggcctggagtgggtcagcgtgatctacgggggcgggtccacgtactacgcggacagcgtggtcggccgcttcaccatctcccgggacaacagcaagaacaccctctacctgcagatgaactccctgcgcgccgaggacaccgccgtgtactactgcgccagccggctcggggtgcgcgccacgaccggcgacctggactactggggccaggggaccctggtcaccgtgtccagcgcgtccacgaagggccccagcgtgttccccctcgccccctccagcaagtccaccagcgggggcaccgccgccctgggctgcctggtcaaggactacttcccggagcccgtgaccgtgagctggaactccggggcgctcacgagcggcgtccacaccttccccgccgtgctgcagtccagcgggctgtactccctcagctccgtggtcaccgtgcccagctccagcctgggcacccagacgtacatctgcaacgtgaaccacaagccgtccaacaccaaggtcgacaagcgggtggagcccaagagctgc

SEQ ID NO: 8748 - RNA, 639 nt, synthetic construct; identical to SEQ ID NO: 8712
  misc_feature 1..639: note = derived and/or modified sequence opt1 from anti-alpha-toxin_4U6V_LightChain
  source 1..639: mol_type = other RNA

SEQ ID NO: 8749 - RNA, 675 nt, synthetic construct
  misc_feature 1..675: note = derived and/or modified sequence opt1 from anti-alpha-toxin_4U6V_HeavyChain
  source 1..675: mol_type = other RNA
gaggtgcagctggtcgagagcggcgggggcctcgtgcagcccgggggctccctgcgcctgagctgcgccgcctccgggttcaccttcagctcccacgacatgcactgggtgcggcaggcgaccggcaagggcctcgagtgggtcagcgggatcggcacggccggggacacctactacccggactccgtgaagggccgcttcaccatcagccgggagaacgccaagaactccctgtacctgcagatgaacagcctccgcgccggggacaccgccgtgtactactgcgcgcgggaccgctactcccccacgggccactactacggcatggacgtctgggggcagggcaccaccgtgaccgtgagctccgccagcacgaaggggccctccgtcttccccctggccccgagctccaagagcacctccggcggcaccgccgcgctggggtgcctcgtgaaggactacttccccgagcccgtgaccgtcagctggaacagcggcgccctgacgtccggggtgcacaccttccccgccgtgctgcagagctccggcctctacagcctgtccagcgtcgtgaccgtgccgtccagctccctggggacccagacgtacatctgcaacgtcaaccacaagcccagcaacaccaaggtggacaagcgggtggagcccaagtcctgc

SEQ ID NO: 8750 - RNA, 879 nt, synthetic construct
  misc_feature 1..879: note = derived and/or modified sequence opt1 from anti-alpha-toxin_4U6V_Chain-A
  source 1..879: mol_type = other RNA
gccgacagcgacatcaacatcaagaccggcaccacggacatcgggtccaacaccaccgtgaagaccggcgacctggtcacgtacgacaaggagaacgggatgcacaagaaggtgttctacagcttcatcgacgacaagaaccacaacaagaagctcctggtgatccgcaccaagggcaccatcgccgggcagtaccgggtctactccgaggagggcgcgaacaagagcggcctggcctggccctccgccttcaaggtgcagctccagctgccggacaacgaggtggcccagatcagcgactactacccccgcaactccatcgacaccaaggagtacatgagcacgctgacctacgggttcaacggcaacgtcaccggggacgacaccggcaagatcgggggcctcatcggcgccaacgtgtccatcgggcacacgctgaagtacgtgcagcccgacttcaagaccatcctggagagccccaccgacaagaaggtcggctggaaggtgatcttcaacaacatggtgaaccagaactgggggccgtacgaccgggactcctggaaccccgtctacggcaaccagctgttcatgaagacccgcaacggcagcatgaaggcggccgacaacttcctcgaccccaacaaggcctccagcctgctctccagcgggttctcccccgacttcgccacggtgatcaccatggaccggaaggcgagcaagcagcagaccaacatcgacgtgatctacgagcgcgtccgggacgactaccagctgcactggacctccacgaactggaagggcaccaacaccaaggacaagtggatcgaccgcagcagcgagcggtacaagatcgactgggagaaggaggagatgaccaac

SEQ ID NO: 8751 - RNA, 879 nt, synthetic construct; identical to SEQ ID NO: 8750
  misc_feature 1..879: note = derived and/or modified sequence opt1 from anti-alpha-toxin_4U6V_Chain-B
  source 1..879: mol_type = other RNA

SEQ ID NO: 8752 - RNA, 642 nt, synthetic construct
  misc_feature 1..642: note = derived and/or modified sequence opt1 from anti-IsdB_5D1Q_Chain-A
  source 1..642: mol_type = other RNA
gacatccagctgacccagagcccctccagcgtgtccgccagcgtcggcgaccgcatcaccatcacgtgccgggcctcccaggacatcagcaactgggtggcgtggtaccagcagaagccggggaaggcccccaagctcctgatctactccgccagctccctgcagagcggcgtgccctcccgcttcagcgggtccggcagcgggaccgacttcaccctcaccatctccagcctgcagcccgaggacttcgccacgtactactgccagcaggccaacaccttcccgtggaccttcggccagggcaccaaggtcgagatcaagcggacggtggcggccccctccgtgttcatcttcccgcccagcgacgagcagctgaagtccgggaccgccagcgtcgtgtgcctcctgaacaacttctacccccgcgaggccaaggtgcagtggaaggtcgacaacgcgctgcagagcggcaactcccaggagagcgtgaccgagcaggactccaaggacagcacctactccctcagctccacgctgaccctgagcaaggccgactacgagaagcacaaggtgtacgcctgcgaggtcacccaccaggggctctccagccccgtgaccaagtccttcaaccggggcgagtgc

SEQ ID NO: 8753 - RNA, 783 nt, synthetic construct
  misc_feature 1..783: note = derived and/or modified sequence opt1 from anti-IsdB_5D1Q_Chain-B
  source 1..783: mol_type = other RNA
caggtgcagctggtccagagcggcgccgaggtgaagaagcccgcctccagcgtgaaggtctcctgccaggcgagcgggggctccttcagcacccgcaccatctcctggctccggcaggccccggggcagggcctggagtggatgggcgggatcagccccatcttcggcgccgccaactacgcccagcgcttccaggggcgggtgacgatcaccgcggacaagtccaccagcaccgcctacatggagctgacgtccctcaccagcgaggacaccgccgtgtactactgcgcccgcgaccggccgcccggcgcgcagttcgacacctgggggcagggcacgctggtcaccgtgtccagcgcctccaccaaggggccgagcgtgttccccctggccccctccagcaagtccaccagcggcggcacggccgccctcgggtgcctggtcaaggactacttccccgagccggtgaccgtgagctggaactccggcgcgctgaccagcggggtccacaccttccccgccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgggggcgggtccggccaccaccaccaccaccaccaccaccaccacgggggcgactacaaggaccacgacggcgactacaaggaccacgacatcgactacaaggacgacgacgacaag

SEQ ID NO: 8754 - RNA, 822 nt, synthetic construct
  misc_feature 1..822: note = derived and/or modified sequence opt1 from anti-IsdB_5D1Q_Chain-C
  source 1..822: mol_type = other RNA
gaggtgcagctggtcgagagcggcgggggcctcgtgcagcccgggggctccctgaccctgagctgcgccgcctccgggctcatcttcagcgactccaccatgcactgggtgcgccaggcgagcggccggggcctggagtgggtcgcccgcatccggtccaaggccaacaactacgccacgagctccgacaagagcgccaccgcgtacctggcctccgtgaaggggcgcttcaccatcagccgggacgactccaaggacaccacgttcctcgagatgagctccctgaagatcgaggacaccgccgtgtactactgcatcgccagctccaccaccggctggtacgtccgcgaggacttcgactactgggggcacggcacgctggtgaccgtgagctccgcgagcaccaaggggccgagcgtcttccccctcgccccctccagcaagtccaccagcggcggcacggccgccctggggtgcctggtgaaggactacttccccgagccggtgaccgtctcctggaacagcggcgccctcacctccggggtgcacaccttccccgcggtgctgcagagctccggcctgtacagcctctccagcgtcgtgacggtgccctccagctccctgggcacccagacctacatctgcaacgtcaaccacaagcccagcaacaccaaggtggacaagaaggtggagccgaagtcctgcgggggcgggagcggccaccaccaccaccaccaccaccaccaccacgggggcgactacaaggaccacgacggcgactacaaggaccacgacatcgactacaaggacgacgacgacaag

SEQ ID NO: 8755 - RNA, 648 nt, synthetic construct
  misc_feature 1..648: note = derived and/or modified sequence opt1 from anti-IsdB_5D1Q_Chain-D
  source 1..648: mol_type = other RNA
gagatcgtgctgacccagagccccggcaccctctccctgagcccgggggagcgcgccacgctgtcctgccgggccagccagtccgtcagctccagctacctcgcgtggtaccagcagaagcccggccaggcgccccgcctgctgatctacggggcctccagccgggccaccggcatccccgaccgcttctccgggagcggctccggcaccgacttcaccctcagcatctcccggctggagccggaggacttcgccgtgtactactgcctgcactacgggacgagccccatgtacaccttcggccaggggaccaagctcgagatcaagcgcaccgtggccgccccctccgtcttcatcttcccgcccagcgacgagcagctgaagtccggcacggccagcgtggtgtgcctgctcaacaacttctacccccgggaggccaaggtccagtggaaggtggacaacgcgctgcagagcgggaactcccaggagagcgtgaccgagcaggactccaaggacagcacctactccctgagctccaccctcacgctgagcaaggccgactacgagaagcacaaggtctacgcctgcgaggtgacccaccagggcctgtccagccccgtgaccaagtccttcaaccgcggcgagtgc

SEQ ID NO: 8756 - RNA, 360 nt, synthetic construct
  misc_feature 1..360: note = derived and/or modified sequence opt1 from anti-IsdB_5D1Q_Chain-E
  source 1..360: mol_type = other RNA
cccggcaagatgaccgacctgcaggacaccaagtacgtggtctacgagagcgtggagaacaacgagtccatgatggacacgttcgtgaagcacccgatcaagaccgggatgctcaacggcaagaagtacatggtcatggagaccaccaacgacgactactggaaggacttcatggtggaggggcagcgcgtgcggacgatcagcaaggacgccaagaacaacacccgcaccatcatcttcccctacgtcgagggcaagaccctgtacgacgccatcgtgaaggtgcacgtcaagacgatcgactacgacgggcagtaccacgtgcggatcgtggacaaggaggcgttcaccaaggccaac

SEQ ID NO: 8757 - RNA, 657 nt, synthetic construct
  misc_feature 1..657: note = derived and/or modified sequence opt1 from anti-IsdB_5D1X_Chain-A
  source 1..657: mol_type = other RNA
gacatcgtgatgacccagagccccctgtccctcccggtcaccctgggccagcccgccagcatctcctgcagctccgcccagagcctggtgcactccgacggggacagctacctcacgtggttccaccagcgccccggccagagcccccggcgcctgatctacaaggtgtccatccgggacgcgggggtcccggaccgcttctccggcagcgggtccggcaccgacttcaccctgaagatcagccgggtggaggccgaggacgtgggcgtctactactgcatgcaggccacccactggccctacacgttcgggcagggcaccaagctcgagatcaagcgcaccgtggccgccccctccgtgttcatcttcccgcccagcgacgagcagctgaagtccgggaccgcgagcgtcgtgtgcctgctcaacaacttctacccccgggaggccaaggtgcagtggaaggtcgacaacgccctgcagtccggcaacagccaggagagcgtgacggagcaggactccaaggacagcacctactccctgagctccaccctcaccctgagcaaggccgactacgagaagcacaaggtgtacgcgtgcgaggtcacgcaccaggggctgtccagccccgtgaccaagtccttcaaccgcggcgagtgc

SEQ ID NO: 8758 - RNA, 777 nt, synthetic construct
  misc_feature 1..777: note = derived and/or modified sequence opt1 from anti-IsdB_5D1X_Chain-B
  source 1..777: mol_type = other RNA
caggtgcagctggtccagagcggctccgaggtgaagaagcccgggagctccgtgaccctcagctgcaaggcctccggcgacaccttcaacacgcacacctacagctgggtccggcaggccccggggcagcggctggagtggatcggcgggatcatgcccatcttcgcggcctccaagagcgcgccccacctccaggaccgcctgaccatcaccgccaacaaggccacgcggaccgcctacatggagctgacctccctgaccagcgacgactccggcgtgtactactgcgcccgcgacggccgcggggccctccagtactggggccaggggacgctggtgaccgtcagctccgccagcaccaagggcccctccgtgttcccgctggcgcccagctccaagagcacctccgggggcacggccgccctcggctgcctggtgaaggactacttccccgagcccgtcaccgtgagctggaacagcggggccctgacctccggcgtgcacaccttcccggccgtcctccagagctccgggctgtacagcctgtccagcgtggtgacggtcccctccagctccctcggcacccagacctacatctgcaacgtgaaccacaagcccagcaacaccaaggtggacaagaaggtcgagcccaagtcctgcggcgggggcagcgggcaccaccaccaccaccaccaccaccaccacggcggggactacaaggaccacgacggcgactacaaggaccacgacatcgactacaaggacgacgacgacaag

SEQ ID NO: 8759 - RNA, 822 nt, synthetic construct; identical to SEQ ID NO: 8754
  misc_feature 1..822: note = derived and/or modified sequence opt1 from anti-IsdB_5D1X_Chain-C
  source 1..822: mol_type = other RNA

SEQ ID NO: 8760 - RNA, 648 nt, synthetic construct
  misc_feature 1..648: note = derived and/or modified sequence opt1 from anti-IsdB_5D1X_Chain-D
  source 1..648: mol_type = other RNA
gagatcgtgctgacgcagacccccgccacgctcagcctgaccccgggcgagcgcgccaccctgacctgccgggcgtcccagagcgtctccagctcctacctcgcctggtaccagcagaagcccgggcaggcgccccgcctgctgatctacggcgccagctcccgggccacggggatccccgaccgcttcagcggctccgggagcggcaccgacttcaccctctccatcagccggctggagccggaggacttcgccgtgtactactgcctgcactacggcacctcccccatgtacttcttcgggcgcggcacggtgctcgacatcaagcggaccgtcgccgcccccagcgtgttcatcttcccgccctccgacgagcagctcaagagcgggaccgcctccgtggtctgcctgctgaacaacttctacccccgcgaggcgaaggtgcagtggaaggtggacaacgccctgcagagcggcaactcccaggagagcgtcaccgagcaggacagcaaggactccacgtacagcctgtccagcaccctcaccctgtccaaggccgactacgagaagcacaaggtgtacgcctgcgaggtgacccaccaggggctgagctcccccgtcaccaagagcttcaaccggggcgagtgc

SEQ ID NO: 8761 - RNA, 354 nt, synthetic construct
  misc_feature 1..354: note = derived and/or modified sequence opt1 from anti-IsdB_5D1X_Chain-E
  source 1..354: mol_type = other RNA
aagatgaccgacctgcaggacaccaagtacgtggtctacgagagcgtggagaacaacgagtccatgatggacacgttcgtgaagcaccccatcaagaccggcatgctcaacgggaagaagtacatggtcatggagaccaccaacgacgactactggaaggacttcatggtggagggccagcgcgtgcggacgatcagcaaggacgccaagaacaacacccgcaccatcatcttcccgtacgtcgaggggaagaccctgtacgacgccatcgtgaaggtgcacgtcaagacgatcgactacgacggccagtaccacgtgcggatcgtggacaaggaggcgttcaccaaggccaac

SEQ ID NO: 8762 - RNA, 792 nt, synthetic construct
  misc_feature 1..792: note = derived and/or modified sequence opt1 from anti-IsdB_5D1Z_Chain-B
  source 1..792: mol_type = other RNA
gccgaggtgcagctggtcgagagcggcgggggcgtggtgcagcccgggggctccctccgcctgagctgcgccgcgtccgggttcaccttcaacaagttctggatgaactgggtccggcaggccccgggcaagggcctggagtgggtggccgacatccaggtggacgggagcgagaagaactacgtcgactccgtgaagggccgcttcaccatcagccgggacaacgggaagaactccctctacctgcagatgaacagcctgcgcgccgaggacacgggcgtgtactactgcgcccgggggcgctacgactactggtccggctacctcagcccctggggccaggggaccctggtcaccgtgtccagcgcgtccaccaagggccccagcgtgttccccctggccccgtccagcaagtccacgagcgggggcaccgccgccctcggctgcctggtcaaggactacttccccgagcccgtgaccgtgtcctggaacagcggggcgctgaccagcggcgtccacacgttccccgccgtgctccagtccagcgggctgtactccctgagctccgtggtcaccgtgccgagctccagcctcggcacccagacctacatctgcaacgtgaaccacaagccctccaacacgaaggtcgacaagaaggtggagcccaagagctgcgggggcggctccgggcaccaccaccaccaccaccaccaccaccacggcggggactacaaggaccacgacggcgactacaaggaccacgacatcgactacaaggacgacgacgacaag

SEQ ID NO: 8763 - RNA, 642 nt, synthetic construct
  misc_feature 1..642: note = derived and/or modified sequence opt1 from anti-IsdB_5D1Z_Chain-C
  source 1..642: mol_type = other RNA
gacatccagctgacccagagcccctccttcctcagcgcctccgtggccgaccgcgtcaccatcacgtgccgggcgagccaggccgtgcgctccagcctggcctggtaccagcagaagccgggcaaggcgccccagctgctcatctactccgccagcaccctggagaacggggtgtccagccggttctccggcagcgggcccggcaccgagttcaccctgacgatctccagcctccagcccgaggacgtcgggacctactactgccagcagctgaacacctacccgttcaccttcggccccggcacgaaggtggagatcaagcgcaccgtggccgccccctccgtcttcatcttcccgcccagcgacgagcagctgaagtccgggaccgccagcgtggtgtgcctcctgaacaacttctacccccgggaggccaaggtccagtggaaggtggacaacgcgctgcagtccggcaacagccaggagagcgtgaccgagcaggactccaaggacagcacgtactccctcagctccaccctgaccctgagcaaggccgactacgagaagcacaaggtctacgcctgcgaggtgacccaccaggggctctccagccccgtgacgaagtccttcaaccgcggcgagtgc

SEQ ID NO: 8764 - RNA, 810 nt, synthetic construct
  misc_feature 1..810: note = derived and/or modified sequence opt1 from anti-IsdB_5D1Z_Chain-D
  source 1..810: mol_type = other RNA
caggtgcagctgcaggagagcggccccgggctcgtcaagccgtccgagaccctgagcctgatctgcaccgtgtccggcgggagcatctccagctccagctactactggggctggatccgccagacgcccgagcggaacctcgagtggatcgggatcatctacttctccggcaccacctactacaaccccagcctgcagtcccgcgtgagcatgtccctggaccggagcaccaaccgcttctccctccggctgagctccgtcacggccgccgacaccgcgatctactactgcgccaagcccaagagccgcgaccggggcgggccgggcgacgactacttcgggatggacgtgtggggccaggggatcatggtgaccgtctccagcgccagcaccaagggcccctccgtgttccccctggcccccagctccaagagcacgtccggcgggaccgccgcgctcggctgcctggtgaaggactacttcccggagcccgtcaccgtgagctggaactccggggccctgaccagcggcgtgcacacgttccccgccgtcctccagtccagcggcctgtactccctgagctccgtggtgaccgtccccagctccagcctcgggacccagacctacatctgcaacgtgaaccacaagccgtccaacacgaaggtggacaagaaggtcgagcccaagagctgcggcgggggctccgggcaccaccaccaccaccaccaccaccaccacggcggcgactacaaggaccacgacggggactacaaggaccacgacatcgactacaaggacgacgacgacaag

SEQ ID NO: 8765 - RNA, 810 nt, synthetic construct; identical to SEQ ID NO: 8764
  misc_feature 1..810: note = derived and/or modified sequence opt1 from anti-IsdB_5D1Z_Chain-F
  source 1..810: mol_type = other RNA

SEQ ID NO: 8766 - RNA, 792 nt, synthetic construct; identical to SEQ ID NO: 8762
  misc_feature 1..792: note = derived and/or modified sequence opt1 from anti-IsdB_5D1Z_Chain-G
  source 1..792: mol_type = other RNA

SEQ ID NO: 8767 - RNA, 642 nt, synthetic construct
  misc_feature 1..642: note = derived and/or modified sequence opt1 from anti-IsdB_5D1Z_HeavyChain
  source 1..642: mol_type = other RNA
gacatccagatgacccagagcccctccttcctgagcgcctccgtgggcgaccgcgtcaccatcacgtgccgggccagccaggggatcaccacctacctcggctggtaccagcagcgcccggggaaggcgccccagctgctgatctacgccgcctccagcctccagtccggcgtgccgccccggttcagcgggtccggcagcggcaccgagttcacgctgaccatctccagcctgcagcccgaggacttcgccacctactactgccagcagctcaacacctacccctacacgttcgggcccggcacccgcctggagatcaagcggaccgtggccgcgccctccgtcttcatcttcccgcccagcgacgagcagctgaagtccgggaccgccagcgtggtgtgcctcctgaacaacttctacccccgcgaggccaaggtccagtggaaggtggacaacgccctgcagtccggcaacagccaggagtccgtgacggagcaggacagcaaggacagcacctactccctcagctccaccctgaccctgagcaaggcggactacgagaagcacaaggtctacgcctgcgaggtgacgcaccaggggctctccagccccgtgaccaagtccttcaaccggggcgagtgc

SEQ ID NO: 8768 - RNA, 471 nt, synthetic construct
  misc_feature 1..471: note = derived and/or modified sequence opt1 from anti-IsdB_5D1Z_Chain-I
  source 1..471: mol_type = other RNA
ggccccgccaaggccaccaacaacacctacccgatcctgaaccaggagctccgcgaggcgatcaagaaccccgccatcaaggacaaggaccacagcgcccccaactcccggcccatcgacttcgagatgaagaagaaggacgggacgcagcagttctaccactacgccagctccgtgaagccggcccgcgtcatcttcaccgacagcaagcccgagatcgagctgggcctgcagtccgggcagttctggcggaagttcgaggtgtacgagggcgacaagaagctccccatcaagctggtgagctacgacaccgtcaaggactacgcgtacatccgcttctccgtgagcaacgggaccaaggccgtgaagatcgtctccagcacgcacttcaacaacaaggaggagaagtacgactacaccctgatggagttcgcccagcccatctacaactccgccgacaagttcaagacc

SEQ ID NO: 8769 - RNA, 324 nt, synthetic construct
  misc_feature 1..324: note = derived and/or modified sequence opt1 from anti-HIV_b12_LightChain
  source 1..324: mol_type = other RNA
gagatcgtgctgacccagagccccggcaccctctccctgagcccgggggagcgcgccacgttctcctgccggagctcccacagcatccgctcccggcgcgtcgcctggtaccagcacaagcccggccaggcgccccggctggtgatccacggggtgagcaaccgcgcctccggcatcagcgaccggttctccgggagcggctccggcaccgacttcaccctcaccatcacgcgcgtcgagcccgaggacttcgccctgtactactgccaggtgtacggggccagctcctacaccttcggccaggggaccaagctggagcggaag

SEQ ID NO: 8770 - RNA, 381 nt, synthetic construct
  misc_feature 1..381: note = derived and/or modified sequence opt1 from anti-HIV_b12_HeavyChain
  source 1..381: mol_type = other RNA
caggtgcagctggagcagagcggcgccgaggtcaagaagcccggggcctccgtgaaggtgagctgccaggcgtccggctaccgcttcagccacttcaccgtccactgggtgcggcaggccccggggcagcgcttcgagtggatgggctggatcaacccctacaacgggaacaaggagttctccgccaagttccaggaccgggtgaccttcacggccgacaccagcgccaacaccgcgtacatggagctccgctccctgcggagcgccgacaccgccgtctactactgcgcccgcgtgggcgagtggggctgggacgactccccctacgacaactactacatggacgtgtgggggaagggcacgaccgtcatcgtgagctcc

SEQ ID NO: 8771 - RNA, 633 nt, synthetic construct
  misc_feature 1..633: note = derived and/or modified sequence opt1 from anti-HIV_2G12_LightChain
  source 1..633: mol_type = other RNA
gtggtcatgacccagagcccctccaccctgagcgcctccgtgggcgacacgatcaccatcacgtgccgcgccagccagtccatcgagacctggctcgcgtggtaccagcagaagccggggaaggcccccaagctgctgatctacaaggccagcaccctcaagaccggcgtgccctcccggttcagcgggtccggcagcgggaccgagttcaccctgacgatctccggcctgcagttcgacgacttcgccacctaccactgccagcactacgccggctacagcgcgaccttcgggcagggcacccgcgtcgagatcaagcggacggtggccgccccctccgtgttcatcttcccgcccagcgacgagcagctcaagtccgggaccgccagcgtcgtgtgcctgctgaacaacttctacccccgcgaggcgaaggtgcagtggaaggtcgacaacgccctccagtccggcaacagccaggagtccgtgaccgagcaggacagcaaggacagcacctactccctgagctccacgctgaccctcagcaaggccgactacgagaagcacaaggtgtacgcctgcgaggtcacccaccaggggctgtccagccccgtgaccaagtccttcaaccggggc

SEQ ID NO: 8772 - RNA, 672 nt, synthetic construct
  misc_feature 1..672: note = derived and/or modified sequence opt1 from anti-HIV_2G12_HeavyChain
  source 1..672: mol_type = other RNA
gaggtgcagctggtcgagagcggcgggggcctcgtgaaggccgggggctccctgatcctgagctgcggggtgtccaacttccgcatcagcgcccacaccatgaactgggtccggcgcgtgcccggcggcgggctcgagtgggtggcgtccatcagcacctccagcacgtaccgggactacgccgacgccgtcaagggccgcttcaccgtgtcccgggacgacctggaggacttcgtgtacctgcagatgcacaagatgcgcgtcgaggacaccgccatctactactgcgcccggaaggggagcgaccgcctctccgacaacgacccgttcgacgcgtggggccccgggaccgtggtgacggtcagccccgcctccaccaagggccccagcgtgttcccgctggccccctccagcaagtccaccagcggcgggaccgccgcgctgggctgcctcgtgaaggactacttccccgagcccgtcacggtgtcctggaacagcggggccctgaccagcggcgtgcacaccttcccggccgtcctgcagtccagcggcctctactccctgagctccgtggtgaccgtccccagctccagcctggggacgcagacctacatctgcaacgtgaaccacaagccctccaacaccaaggtggacaagaaggtcgagcccaag

SEQ ID NO: 8773 - RNA, 642 nt, synthetic construct
  misc_feature 1..642: note = derived and/or modified sequence opt1 from anti-HIV_4E10_LightChain
  source 1..642: mol_type = other RNA
gagatcgtgctgacccagagccccggcacccagtccctcagcccgggggagcgggccacgctgtcctgccgggccagccagtccgtcggcaacaacaagctggcgtggtaccagcagcgccccgggcaggcgccccggctcctgatctacggcgccagctcccgccccagcggggtggccgaccggttctccggcagcggctccgggaccgacttcaccctgaccatcagccgcctcgagccggaggacttcgccgtgtactactgccagcagtacggccagtccctgagcacgttcgggcagggcaccaaggtcgaggtgaagcggaccgtggccgccccctccgtcttcatcttcccgcccagcgacgagcagctgaagtccgggaccgccagcgtggtgtgcctcctgaacaacttctacccccgcgaggccaaggtccagtggaaggtggacaacgcgctgcagtccggcaacagccaggagagcgtgacggagcaggactccaaggacagcacctactccctcagctccaccctgaccctgagcaaggccgactacgagaagcacaaggtctacgcctgcgaggtgacgcaccagggcctctccagccccgtgaccaagtccttcaaccgcggggag

SEQ ID NO: 8774 - RNA, 684 nt, synthetic construct
  misc_feature 1..684: note = derived and/or modified sequence opt1 from anti-HIV_4E10_HeavyChain
  source 1..684: mol_type = other RNA
caggtgcagctggtccagagcggcgccgaggtgaagcgccccgggtccagcgtgaccgtctcctgcaaggccagcggcgggtccttcagcacctacgcgctctcctgggtgcggcaggccccgggccgcgggctggagtggatgggcggcgtgatccccctgctcacgatcaccaactacgcgccccggttccaggggcgcatcaccatcaccgccgaccggagcacgtccaccgcctacctggagctgaacagcctccgccccgaggacaccgccgtctactactgcgcccgggagggcaccacggggtggggctggctggggaagccgatcggcgccttcgcccactggggccaggggaccctggtgaccgtgtccagcgcgtccaccaagggccccagcgtcttccccctcgccccctccagcaagtccacgagcgggggcaccgccgccctgggctgcctggtgaaggactacttcccggagcccgtgaccgtctcctggaacagcggggccctcaccagcggcgtgcacacgttccccgcggtgctgcagtccagcgggctgtactccctcagctccgtcgtgaccgtgcccagctccagcctgggcacccagacctacatctgcaacgtcaaccacaagccgtccaacacgaaggtggacaagaaggtggagcccaag

SEQ ID NO: 8775 - RNA, 312 nt, synthetic construct
  misc_feature 1..312: note = derived and/or modified sequence opt1 from anti-HIV_VRC01_LightChain
  source 1..312: mol_type = other RNA
gagatcgtgctgacccagagccccggcaccctctccctgagcccgggggagacggccatcatctcctgccgcaccagccagtacggctccctggcctggtaccagcagcggcccgggcaggcgccccgcctcgtcatctacagcggctccacccgggccgccgggatccccgaccgcttcagcggctcccggtggggcccggactacaacctgaccatcagcaacctggagtccggggacttcggcgtgtactactgccagcagtacgagttcttcgggcagggcacgaaggtgcaggtcgacatcaagcgc

SEQ ID NO: 8776 - RNA, 363 nt, synthetic construct
  misc_feature 1..363: note = derived and/or modified sequence opt1 from anti-HIV_VRC01_HeavyChain
  source 1..363: mol_type = other RNA
caggtgcagctggtccagagcggcgggcagatgaagaagcccggcgagtccatgcgcatcagctgccgggcctccgggtacgagttcatcgactgcaccctcaactggatccgcctggccccgggcaagcggcccgagtggatggggtggctgaagccccgcggcggcgcggtgaactacgcccggcccctccaggggcgcgtgaccatgacgcgggacgtctacagcgacaccgccttcctggagctgcgctccctcaccgtggacgacaccgccgtgtacttctgcacgcggggcaagaactgcgactacaactgggacttcgagcactgggggcgcggcaccccggtcatcgtgagctcc

SEQ ID NO: 8777 - RNA, 330 nt, synthetic construct
  misc_feature 1..330: note = derived and/or modified sequence opt1 from anti-HIV_PG9_LightChain
  source 1..330: mol_type = other RNA
cagagcgccctgacccagcccgcctccgtgagcggctccccggggcagagcatcaccatctcctgcaacggcacgagcaacgacgtcgggggctacgagtccgtgagctggtaccagcagcaccccgggaaggcgcccaaggtggtcatctacgacgtgtccaagcgccccagcggcgtgtccaaccggttcagcggctccaagagcgggaacaccgcctccctcaccatcagcggcctgcaggccgaggacgagggggactactactgcaagtccctgaccagcacgcgccggcgcgtcttcggcaccgggaccaagctcaccgtgctg

SEQ ID NO: 8778 - RNA, 408 nt, synthetic construct
  misc_feature 1..408: note = derived and/or modified sequence opt1 from anti-HIV_PG9_HeavyChain
  source 1..408: mol_type = other RNA
cagcgcctggtggagagcggcgggggcgtcgtgcagcccgggtccagcctccggctgtcctgcgccgccagcggcttcgacttctcccgccaggggatgcactgggtgcggcaggcgccgggccagggcctggagtgggtcgccttcatcaagtacgacgggagcgagaagtaccacgccgactccgtgtggggccgcctcagcatctcccgggacaacagcaaggacaccctgtacctgcagatgaactccctccgcgtggaggacaccgccacgtacttctgcgtccgggaggccgggggccccgactaccgcaacgggtacaactactacgacttctacgacggctactacaactaccactacatggacgtgtggggcaaggggaccaccgtgaccgtcagctcc

SEQ ID NO: 8779 - RNA, 630 nt, synthetic construct
  misc_feature 1..630: note = derived and/or modified sequence opt1 from anti-HIV_VRC07_LightChain
  source 1..630: mol_type = other RNA
gagatcgtgctgacccagagccccggcaccctctccctgagcccgggggagacggccatcatctcctgccggaccagccagtacggctccctggcctggtaccagcagcggcccgggcaggcgccccgcctcgtcatctacagcggctccacccgggccgccgggatccccgaccgcttcagcggctcccggtggggcccggactacaccctgacgatcagcaacctggagtccggggacttcggcgtgtactactgccagcagtacgagttcttcgggcagggcaccaaggtgcaggtcgacatcaagcgcaccgtggccgcccccagcgtgttcatcttcccgccctccgacgagcagctcaagagcgggaccgcgtccgtcgtgtgcctgctgaacaacttctacccccgggaggccaaggtgcagtggaaggtcgacaacgccctccagagcggcaactcccaggagagcgtgacggagcaggactccaaggacagcacctacagcctgtccagcaccctgaccctctccaaggccgactacgagaagcacaaggtgtacgcgtgcgaggtcacgcaccagggcctgcgcagccccgtgaccaagtccttcaaccgcggggagtgc

SEQ ID NO: 8780 - RNA, 375 nt, synthetic construct
  misc_feature 1..375: note = derived and/or modified sequence opt1 from anti-HIV_VRC07_HeavyChain
  source 1..375: mol_type = other RNA
caggtgcagctggtccagagcggcgggcagatgaagaagcccggcgagtccatgcgcatcagctgccgggcctccgggtacgagttcatcgactgcaccctcaactggatccgcctggccccgggcaagcggcccgagtggatggggtggctgaagccccgcggcggcgcggtgaactacgcccggcccctccaggggcgcgtgaccatgacgcgggacgtctacagcgacaccgccttcctggagctgcgctccctcaccagcgacgacaccgccgtgtacttctgcacgcggggcaagtactgcaccgcccgcgactactacaactgggacttcgagcactgggggcagggcaccccggtgatcgtctccagc

SEQ ID NO: 8781 - RNA, 315 nt, synthetic construct
  misc_feature 1..315: note = derived and/or modified sequence opt1 from anti-HIV_3BNC117_LightChain
  source 1..315: mol_type = other RNA
gacatccagatgacccagagcccctccagcctgtccgccagcgtgggcgacaccgtcacgatcacgtgccaggccaacgggtacctcaactggtaccagcagcgccggggcaaggcgccgaagctgctgatctacgacgggtccaagctcgagcgcggcgtgcccagccggttctccgggcgccggtggggccaggagtacaacctgaccatcaacaacctgcagcccgaggacatcgccacctacttctgccaggtgtacgagttcgtcgtgcccggcacccgcctcgacctgaagcggaccgtggccgccccg

SEQ ID NO: 8782 - RNA, 387 nt, synthetic construct
  misc_feature 1..387: note = derived and/or modified sequence opt1 from anti-HIV_3BNC117_HeavyChain
  source 1..387: mol_type = other RNA
caggtgcagctgctccagagcggcgccgccgtcaccaagcccggggcgtccgtgcgcgtgagctgcgaggcctccggctacaacatccgggactacttcatccactggtggcgccaggccccggggcagggcctgcagtgggtcgggtggatcaaccccaagaccggccagcccaacaacccccggcagttccagggccgcgtgagcctgacgcggcacgcctcctgggacttcgacaccttcagcttctacatggacctcaaggccctgcgctccgacgacaccgcggtgtacttctgcgcccggcagcgcagcgactactgggacttcgacgtctgggggtccggcacccaggtgacggtgagctccgccagcaccaaggggccg

SEQ ID NO: 8783 - RNA, 324 nt, synthetic construct
  misc_feature 1..324: note = derived and/or modified sequence opt1 from anti-HIV_10-1074_LightChain
  source 1..324: mol_type = other RNA
agctacgtgcgccccctgtccgtcgccctcggcgagaccgcccggatcagctgcgggcgccaggcgctgggctcccgggccgtgcagtggtaccagcaccgcccggggcaggcccccatcctgctcatctacaacaaccaggaccggcccagcggcatccccgagcgcttctccgggaccccggacatcaacttcggcacgcgggccaccctgaccatcagcggcgtggaggccggggacgaggcggactactactgccacatgtgggactcccgcagcggcttctcctggagcttcgggggcgccacccggctgacggtcctc

SEQ ID NO: 8784 - RNA, 396 nt, synthetic construct
  misc_feature 1..396: note = derived and/or modified sequence opt1 from anti-HIV_10-1074_HeavyChain
  source 1..396: mol_type = other RNA
caggtgcagctgcaggagagcggccccgggctcgtcaagccgtccgagaccctgagcgtgacctgctccgtgagcggcgactccatgaacaactactactggacgtggatccgccagagccccgggaagggcctggagtggatcgggtacatctccgaccgggagagcgccacctacaacccctccctcaacagccgcgtcgtgatctcccgggacaccagcaagaaccagctgtccctgaagctcaacagcgtgacccccgccgacacggcggtctactactgcgccaccgcccgccggggccagcgcatctacggcgtggtgtccttcggggagttcttctactactacagcatggacgtctggggcaaggggaccaccgtgacggtgtccagc

SEQ ID NO: 8785 - RNA, 633 nt, synthetic construct
  misc_feature 1..633: note = derived and/or modified sequence opt1 from anti-HIV_PGT121_LightChain
  source 1..633: mol_type = other RNA
agcgacatctccgtggcccccggcgagaccgcccgcatcagctgcggggagaagtccctgggcagccgggcggtccagtggtaccagcaccgcgccgggcaggccccgtccctcatcatctacaacaaccaggaccggcccagcggcatccccgagcgcttctccgggagccccgactccccgttcggcaccacggccaccctgaccatcaccagcgtggaggccggcgacgaggcggactactactgccacatctgggactcccgggtgcccacgaagtgggtcttcgggggcgggaccaccctgaccgtgctcggccagcccaaggccgcccccagcgtgacgctgttcccgccctccagcgaggagctgcaggccaacaaggcgaccctcgtctgcctgatctccgacttctaccccggggccgtgaccgtggcctggaaggccgacagctcccccgtcaaggccggcgtggagaccacgaccccgagcaagcagtccaacaacaagtacgcggccagcagctacctgtccctcacccccgagcagtggaagtcccacaagagctacagctgccaggtgacccacgagggctccacggtcgagaagaccgtggcccccaccgagtgcagc

SEQ ID NO: 8786 - RNA, 705 nt, synthetic construct
  misc_feature 1..705: note = derived and/or modified sequence opt1 from anti-HIV_PGT121_HeavyChain
  source 1..705: mol_type = other RNA
cagatgcagctgcaggagagcggccccgggctcgtgaagccgtccgagaccctgagcctgacctgctccgtcagcggcgcctccatcagcgactcctactggagctggatccgccggtcccccgggaagggcctcgagtggatcgggtacgtgcacaagagcggcgacacgaactactcccccagcctgaagtcccgcgtgaacctgagcctcgacacctccaagaaccaggtcagcctgtccctggtggccgcgaccgccgccgacagcggcaagtactactgcgcccggaccctccacgggcgccggatctacggcatcgtggccttcaacgagtggttcacgtacttctacatggacgtctgggggaacggcacccaggtgaccgtgtccagcgcgagcaccaaggggccctccgtcttcccgctggcccccagctccaagagcacgtccggcggcaccgccgccctggggtgcctcgtgaaggactacttccccgagcccgtgaccgtcagctggaactccggcgcgctgaccagcggggtgcacacgttcccggccgtgctgcagtccagcggcctctactccctgagctccgtcgtgaccgtgcccagctccagcctgggcacccagacctacatctgcaacgtcaaccacaagccctccaacacgaaggtggacaagcgcgtggagcccaagagctgc

SEQ ID NO: 8787 - RNA, 657 nt, synthetic construct
  misc_feature 1..657: note = derived and/or modified sequence opt1 from anti-HIV_PGDM1400_LightChain
  source 1..657: mol_type = other RNA
gacttcgtgctgacgcagagcccccactccctcagcgtcaccccgggcgagtccgccagcatctcctgcaagagctcccacagcctgatccacggggaccgcaacaactacctggcctggtacgtgcagaagcccggccggagcccccagctcctgatctacctggcgagctcccgcgccagcggggtgcccgaccggttctccggcagcgggtccgacaaggacttcacgctcaagatcagccgcgtcgagaccgaggacgtgggcacctactactgcatgcagggccgggagtccccgtggaccttcgggcagggcacgaaggtggacatcaagcgcaccgtcgccgcccccagcgtgttcatcttcccgccctccgacgagcagctgaagtccgggaccgccagcgtggtctgcctgctcaacaacttctacccccgggaggcgaaggtgcagtggaaggtggacaacgccctgcagtccggcaacagccaggagtccgtcaccgagcaggacagcaaggactccacgtacagcctgtccagcaccctcaccctgtccaaggccgactacgagaagcacaaggtgtacgcctgcgaggtgacccaccaggggctgagctcccccgtcaccaagagcttcaaccgcggcgagtgc

SEQ ID NO: 8788 - RNA, 735 nt, synthetic construct
  misc_feature 1..735: note = derived and/or modified sequence opt1 from anti-HIV_PGDM1400_HeavyChain
  source 1..735: mol_type = other RNA
caggcccagctggtgcagagcggccccgaggtccgcaagccggggacctccgtgaaggtgagctgcaaggcccccggcaacaccctcaagacgtacgacctgcactgggtccggtccgtgcccgggcagggcctgcagtggatggggtggatcagccacgagggcgacaagaaggtgatcgtcgagcgcttcaaggcgaaggtgaccatcgactgggaccggtccaccaacaccgcctacctccagctgagcggcctgacgtccggggacaccgccgtgtactactgcgccaagggcagcaagcaccgcctccgggactacgccctgtacgacgacgacggggcgctgaactgggccgtcgacgtggactacctctccaacctggagttctggggccaggggaccgccgtgaccgtcagctccgccagcacgaagggcccctccgtgttcccgctggcgcccagctccaagagcacctccggcgggaccgccgccctcggctgcctggtgaaggactacttccccgagcccgtcaccgtgagctggaactccggggccctgacgagcggcgtgcacaccttcccggccgtcctccagagctccggcctgtacagcctgtccagcgtggtgaccgtcccctccagctccctcgggacccagacgtacatctgcaacgtgaaccacaagcccagcaacaccaaggtggacaagaaggtcgagcccaagtcctgcgac

SEQ ID NO: 8789 - RNA, 630 nt, synthetic construct
  misc_feature 1..630: note = derived and/or modified sequence opt1 from anti-HIV_N6_LightChain
  source 1..630: mol_type = other RNA
tacatccacgtgacccagagcccctccagcctgtccgtcagcatcggcgaccgggtgaccatcaactgccagacgtcccagggggtgggcagcgacctccactggtaccagcacaagccggggcgggcccccaagctgctgatccaccacacctccagcgtcgaggacggcgtgccctcccgcttcagcgggtccggcttccacaccagcttcaacctcaccatctccgacctgcaggccgacgacatcgcgacgtactactgccaggtgctgcagttcttcggccgggggagccgcctccacatcaagcggaccgtcgccgccccctccgtgttcatcttcccgcccagcgacgagcagctgaagtccggcaccgccagcgtggtctgcctgctcaacaacttctacccccgcgaggccaaggtgcagtggaaggtggacaacgcgctgcagtccgggaacagccaggagagcgtcaccgagcaggactccaaggacagcacgtactccctgagctccaccctcaccctgagcaaggccgactacgagaagcacaaggtgtacgcctgcgaggtgacccaccagggcctgtccagccccgtcacgaagtccttcaaccgcggggagtgc

SEQ ID NO: 8790 - RNA, 675 nt, synthetic construct
  misc_feature 1..675: note = derived and/or modified sequence opt1 from anti-HIV_N6_HeavyChain
  source 1..675: mol_type = other RNA
cgcgcccacctggtgcagagcggcaccgccatgaagaagcccggggcgtccgtccgggtgagctgccagacctccggctacacgttcaccgcccacatcctcttctggttccgccaggccccggggcggggcctggagtgggtggggtggatcaagccccagtacggcgccgtcaacttcggcgggggcttccgcgaccgggtgaccctgacccgcgacgtgtaccgggagatcgcctacatggacatccgcgggctcaagcccgacgacacggcggtctactactgcgcccgggaccgcagctacggcgactccagctgggccctggacgcctgggggcagggcaccaccgtggtggtctccgcggccagcaccaagggcccctccgtgttcccgctggcccccagctccaagagcacgtccgggggcaccgccgccctcgggtgcctggtgaaggactacttccccgagcccgtcaccgtgagctggaactccggcgcgctgaccagcggcgtgcacacgttcccggccgtcctccagtccagcgggctgtactccctgagcagcgtggtgaccgtcccctccagctccctcggcacccagacctacatctgcaacgtgaaccacaagcccagcaacacgaaggtggacaagaaggtcgagcccaagtcctgc

SEQ ID NO: 8791 - RNA, 1080 nt, synthetic construct
  misc_feature 1..1080: note = derived and/or modified sequence opt1 from anti-HIV_N6_GChain
  source 1..1080: mol_type = other RNA
gcctgggaggacgccgacaccaccctgttctgcgcgagcgacgccaaggcctactccacggagaagcacaacgtgtgggccacccacgcctgcgtccccaccgaccccgacccccaggagatccccctcgagaacgtgaccgagaacttcaacatgtggaagaacaacatggtggagcagatgcacgaggacatcatcagcctgtgggacgagtccctgaagccctgcgtcatgctcacgggcgggagcaccatcaagcaggcgtgcccgaaggtgaccttcgagcccatccccatccactactgcgcccccgccggcttcgccatcctgaagtgccgcgacgaggacttcaacgggaccggcccgtgcaagaacgtgtccacggtccagtgcacccacgggatcaagcccgtggtgagcacccagctgctcctgaacggctccctggcgaagggcgacatcgtcatccggagcgagaacctcaccaacaacgccaaggtgatcatcgtgcagctgaacgagcccgtccagatcgtgtgcatccgccccaacaacgggggctccgggagcggcggggacatccggcaggcccactgcaacgtgacgcgcggcaagtgggtcaacatcaccaagaacgtgaaggagcagctgtggaagatcttcaacaagaccaccaacatcacgttcaacaacaccatcttcaactccccggccggcggggacctcgagatcaccacccacagcttcaactgcggcggggagttcttctactgcaacacgtccgacctgttcaacgagaccaacctgagcgccaaccacaccgacaccaacgagaacatcacgctccagtgccggatcaagcagatcgtgcgcatgtggcagcgggtcggccaggcgatgtacgccccgcccatcgccggcaacatcacgtgcatctccaacatcaccgggctgctgctcacccgcgacggcgtgaacgacacccacgacaaggagaacgagaccttccggcccaccgggggcgacatgcgcgacaactggcggagcgagctgtacaagtacaaggtgatcaagctgaag

SEQ ID NO: 8792 - RNA, 645 nt, synthetic construct
  misc_feature 1..645: note = derived and/or modified sequence opt1 from anti-HIV_10E8_LightChain
  source 1..645: mol_type = other RNA
agctacgagctgacccaggagaccggcgtgtccgtcgccctcgggcgcacggtgaccatcacgtgccggggcgacagcctgcgctcccactacgccagctggtaccagaagaagcccgggcaggcgccgatcctcctgttctacggcaagaacaaccggccctccggggtgcccgaccgcttcagcggctccgccagcggcaaccgggcctccctgaccatcagcggggcccaggccgaggacgacgcggagtactactgctccagccgcgacaagtccggcagccggctgtccgtcttcgggggcgggaccaagctcaccgtgctgagccagcccaaggccgccccgtccgtgaccctgttcccgcccagctccgaggagctccaggccaacaaggcgaccctggtctgcctgatcagcgacttctaccccggcgccgtgacggtggcctggaaggccgacagctcccccgtcaaggccggcgtggagaccaccacccccagcaagcagtccaacaacaagtacgcggccagctcctacctcagcctgacgcccgagcagtggaagtcccaccgcagctactcctgccaggtgacccacgaggggagcaccgtcgagaagaccgtggcccccacggagtgctcc

SEQ ID NO: 8793 - RNA, 708 nt, synthetic construct
  misc_feature 1..708: note = derived and/or modified sequence opt1 from anti-HIV_10E8_HeavyChain
  source 1..708: mol_type = other RNA
gaggtgcagctggtcgagagcggcgggggcctcgtgaagcccgggggctccctgcgcctgagctgctccgccagcgggttcgacttcgacaacgcctggatgacctgggtgcggcagccgcccggcaagggcctcgagtgggtcgggcgcatcaccggccccggggagggctggtccgtggactacgcggcccccgtggaggggcggttcacgatcagccgcctgaactccatcaacttcctgtacctcgagatgaacaacctgcggatggaggacagcggcctgtacttctgcgcccgcaccggcaagtactacgacttctggtccgggtacccgcccggcgaggagtacttccaggactgggggcggggcaccctcgtcaccgtgagctccgccagcacgaagggcccctccgtgttccccctggccccgagctccaagagcacctccgggggcaccgcggccctggggtgcctcgtcaaggactacttccccgagcccgtgaccgtgagctggaactccggcgccctgacgagcggggtccacaccttccccgccgtgctgcagagctccggcctctacagcctgtccagcgtggtcaccgtgccgtccagctccctgggcacccagacgtacatctgcaacgtgaaccacaagcccagcaacaccaaggtcgacaagcgcgtggagcccaagtcctgcgacaag

SEQ ID NO: 8794 - RNA, 333 nt, synthetic construct
  misc_feature 1..333: note = derived and/or modified sequence opt1 from anti-HIV_12A12_LightChain
  source 1..333: mol_type = other RNA
gacatccagatgacccagagcccctccagcctgtccgccagcgtgggcgaccgcgtcaccatcacgtgccaggccgggcagggcatcgggtccagcctccagtggtaccagcagaagccgggcaaggcgcccaagctgctggtgcacggggcctccaacctccaccggggcgtgcccagccgcttctccggcagcgggttccacaccaccttctccctgaccatcagcggcctgcagcgggacgacttcgccacgtacttctgcgccgtcctcgagttcttcgggcccggcaccaaggtggagatcaagcgcaccgtggccgcgccgtccgtc

SEQ ID NO: 8795 - RNA, 381 nt, synthetic construct
  misc_feature 1..381: note = derived and/or modified sequence opt1 from anti-HIV_12A12_HeavyChain
  source 1..381: mol_type = other RNA
agccagcacctggtgcagtccggcacccaggtcaagaagcccggggccagcgtgcgcatctcctgccaggccagcggctactccttcaccgactacgtgctccactggtggcggcaggcgccggggcagggcctggagtggatggggtggatcaagcccgtctacggcgcccgcaactacgcccggcgcttccagggccggatcaacttcgaccgcgacatctaccgggagatcgccttcatggacctgagcgggctccgctccgacgacacggccctgtacttctgcgcgcgggacggcagcggggacgacacctcctggcacctggacccctggggccaggggaccctcgtgatcgtgagcgccgcctccaccaagggc

SEQ ID NO: 8796 - RNA, 315 nt, synthetic construct
  misc_feature 1..315: note = derived and/or modified sequence opt1 from anti-HIV_12A21_LightChain
  source 1..315: mol_type = other RNA
gacatccagatgacccagagcccctccagcctgtccgccagcgtgggcgaccgcgtcaccatcaactgccaggccgggcagggcatcgggtccagcctcaactggtaccagaagaagccgggccgggcgcccaagctgctggtgcacggggcctccaacctccagcgcggcgtgcccagccggttctccggcagcgggttccacacgaccttcaccctgaccatctccagcctgcagcccgacgacgtcgccacgtacttctgcgccgtgttccagtggttcggcccggggaccaaggtggacatcaagcgcacc

SEQ ID NO: 8797 - RNA, 384 nt, synthetic construct
  misc_feature 1..384: note = derived and/or modified sequence opt1 from anti-HIV_12A21_HeavyChain
  source 1..384: mol_type = other RNA
agccagcacctggtgcagtccggcacccaggtcaagaagcccggggccagcgtgcgcgtgtcctgccaggccagcggctacaccttcacgaactacatcctgcactggtggcggcaggcgccggggcagggcctggagtggatggggctgatcaagcccgtcttcggcgccgtgaactacgcccgccagttccagggccggatccagctcacccgcgacatctaccgggagatcgccttcctggacctgtccgggctccgcagcgacgacaccgccgtgtactactgcgcgcgggacgagtccggcgacgacctgaagtggcacctccacccctgggggcagggcacccaggtcatcgtgagccccgcctccacgaaggggccg

SEQ ID NO: 8798 - RNA, 648 nt, synthetic construct
  misc_feature 1..648: note = derived and/or modified sequence opt1 from anti-HIV_35022_LightChain
  source 1..648: mol_type = other RNA
cagagcgtgctgacccagtccgccagcgtctccggcagcctcgggcagtccgtgaccatcagctgcacgggccccaactccgtgtgctgcagccacaagtccatcagctggtaccagtggccgcccgggcgcgcccccaccctgatcatctacgaggacaacgagcgggcgcccggcatctccccgcgcttcagcgggtacaagtcctactggagcgcctacctgaccatctccgacctccggcccgaggacgagaccacgtactactgctgcagctacacccacaactccggctgcgtcttcggcaccgggaccaaggtgagcgtgctgggccagtccaaggccaaccccagcgtcacgctgttcccgcccagctccgaggagctccaggccaacaaggccaccctggtgtgcctgatcagcgacttctaccccggggcggtgaccgtcgcctggaaggccgactccagccccgtgaaggccggcgtggagaccacgaccccctccaagcagagcaacaacaagtacgcggcctccagctacctctccctgaccccggagcagtggaagtcccaccgcagctacagctgccaggtcacccacgaggggtccacggtggagaagaccgtggcccccaccgagtgcagc

SEQ ID NO: 8799 - RNA, 729 nt, synthetic construct
  misc_feature 1..729: note = derived and/or modified sequence opt1 from anti-HIV_35022_HeavyChain
  source 1..729: mol_type = other RNA
gagggccagctggtgcagagcggggccgagctcaagaagcccggcgcctccgtgaagatcagctgcaagacctccgggtaccgcttcaacttctaccacatcaactggatccggcagaccgcgggccgcgggccggagtggatgggctggatcagcccctactccggcgacaagaacctggcccccgccttccaggaccgggtgatcatgacgaccgacaccgaggtgcccgtcaccagcttcacgtccaccggggccgcctacatggagatccgcaacctgaagttcgacgacaccggcacctacttctgcgcgaaggggctcctgcgggacggcagctccacgtggctgccgtacctctgggggcagggcaccctgctgaccgtgagctccgccagcaccaagggcccctccgtgttccccctcgcccccagctccaagagcacgtccgggggcaccgccgcgctggggtgcctggtcaaggactacttcccggagcccgtgaccgtgagctggaactccggcgccctcaccagcggcgtccacacgttccccgccgtgctgcagagctccgggctgtacagcctctccagcgtggtcaccgtgccctccagctccctgggcacccagacctacatctgcaacgtgaaccacaagccgagcaacacgaaggtcgacaagcgcgtggagcccaagtcctgcgacaaggggctggaggtcctcttccag

SEQ ID NO: 8800 - RNA, 648 nt, synthetic construct
  misc_feature 1..648: note = derived and/or modified sequence opt1 from anti-HIV_3BC176_LightChain
  source 1..648: mol_type = other RNA
cagagcgtgctgacccagcccgcctccgtcagcgcctccccgggccagagcatcaccgtgtcctgcacggggagccgcaacgacgtgggcgggtacgacttcgtctcctggtaccagcggcaccccggcggggtgcccaagctcatcatctacgagatcagcaagcgcccctccggcatcccgcagcggttcagcggctcccgcagcgggaacaccgcgtccctgaccatcagcggcctgcaggacgacgacgaggccgactactactgctgctcctacgccagctacgaccggctcatcttcgggggcgggacccgcgtgtccgtcctgcggcagcccaaggccgcccccagcgtgacgctgttcccgccctccagcgaggagctccaggcgaacaaggccaccctggtgtgcctgatcagcgacttctaccccggcgccgtcaccgtggcctggaaggcggacggctcccccgtgaaggccggggtcgagaccacgaagcccagcaagcagtccaacaacaagtacgccgccagctcctacctcagcctgaccccggagcagtggaagtcccaccgcagctactcctgccaggtgacccacgagggcagcaccgtggagaagacggtcgcccccaccgagtgctcc

SEQ ID NO: 8801 - RNA, 699 nt, synthetic construct
  misc_feature 1..699: note = derived and/or modified sequence opt1 from anti-HIV_3BC176_HeavyChain
  source 1..699: mol_type = other RNA
gagcaggtccagctgatgcagagcggcgcccagctccgcgaccccggggactccctgaagatcagctgcaaggcctccggctacaacttcatcgactaccacatccactgggtgcggctggcgccggggcgcggcctcgagtggatggggtggatcgaccccgtgggcggcatcaccaagtacgccgggcagttccagggccggctgagcctgacccgcgacacgtccaccaacaccctcttcctggagctgagccggctcaccgccggggacacggccgtgtacttctgcgcccgctccatgcggcccgtcgaccacggcatcgactacagcgggctgttcgtgttccacttctggggccgcggctccgacgtgctggtcagctccgcgagcaccaaggggccctccgtgttcccgctcgcccccagctccaagagcacctccggcgggaccgccgccctgggctgcctggtgaaggactacttccccgagcccgtcacggtgagctggaactccggcgcgctcaccagcggggtgcacaccttcccggccgtcctgcagagctccggcctgtacagcctctccagcgtggtgaccgtcccctccagctccctggggacgcagacctacatctgcaacgtgaaccacaagcccagcaacaccaaggtggacaagaaggtcgagcccaagtcctgcgac

SEQ ID NO: 8802 - RNA, 621 nt, synthetic construct
  misc_feature 1..621: note = derived and/or modified sequence opt1 from anti-HIV_3BNC55_LightChain
  source 1..621: mol_type = other RNA
gacatccagatgacccagagcccctccagcctgtccgccagcgtgggcgacaaggtcaccatcacgtgccagacctccgccgggtacctcaactggtaccagcagcgccggggccgcgcgccgaagctgctgatgtacgacgggagccggctcgtgaccggcgtgccctcccgcttcagcgggcggcgctggggcacccagtacaacctgacgatcggctccctgcagcccgaggacatcgccacctactactgccaggtctacgagttcttcgggcccggcacccggctcgacctgaagcgcaccgtggccgccccgagcgtgttcatcttcccgccctccgacgagcagctcaagagcgggacggcctccgtcgtgtgcctgctgaacaacttctacccccgggaggcgaaggtgcagtggaaggtcgacaacgccctgcagagcggcaactcccaggagagcgtgaccgagcaggactccaaggacagcacctactccctcagcagcaccctgacgctgtccaaggccgactacgagaagcacaaggtgtacgcctgcgaggtcacccaccaggggctcagctcccccgtgaccaagagcttcaaccgcggcgagtgc

SEQ ID NO: 8803 - RNA, 675 nt, synthetic construct
  misc_feature 1..675: note = derived and/or modified sequence opt1 from anti-HIV_3BNC55_HeavyChain
  source 1..675: mol_type = other RNA
caggtgcagctggtccagagcggcaccgccgtgaagcgccccggggcctccgtgcgggtcagctgccaggcgtccggctacaccttcacggactacttcatctactggtggcgccaggccccggggcagggcctcgagtggctggggtggatcaaccccctgaccagccagccctcctaccccagccggttccagggccgcctcaccctgacccgggacacgttcgacgagatgctgtacatggacctccgcggcctgcggtccgacgacaccgggatctacttctgcgcccgccggcacagcgactactgcgacttcgacatctggggctccgggacccagatcatcgtgagctccgccagcaccaagggcccgtccgtgttccccctggcccccagctccaagagcacgtccgggggcaccgcggccctcggctgcctggtcaaggactacttccccgagccggtgaccgtgagctggaactccggggccctgaccagcggcgtccacacgttccccgccgtgctccagagctccgggctgtacagcctgtccagcgtggtcaccgtgccctccagctccctcggcacccagacctacatctgcaacgtgaaccacaagcccagcaacacgaaggtcgacaagcgcgtggagccgaagtcctgcgacaagacc

SEQ ID NO: 8804 - RNA, 618 nt, synthetic construct
  misc_feature 1..618: note = derived and/or modified sequence opt1 from anti-HIV_3BNC60_LightChain
  source 1..618: mol_type = other RNA
gacatccagatgacccagagcccctccagcctgtccgcccgcgtgggcgacaccgtcacgatcacgtgccaggccaacgggtacctcaactggtaccagcagcggcgcggcaaggcgccgaagctgctgatctacgacgggagcaagctcgagcggggcgtgcccgcccgcttctccgggcggcgctggggccaggagtacaacctgaccatcaacaacctgcagcccgaggacgtggccacctacttctgccaggtctacgagttcatcgtgcccggcacgcggctcgacctgaagcgcaccgtggccgccccgagcgtcttcatcttcccgccctccgacgagcagctcaagagcgggaccgcgtccgtggtgtgcctgctgaacaacttctacccccgggaggccaaggtccagtggaaggtggacaacgccctgcagagcggcaactcccaggagagcgtgaccgagcaggactccaaggacagcacgtactccctcagctccaccctgaccctgagcaaggccgactacgagaagcacaaggtctacgcgtgcgaggtgacccaccaggggctctccagccccgtgaccaagagcttcaaccgcggcgagtgc

SEQ ID NO: 8805 - RNA, 687 nt, synthetic construct
  misc_feature 1..687: note = derived and/or modified sequence opt1 from anti-HIV_3BNC60_HeavyChain
  source 1..687: mol_type = other RNA
caggtgcacctgagccagtccggcgccgccgtcaccaagcccggggcgagcgtgcgcgtgtcctgcgaggccagcggctacaagatctccgaccacttcatccactggtggcggcaggccccggggcagggcctccagtgggtcgggtggatcaaccccaagaccggccagcccaacaacccccgccagttccagggccgggtgagcctgacgcgccaggcctcctgggacttcgacacctacagcttctacatggacctgaaggccgtgcggtccgacgacaccgcgatctacttctgcgcccgccagcggagcgacttctgggacttcgacgtctgggggtccggcacccaggtgacggtgagctccgccagcaccaaggggccgtccgtcttccccctcgcccccagctccaagagcacctccggcgggaccgcggccctgggctgcctggtgaaggactacttccccgagccggtgacggtcagctggaacagcggcgccctcacctccggggtgcacaccttccccgccgtgctgcagagctccggcctgtacagcctctccagcgtcgtgaccgtgccctccagctccctggggacgcagacctacatctgcaacgtcaaccacaagcccagcaacaccaaggtggacaagcgcgtggagccgaagtcctgcgacaagacc

SEQ ID NO: 8806 - RNA, 687 nt, synthetic construct
  misc_feature 1..687: note = derived and/or modified sequence opt1 from anti-HIV_3BNC60_HeavyChain
  source 1..687: mol_type = other RNA
gaggtgcacctgagccagtccggcgccgccgtcaccaagcccggggcgagcgtgcgcgtgtcctgcgaggccagcggctacaagatctccgaccacttcatccactggtggcggcaggccccggggcagggcctccagtgggtcgggtggatcaaccccaagaccggccagcccaacaacgcccgccagttccagggccgggtgagcctgacgcgccaggcctcctgggacttcgacacctacagcttctacatggacctgaaggcggtgcggtccgacgacaccgccatctacttctgcgcccgccagcggagcgacttctgggacttcgacgtctgggggtccggcacccaggtgacggtgagctccgccagcaccaaggggccctccgtcttcccgctcgcgcccagctccaagagcacctccggcgggaccgccgccctgggctgcctggtgaaggactacttccccgagcccgtgacggtcagctggaacagcggcgccctcacctccggggtgcacaccttcccggccgtgctgcagagctccggcctgtacagcctctccagcgtcgtgaccgtgccctccagctccctggggacgcagacctacatctgcaacgtcaaccacaagcccagcaacaccaaggtggacaagcgcgtggagcccaagtcctgcgacaagacc

SEQ ID NO: 8807 - RNA, 648 nt, synthetic construct
  misc_feature 1..648: note = derived and/or modified sequence opt1 from anti-HIV_447-52D_LightChain
  source 1..648: mol_type = other RNA
cagagcgtgctgacccagcccccgtccgtcagcgccgcccccggccagaaggtgaccatctcctgcagcgggtccagctccaacatcggcaacaactacgtgctctggtaccagcagttccccgggacggcgcccaagctgctgatctacggcaacaacaagcgcccgagcgggatccccgaccggttctccggcagcaagtccggcaccagcgccaccctcgggatcaccggcctgcagacgggggacgaggccgactacttctgcgccacctgggactccggcctgagcgccgactgggtcttcgggggcggcaccaagctcaccgtgctgtcccagcccaaggcggcccccagcgtgacgctgttcccgccctccagcgaggagctccaggccaacaaggccaccctggtctgcctgatctccgacttctaccccggggcggtgaccgtggcctggaaggccgacagcagccccgtcaaggccggcgtggagaccacgaccccgtccaagcagagcaacaacaagtacgccgcgtccagctacctctccctgacccccgagcagtggaagtcccaccgcagctacagctgccaggtgacccacgaggggtccacggtcgagaagaccgtggcccccaccgagtgc

SEQ ID NO: 8808 - RNA, 693 nt, synthetic construct
  misc_feature 1..693: note = derived and/or modified sequence opt1 from anti-HIV_447-52D_HeavyChain
  source 1..693: mol_type = other RNA
gaggtgcagctggtcgagagcggcgggggcctcgtgaagcccgggggctccctgcgcctgacctgcgtggccagcgggttcaccttctccgacgtctggctcaactgggtgcggcaggccccgggcaagggcctggagtgggtggggcgcatcaagagccggaccgacggcgggaccaccgactacgcggcctccgtcaagggccgcttcaccatcagccgggacgactccaagaacacgctgtacctccagatgaacagcctgaagaccgaggacaccgccgtgtactcctgcaccacggacgggttcatcatgatccgcggcgtgagcgaggactactactactactacatggacgtctggggcaaggggaccaccgtgaccgtgtccagcgcctccacgaagggccccagcgtcttccccctggccccctgctcccggagcacctccgggggcaccgcggccctcggctgcctggtgaaggactacttcccggagcccgtgaccgtcagctggaactccggggccctgacgagcggcgtgcacaccttccccgccgtgctccagagctccgggctgtacagcctgtccagcgtcgtgaccgtgccctccagctccctcggcacccagacgtacacgtgcaacgtcaaccacaagccgagcaacaccaaggtggacaagcgcgtggagctg

SEQ ID NO: 8809 - RNA, 645 nt, synthetic construct
  misc_feature 1..645: note = derived and/or modified sequence opt1 from anti-HIV_447-52D_LightChain
  source 1..645: mol_type = other RNA
cagagcgtgctgacccagcccccgtccgtcagcgccgcccccggccagaaggtgaccatctcctgcagcgggtccagctccaacatcggcaacaactacgtgctctggtaccagcagttccccgggacggcgcccaagctgctgatctacggcaacaacaagcgcccgagcgggatccccgaccggttctccggcagcaagtccggcaccagcgccaccctcgggatcaccggcctgcagacgggggacgaggccgactacttctgcgccacctgggactccggcctgagcgccgactgggtcttcgggggcggcaccaagctcaccgtgctgtcccagcccaaggcggcccccagcgtgacgctgttcccgccctccagcgaggagctccaggccaacaaggccaccctggtctgcctgatctccgacttctaccccggggcggtgaccgtggcctggaaggccgacagcagccccgtcaaggccggcgtggagaccacgaccccgtccaagcagagcaacaacaagtacgccgcgtccagctacctctccctgacccccgagcagtggaagtcccaccgcagctacagctgccaggtgacccacgaggggtccacggtcgagaagaccgtggcccccaccgag

SEQ ID NO: 8810 - RNA, 705 nt, synthetic construct
  misc_feature 1..705: note = derived and/or modified sequence opt1 from anti-HIV_447-52D_HeavyChain
  source 1..705: mol_type = other RNA
gaggtgcagctggtcgagagcggcgggggcctcgtgaagcccgggggctccctgcgcctgacctgcgtggccagcgggttcaccttctccgacgtctggctcaactgggtgcggcaggccccgggcaagggcctggagtgggtggggcgcatcaagagccggacggacggcgggaccaccgactacgcggcctccgtcaagggccgcttcaccatcagccgggacgactccaagaacacgctgtacctccagatgaacagcctgaagaccgaggacaccgccgtgtactcctgcaccacggacgggttcatcatgatccgcggcgtgagcgaggactactactactactacatggacgtctggggcaaggggaccaccgtgaccgtgtccagcgcctccacgaagggccccagcgtcttccccctggccccctgctcccggagcacctccgggggcaccgcggccctcggctgcctggtgaaggactacttcccggagcccgtgaccgtcagctggaactccggggccctgacgagcggcgtgcacaccttccccgccgtgctccagagctccgggctgtacagcctgtccagcgtcgtgaccgtgccctccagctccctcggcacccagacgtacacgtgcaacgtcaaccacaagccgagcaacaccaaggtggacaagcgcgtggagctgaagacccccacc

SEQ ID NO: 8811 - RNA, 624 nt, synthetic construct
  misc_feature 1..624: note = derived and/or modified sequence opt1 from anti-HIV_5H/I1-BMV-D5_LightChain
  source 1..624: mol_type = other RNA
gacatccagatgacccagagcccctccaccctgagcgcctccatcggcgaccgcgtgacgatcacgtgccgggccagcgaggggatctaccactggctcgcgtggtaccagcagaagccgggcaaggcccccaagctgctgatctacaaggcctccagcctcgcctccggggcccccagccgcttctccggcagcgggtccggcaccgacttcaccctgaccatcagctccctgcagcccgacgacttcgcgacctactactgccagcagtacagcaactacccgctcaccttcggcgggggcaccaagctggagatcaagcggacggtcgccgccccctccgtgttcatcttcccgcccagcgacgagcagctgaagtccgggaccgccagcgtggtctgcctcctgaacaacttctacccccgcgaggcgaaggtgcagtggaaggtggacaacgccctgcagtccggcaacagccaggagagcgtcaccgagcaggactccaaggacagcacctactccctcagctccacgctgaccctgagcaaggccgactacgagaagcacaaggtgtacgcctgcgaggtgacccaccaggggctctccagccccgtcaccaagtcc

SEQ ID NO: 8812 - RNA, 651 nt, synthetic construct
  misc_feature 1..651: note = derived and/or modified sequence opt1 from anti-HIV_5H/I1-BMV-D5_HeavyChain
  source 1..651: mol_type = other RNA
caggtgcagctggtccagagcggcgccgaggtgcgcaagcccggggcctccgtgaaggtcagctgcaaggcgtccggcgacaccttcagctcctacgccatcagctgggtgcggcaggccccggggcagggcctcgagtggatgggcgggatcatccccatcttcggcaccgccaactacgcccaggcgttccaggggcgcgtgacgatcaccgccaacgagtccaccagcaccgcctacatggagctgtccagcctgcggtccgaggacacggccatctactactgcgcgcgcgacaaccccaccctcctgggcagcgactactggggcgccgggaccctggtcaccgtgtccagcgcctccacgaaggggcccagcgtgttcccgctcgccccctgctcccggagcacctccggcggcaccgccgcgctggggtgcctggtcaaggactacttccccgagcccgtgaccgtgagctggaacagcggcgccctcacgtccggggtccacaccttcccggccgtgctgcagagctccggcctgtacagcctctccagcgtggtcaccgtgccctccagctccctgggcacccagacgtacatctgcaacgtgaaccacaagcccagcaacaccaaggtcgacaagcgcgtg

SEQ ID NO: 8813 - RNA, 657 nt, synthetic construct
  misc_feature 1..657: note = derived and/or modified sequence opt1 from anti-HIV_5H/I1-BMV-D5_A-Chain
  source 1..657: mol_type = other RNA
atgcagctgctcagcggcatcgtgcagcagcagaacaacctgctgcgcgcgatcgaggcccagcagcacctcctgcagctgaccgtctgggggatcaagcagctccaggcgcggatcctggccggcgggtccggcgggcacaccacgtggatggagtgggaccgcgagatcaacaactacaccagcctgatccactccctcatcgaggagagccagaaccagcaggagaagaacgagcaggagctgctggagggctccagcggcgggcagctcctgtccggcatcgtgcagcagcagaacaacctgctccgggccatcgaggcccagcagcacctcctgcagctgaccgtgtgggggatcaagcagctgcaggcccgcatcctggcgggcgggagcggcggccacaccacgtggatggagtgggaccgggagatcaacaactacacctccctcatccacagcctgatcgaggagtcccagaaccagcaggagaagaacgagcaggagctgctcgaggggagctccggcgggcagctgctgagcggcatcgtccagcagcagaacaacctcctgcgcgccatcgaggcccagcagcacctcctgcagctgaccgtgtggggcatcaagcagctgcaggcccggatcctcgccgggggc

SEQ ID NO: 8814 - RNA, 390 nt, synthetic construct
  misc_feature 1..390: note = derived and/or modified sequence opt1 from anti-HIV_8ANC195_LightChain
  source 1..390: mol_type = other RNA
gacatccagatgacccagagcccctccaccctgagcgcctccatcggcgacacggtgcgcatcagctgccgggcctcccagagcatcaccgggaactgggtcgcgtggtaccagcagcgccccggcaaggcgccccggctcctgatctaccgcggggccgccctgctcggcggggtgccctcccggttcagcggctccgccgccggcaccgacttcaccctgacgatcgggaacctgcaggccgaggacttcggcaccttctactgccagcagtacgacacctaccccgggaccttcggccaggggacgaaggtggaggtcaagcgcaccgtggccgccccgagcgtgttcatcttcccgccctccgacgagcagctcaagagcggcacc

SEQ ID NO: 8815 - RNA, 423 nt, synthetic construct
  misc_feature 1..423: note = derived and/or modified sequence opt1 from anti-HIV_8ANC195_HeavyChain
  source 1..423: mol_type = other RNA
cagatccacctggtgcagagcggcaccgaggtcaagaagcccgggtccagcgtgaccgtgtcctgcaaggcctacggcgtcaacacgttcgggctctacgccgtgaactgggtgcgccaggcgcccggccagagcctggagtacatcgggcagatctggcggtggaagtccagcgcctcccaccacttccgcggccgggtcctgatcagcgccgtggacctcaccggctccagcccgcccatctccagcctggagatcaagaacctgacctccgacgacaccgccgtgtacttctgcacgaccaccagcacctacgacaagtggtccgggctccaccacgacggcgtcatggccttcagctcctgggggcagggcacgctgatcagcgtgtccgcggccagcaccaaggggcccagcgtgttc

SEQ ID NO: 8816 - RNA, 333 nt, synthetic construct
  misc_feature 1..333: note = derived and/or modified sequence opt1 from anti-HIV_CAP256-VRC26.01_LightChain
  source 1..333: mol_type = other RNA
cagagcgtgctgacccagcccccgtccgtcagcgccgcccccggccagaaggtgaccatctcctgcagcgggtccagctccacgatcggcaacaactacgtgagctggtaccgcctcctgcccgggaccgcgcccaagctgctcatctacaagaacgacaaccggccgtccggcatccccgaccgcttcagcgggtccaagagcggcacctccgccaccctgggcatcagcgggctgcagacgggcgacgaggccgactactactgcgggacctgggacacctccctcagcggcgggggcgtcttcggcaccgggacgaaggtgaccgtgctg

SEQ ID NO: 8817 - RNA, 432 nt, synthetic construct
  misc_feature 1..432: note = derived and/or modified sequence opt1 from anti-HIV_CAP256-VRC26.01_HeavyChain
  source 1..432: mol_type = other RNA
gaggtgcaggtcgtggagagcggcgggggcgtggtccagcccgggcgctccctgcggctcagctgcaccgcctccggcttcaccttcagcaacttcgccatggggtgggtgcgccaggcgccgggcaagggcctggagtgggtggccttcatctccagcgacgggtccaacaagaactacggcgacagcgtcaaggggcggttcacgatctcccgcgacaacagcaagaacaccgtgttcctgcagatgaactccctccgggtggaggacaccgccctgtactactgcgccaaggacgtcggcgactacaagagcgacgagtgggggaccgagtactacgacatctccatcagctaccccatccaggacccccgcgccatggtgggcgcgttcgacctgtggggccaggggacgatggtgaccgtctccccc

SEQ ID NO: 8818 - RNA, 324 nt, synthetic construct
  misc_feature 1..324: note = derived and/or modified sequence opt1 from anti-HIV_CAP256-VRC26.02_LightChain
  source 1..324: mol_type = other RNA
cagagcgtgctgacccagcccccgtccgtcagcgccgcccccggccagaaggtgaccatctcctgcagcgggtccaacagcaacatcggcaacaaggacgtgtcctggtaccagcagatccccgcgacggcccccaagctcctgatctacgagaacaacaagcgcccgagcgggatctccgaccggttcagcggctccaagagcgggacctccgccaccctggccatcaccggcctccagacgggcgacgaggccgactactactgcgcgacctgggacgggcgcgtcagcgtgatcggcaccgggaccaacgtgatcgtcctg

SEQ ID NO: 8819 - RNA, 432 nt, synthetic construct
  misc_feature 1..432: note = derived and/or modified sequence opt1 from anti-HIV_CAP256-VRC26.02_HeavyChain
  source 1..432: mol_type = other RNA
gaggtgcagctggtcgagagcggcgggggcgtggtgcagcccgggcgctccctccggctgagctgcgccgcctcccagttcagcttcggcaactacgggatgcactgggtccgccaggcgccgggcaagggcctggagtgggtggccgccatctccttcgccgggaccaagaccaactacgccgacagcgtgaagggccggttcacgatctcccgcgacaacagcaagaacaccgtctacctccagatgaactccctgcgggcggaggacaccgccctgtacttctgcgccaaggacatccgcgagtacgagtgcgagtactggaccagcgactactacgacttcgggcggccccagccctgcatcgactcccgcggcgtggtggggacgttcgacgtctggggccagggcaccatggtgaccgtgagctcc

SEQ ID NO: 8820 - RNA, 333 nt, synthetic construct
  misc_feature 1..333: note = derived and/or modified sequence opt1 from anti-HIV_CAP256-VRC26.03_LightChain
  source 1..333: mol_type = other RNA
cagagcgtgctgacccagcccccgtccgtcagcgccgcccccggccagaaggtgaccatctcctgcagcgggtccagctccaacatcggcaacaacttcgtgagctggtaccagcagcgccccgggacggcgcccaagatcctcatctacgagaacaacaagcggccgtccgagacccccgaccgcttcagcggctccaagagcgggacctccgccaccctggccatcacgggcctgcagaccgccgacgaggccgagtactactgcgcgacctggagcgcctccctcagctccgcccgggtcttcggcaccgggacgcgcatcaccgtgctg

SEQ ID NO: 8821 - RNA, 432 nt, synthetic construct
  misc_feature 1..432: note = derived and/or modified sequence opt1 from anti-HIV_CAP256-VRC26.03_HeavyChain
  source 1..432: mol_type = other RNA
gaggtgcagctggtcgagagcggcgggggcgtggtgcagcccgggaagtccctccggctgagctgcgccgcctcccggttcagcttcaaccgctacggcatgcactgggtccggcaggcgccggggaagggcctggagtgggtggccgccatctcctacgacggcaccgacaagtaccacgccgacaaggtgtgggggcgcttcaccatcagccgggacaactccaagaacacgctctacctgcagatgaacagcctgcgcgccgaggacaccgcgctctactactgcgccaaggacctgcgggaggacgagtgcgaggagtggtggtccgactactacgacttcggcaagcagctgccctgccgcaagagccgcggggtcgccggcatcttcgacgggtggggccagggcaccatggtgaccgtgtccagc

SEQ ID NO: 8822 - RNA, 333 nt, synthetic construct
  misc_feature 1..333: note = derived and/or modified sequence opt1 from anti-HIV_CAP256-VRC26.04_LightChain
  source 1..333: mol_type = other RNA
cagcccgtgctgacccagccgcccagcgtctccgccgcccccggccagaaggtgaccatcagctgctccgggagctccagcaacatcggcaacaacttcgtgtcctggtaccagcagcgccccgggacggcgccgagcctcctgatctacgagaccaacaagcggccctccggcatccccgaccgcttcagcgggtccaagagcgccacctccgccaccctggccatcacgggcctccagaccggcgacgaggccgactactactgcgcgacctgggccgccagcctgacctccgcccgggtcttcgggacgggcaccaaggtgatcgtgagc

SEQ ID NO: 8823 - RNA, 432 nt, synthetic construct
  misc_feature 1..432: note = derived and/or modified sequence opt1 from anti-HIV_CAP256-VRC26.04_HeavyChain
  source 1..432: mol_type = other RNA
gaggtgcagctggtcgagagcggcgggggcgtggtgcagcccgggaagtccctccgcctgagctgcgccgcctcccagttcagcttcaaccggtacggcatgcactgggtccgccaggcgccggggaagggcctggagtgggtggccgccatctcctacgacggcaccgacaagtaccacgccgacaaggtgtgggggcggttcaccatcagccgcgacaactccaagaacacgctctacctgcagatgaacagcctgcgggccgaggacaccgcgctctactactgcgccaaggacctgcgcgaggacgagtgcgaggagtggtggtccgactactacgacttcggcaagcagctgccctgccggaagtcccgcggggtcgccggcatcttcgacaagtgggggcagggcaccatggtgatcgtgagcagc

SEQ ID NO: 8824 - RNA, 324 nt, synthetic construct
  misc_feature 1..324: note = derived and/or modified sequence opt1 from anti-HIV_CAP256-VRC26.05_LightChain
  source 1..324: mol_type = other RNA
cagagcgccctgacccagcccccgtccgtgagcgccgcgcccggccagaaggtcaccatctcctgcagcgggaacatcggcaacaactacgtgtcctggtaccagcaggtccccgggacggcccccaagctcctgatctacgagaacaacaagcgcccgagcggcatccccgaccggttctccgggagcaagtccggcaccagcgccaccctggtgatcaccggcctccagacgggggacgaggccgacttctactgcggcacctggggcgggtccctgcgcaccgggggcgtgctgggcaccgggacgcgggtgaccgtcctc

SEQ ID NO: 8825 - RNA, 432 nt, synthetic construct
  misc_feature 1..432: note = derived and/or modified sequence opt1 from anti-HIV_CAP256-VRC26.05_HeavyChain
  source 1..432: mol_type = other RNA
gaggtgcagctggtcgagagcggcgggggcgtggtgcagcccgggcgctccctccggctgagctgcgccgcctcccacttcagcctgtccagctacggcatgcactgggtccgccaggcgccggggaagggcctcgagtgggtgaccggcatctccttcgccgggaccaagacgtactacggcgacagcgtgcgggggcgcttcaccgtctcccgggacatcagcaagaacaccctgttcctgcagatgaactccctccgccccgacgacaccgccatgtactactgcgcccgggaccagcgctactacgagtgcgaggagtgggccagcgactactacgacttcggccgggagcagccctgcctggacccccgcggggtggtgggcatcttcgacctgtggggccaggggacgatggtcaccgtgtccagc

SEQ ID NO: 8826 - RNA, 324 nt, synthetic construct
  misc_feature 1..324: note = derived and/or modified sequence opt1 from anti-HIV_CAP256-VRC26.06_LightChain
  source 1..324: mol_type = other RNA
cagagcgtgctgacccagcccccgtccgtcagcgccgcccccggccagaaggtgaccatctcctgcagcgggtccacgagcaagatcggccagaactccgtgagctggtaccagcagctccccgggaccgcgcccaagctgctgatctacgagaacgaccgccggccgtccggcacccccgaccgcttcagcgggtccaagagcggcacctccgccacgctcgccatcaccggcctgcagaccggggacgaggccgagtactactgcgagacctgggacggcagcgggggcgtcttcgggacgggcaccaaggtgaccgtgctg

SEQ ID NO: 8827 - RNA, 435 nt, synthetic construct
  misc_feature 1..435: note = derived and/or modified sequence opt1 from anti-HIV_CAP256-VRC26.06_HeavyChain
  source 1..435: mol_type = other RNA
gaggtgcagctgatcgagagcggcgggggcgtcgtgcagcccgggcggtccctccggctgagctgcggcgcctccgggttcagcttcaacaactacggcatgcactgggtgcgccaggccccgggcaaggggctggagtgggtcgcgggcatctccttcgccgggatcaagaagtactacggcaccagcgtgaaggggcggttcaccatctcccgcgacaacagcaagaacaacttctacctccagatgaactccctgcgggtggaggacacggccctgtactactgcgcccgcgacctccgggagctggagtgcgaggagtggaccctgtacaactactacgacttcggcagccgcggcccctgcgtcgacccccgcggggtggccggctccttcgacgtgtgggggcagggcaccatggtcaccgtgagctcc

SEQ ID NO: 8828 - RNA, 333 nt, synthetic construct
  misc_feature 1..333: note = derived and/or modified sequence opt1 from anti-HIV_CAP256-VRC26.07_LightChain
  source 1..333: mol_type = other RNA
caggccgtgctgacccagcccccgagcgtctccgccgcgcccggccagaacgtgaccatcagctgctccgggagcggctccaacatcgggaacaacttcgtgagctggtaccagcagcgccccggcacggcccccaagctcctgatctacgagtccaacaagcggccgagcgggatccccgaccgcttctccggcagcaagtccggcaccagcgccaccctggccatcaccgggctccagacgggcgacgaggcctactactactgcgcgacctgggccgcccggctgaactccgcccgcgtcttcgggaccggcaccatggtgacggtgctg

SEQ ID NO: 8829 - RNA, 432 nt, synthetic construct
  misc_feature 1..432: note = derived and/or modified sequence opt1 from anti-HIV_CAP256-VRC26.07_HeavyChain
  source 1..432: mol_type = other RNA
gaggtgcagctggtcgagagcggcgggggcgtggtgcagcccgggcgctccctccggctgagctgcgtcggctcccagttcagcttcaaccgctacgggatgcactgggtgcggcaggccccgggcaagggcctggagtgggtggccgggatctccttcgacggcaccgaccgctaccacgcggacaacgtctgggggcggttcaccatcagccgcgacaactccaagaacacgctctacctgcagatgagctccctgcgggccgaggacaccgccctctactactgcgccaaggacctgcgcgaggacgagtgcgaggagtggtggagcgactactacgacttcggcaagaagctgccctgccggaagtcccgcggggtggccggcgtgttcgacaagtggggccaggggaccatggtcaccgtgagctcc

SEQ ID NO: 8830 - RNA, 333 nt, synthetic construct
  misc_feature 1..333: note = derived and/or modified sequence opt1 from anti-HIV_CAP256-VRC26.08_LightChain
  source 1..333: mol_type = other RNA
cagagcgccctgacccagcccccgtccgtgagcgccgcgcccggccagaaggtcaccatctcctgcagcgggaactccagcaacatcggcaacaacttcgtgtcctggtaccagcaggtccccgggacggcccccaagctcctgctgtacgagacctaccgccggccgagcggcatccccgaccgcttctccgggagcaagtccggcaccagcgccaccctcgccatcacgggcctgcagaccggggacgaggccgactactactgcaccgtgtggggcgtgcggaagggggtgggcgcggtcttcgggaccggcacgaaggtgaccgtgctg

SEQ ID NO: 8831 - RNA, 438 nt, synthetic construct
  misc_feature 1..438: note = derived and/or modified sequence opt1 from anti-HIV_CAP256-VRC26.08_HeavyChain
  source 1..438: mol_type = other RNA
gaggtgcagctggtcgagagcggcgggggcgtggtgcagcccgggcgctccctcaccctgagctgcgccgcctcccagttcaccttcagcaactacggcatgcactgggtccggcaggcgccggggaagggcctggagtgggtggcctccgtgagcaacgacggcacgaagaagtaccacggggactccgtctggggccgcttcaccatcagccgggacaactccaagaacaccctcttcctgcagatgagctccctgcgcgccgaggacaccgccgtgtacttctgcgtgcgggaccagcgcgaggacgagtgcgaggagtggtggagcgactactacgacttcgggcgggagctcccctgccgcaagttccggggcctggggctggccggcatcttcgacatctggggccacgggacgatggtcaccgtgtccagc

SEQ ID NO: 8832 - RNA, 333 nt, synthetic construct
  misc_feature 1..333: note = derived and/or modified sequence opt1 from anti-HIV_CAP256-VRC26.09_LightChain
  source 1..333: mol_type = other RNA
cagagcgccctgacccagcccccgtccgtgagcgccgcgcccggccagaaggtcaccatctcctgcagcgggaactccagcaacatcggcaacaacttcgtgtcctggtaccagcagctccccgggacggcccccaagctgctgatctacgagaacaaccgccggccgagcggcatccccgaccgcttctccgggagcaagtccggcaccagcgccaccctcgccatctccggcctgcagaccggggacgaggccgactactggtgcgcggtgtggggcgtccggcgcggggccggcgccgtgttcggggccggcacgaaggtgaccgtcctg

SEQ ID NO: 8833 - RNA, 438 nt, synthetic construct
  misc_feature 1..438: note = derived and/or modified sequence opt1 from anti-HIV_CAP256-VRC26.09_HeavyChain
  source 1..438: mol_type = other RNA
gaggtgcagctggtcgagagcggcgggggcgtggtgcagcccgggcgctccctcaccctgagctgcgccgcctcccagttcaacttcgcgaactacggcatgcactgggtccggcaggccccggggaagggcctggagtgggtggccagcatctccaacgacggcaccaagaagtaccacgaggagagcgtgtgggggcgcttcacgatctccaaggacaacagcaagtccaccctcttcctgcagatgaacagcctgcggatcgaggacaccgccctctacttctgcgtcaaggaccagcgcgaggacgagtgcgaggagtggtggtccgactactacgacttcggccgggagctgccctgccgcaagagccgggggctgggcctcgccgggatcttcgacatgtggggccacggcaccatggtgacggtgtccagc

SEQ ID NO: 8834 - RNA, 333 nt, synthetic construct
  misc_feature 1..333: note = derived and/or modified sequence opt1 from anti-HIV_CAP256-VRC26.10_LightChain
  source 1..333: mol_type = other RNA
cagagcgtgctgacccagcccccgtccgtcagcgccgcccccggccagaaggtgaccatctcctgcagcgggtccagctccaacatcggcgacaactacgtgagctggtaccagcacctccccgggacggcgcccaagctgctgatctacgagaacacccgccggccgtccggcatccccgaccgcttcagcgggtccaagagcggcacctccgccaccctcgccatcacgggcctgcagaccggggacgaggccgactactactgcggcacctgggacgtccggcccaaccgcggggccgtgttcggcaccgggacgaaggtgaccgtcctg

SEQ ID NO: 8835 - RNA, 432 nt, synthetic construct
  misc_feature 1..432: note = derived and/or modified sequence opt1 from anti-HIV_CAP256-VRC26.10_HeavyChain
  source 1..432: mol_type = other RNA
caggccatcctggtggagagcggcgggggcgtcgtgcagcccgggcgctccctccggctgagctgcgccgcgtcccagttcaccttcagcggccacgggctgcactgggtgcgccaggccccgggcaagggcctcgagtgggtcgcctccatcagcttcgccgggaccaagatggactacgccgactccgtgaagggccggttcgcgatcagccgcgacaactccaagaacacgctgtacctgcagatgaacagcctccgggtggaggacaccgccctgtactactgcgccaaggacatgcgcgagtacgagtgcgagtactggacctccgactactacgacttcgggcggccccagccctgcatcgaccgccggggcgtcgtggggatcttcgacatgtggggccagggcaccatggtgacggtcagcacc

SEQ ID NO: 8836 - RNA, 321 nt, synthetic construct
  misc_feature 1..321: note = derived and/or modified sequence opt1 from anti-HIV_CAP256-VRC26.11_LightChain
  source 1..321: mol_type = other RNA
cagagcgtgctgacccagcccccgtccgtcagcgccgcccccggccagaacgtgaccatctcctgcagcgggccgccctcccacatcgagaagaacgacgtgagctggtaccagcgcctccccggcatggcgcccaagatggtcatctacgagtccaagcggcgccccctggggatccccgtgcggttcagcgcctcccgcagcggctccagcgccacgctggtgatcaccgggctccagaccgccgacgaggccgactactactgcggcacctgggacggccggatgaacttcgggacgggcaccaccgtctccgtgctg

SEQ ID NO: 8837 - RNA, 429 nt, synthetic construct
  misc_feature 1..429: note = derived and/or modified sequence opt1 from anti-HIV_CAP256-VRC26.11_HeavyChain
  source 1..429: mol_type = other RNA
gaggtgcagctggtcgagagcggcgggggcgtggtgcccccggggaagtccctcaccctgagctgcgtcgcctcccgcttcaccttcagcgccttcggcatgcactgggtgcggcaggcgcccgggaagggcctggagtgggtggcctccatcagcttcgccggcatcaagaagtactacgccgactccgtcaaggggcgcttcagcatctcccgggacaacagcaacaccctcttcctgcagatgaacggcctgcgcggggaggacacgggcctctaccactgcgtgaaggacatgcgggagctggagtgcgaggagtgggcctccgactactacgacttcgggaagccccagccctgcctggaccgccggggcgtgagcggcatctccgcgtggtgggggccgggcaccatggtcaccgtgagctcc

SEQ ID NO: 8838 - RNA, 321 nt, synthetic construct
  misc_feature 1..321: note = derived and/or modified sequence opt1 from anti-HIV_CAP256-VRC26.12_LightChain
  source 1..321: mol_type = other RNA
cagagcgtgctgacccagcccccgtccgtcagcaccgcccccggccagacggtgaccgtgtcctgcagcgggggcacctccaacaccgggaacaacttcgtcagctggtaccagcacctccccggcacggcccccaagctgctgatctacgagaacaacaagcgcccgctcggggtgcccgaccggttctccggcgccaagagcggcacctccgcgaccctggccatcaccgggctgcagacgggcgacgagggggactactactgcgccacctggagcggctccctcaacatcgggaccggcaccaaggtgagcgtcctg

SEQ ID NO: 8839 - RNA, 432 nt, synthetic construct
  misc_feature 1..432: note = derived and/or modified sequence opt1 from anti-HIV_CAP256-VRC26.12_HeavyChain
  source 1..432: mol_type = other RNA
gaggtgcagctggtccagagcggcgggggcgtggtgcagcccgggcgctccctccggctgagctgcgccgccccgtacttcgagttcggccgctacgggttccactgggtccggcaggcgcccggcaagggcctggagtgggtggcctccatcagcttcgccgggcgcgactactaccactcccccagcgtgtggggccggttcaccatctcccgcgacaacagcaagaacaccctctacctgcagatgaactccctgcggatcgaggacacggccctctacttctgcgcccgcgacctgcgggagagcgagtgcgaggagtgggagtccgactactacgacttcgggaagaagggcccctgcgtcaagccgcgcggggtggcgggcggcctggacctctgggggcagggcaccatggtgatcgtcagctcc

SEQ ID NO: 8840 - RNA, 333 nt, synthetic construct
  misc_feature 1..333: note = derived and/or modified sequence opt1 from anti-HIV_CAP256-VRC26.I1_LightChain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgatctacaagaacaacgagcgcccgtccggcatccccgaccggttcagcgggtccaagagcggcacctccgccaccctcggcatcaccgggctgcagacgggcgacgaggccgactactactgcgggacctgggacaccagcctgtccgccggcggggtcttcggcaccggcacgaaggtgaccgtgctc

SEQ ID NO: 8841 - RNA, 432 nt, synthetic construct
  misc_feature 1..432: note = derived and/or modified sequence opt1 from anti-HIV_CAP256-VRC26.I1_HeavyChain
  source 1..432: mol_type = other RNA
caggtgcagctggtcgagagcggcgggggcgtggtgcagcccgggcgctccctccggctgagctgcgccgcctccggcttcaccttcagcaactacgcgatggactgggtccgccaggccccggggaagggcctggagtgggtggccgtgatctccagcgacggctccaacaagaactacgccgacagcgtcaaggggcggttcaccatctcccgcgacaacagcaagaacacgctctacctgcagatgaactccctgcgggccgaggacaccgcggtgtactactgcgccaaggacctcggcgagaacaagaacgacgagtgggccaccgactactacgacctgagcatcgcctaccccgtgcaggacccccgcgcggtcgtgggggccttcgacatctggggccaggggaccatggtgacggtctccagc

SEQ ID NO: 8842 - RNA, 333 nt, synthetic construct
  misc_feature 1..333: note = derived and/or modified sequence opt1 from anti-HIV_CAP256-VRC26.I2_LightChain
  source 1..333: mol_type = other RNA
cagagcgtgctgacccagcccccgtccgtcagcgccgcccccggccagaaggtgaccatctcctgcagcgggtccagctccacgatcggcaacaactacgtgagctggtaccagctcctgcccgggaccgcgcccaagctgctcatctacaagaacgacaagcgcccgtccggcatccccgaccggttcagcgggtccaagagcggcacctccgccaccctgggcatcacggggctgcagaccggcgacgaggccgactactactgcgggacctgggacaccagcctctccgccggcggggtcttcggcacgggcaccaaggtgaccgtgctg

SEQ ID NO: 8843 - RNA, 432 nt, synthetic construct
  misc_feature 1..432: note = derived and/or modified sequence opt1 from anti-HIV_CAP256-VRC26.I2_HeavyChain
  source 1..432: mol_type = other RNA
caggtgcagctggtcgagagcggcgggggcgtggtgcagcccgggcgctccctccggctgagctgcgccgcctccggcttcaccttcagcaacttcgcgatggggtgggtccgccaggccccgggcaagggcctggagtgggtggccttcatctccagcgacgggtccaacaagaactacggcgacagcgtgaaggggcggttcaccatctcccgcgacaacagcaagaacaccctcttcctgcagatgaactccctgcgggccgaggacacggccctctactactgcgcgaaggacgtcggcgagtacaagagcgacgagtgggccaccgactactacgacctgtccatcgcctaccccatccaggacccccgcgccatggtgggggcgttcgacatctggggccagggcaccatggtgacggtcagctcc

SEQ ID NO: 8844 - RNA, 333 nt, synthetic construct
  misc_feature 1..333: note = derived and/or modified sequence opt1 from anti-HIV_CAP256-VRC26.UCA_LightChain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgatctacgagaacaacaagcgcccgtccggcatccccgaccggttcagcgggtccaagagcggcacctccgccaccctcggcatcaccgggctgcagacgggcgacgaggccgactactactgcgggacctgggacagctccctgagcgccggcggggtcttcggcaccggcaccaaggtgacggtgctc

SEQ ID NO: 8845 - RNA, 432 nt, synthetic construct
  misc_feature 1..432: note = derived and/or modified sequence opt1 from anti-HIV_CAP256-VRC26.UCA_HeavyChain
  source 1..432: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgtgatcagctacgacgggtccaacaagtactacgccgacagcgtcaagggccggttcaccatctcccgcgacaacagcaagaacacgctctacctgcagatgaactccctgcgggccgaggacaccgccgtgtactactgcgcgaaggacctcggggagagcgagaacgaggagtgggccaccgactactacgacttctccatcggctaccccgggcaggacccccgcggcgtggtcggcgccttcgacatctgggggcagggcaccatggtgacggtgagctcc

SEQ ID NO: 8846 - RNA, 324 nt, synthetic construct
  misc_feature 1..324: note = derived and/or modified sequence opt1 from anti-HIV_CH01_LightChain
  source 1..324: mol_type = other RNA
gagatcgtgctggcccagagccccggcaccctctccctgagcccgggggagcgcgccaccctgtcctgccgggcgagccacaacgtccaccccaagtacttcgcctggtaccagcagaagcccggccagagcccccgcctcctgatctacgggggctccacgcgggccgccgggatcccgggcaagttctccggcagcgggtccggcaccgacttcaccctgaccatcagccgcgtggaccccgaggacttcgccgtgtactactgccagcagtacgggggctccccctacacgttcgggcagggcaccaaggtcgagatcaag

SEQ ID NO: 8847 - RNA, 399 nt, synthetic construct
  misc_feature 1..399: note = derived and/or modified sequence opt1 from anti-HIV_CH01_HeavyChain
  source 1..399: mol_type = other RNA
gaggtgcagctggtcgagagcggcgccaacgtggtgcgccccgggggctccctccggctgagctgcaaggcctccgggttcatcttcgagaacttcggcttcagctgggtccgccaggcgccggggaagggcctgcagtgggtggccggcctcaactggaacgggggcgacacccggtacgccgactccgtgaaggggcgcttccggatgagccgcgacaactcccggaacttcgtctacctggacatggacaaggtgggcgtggacgacaccgccttctactactgcgcccgcgggacggactacaccatcgacgacgcgggcatccactaccagggcagcgggaccttctggtacttcgacctgtggggccgggggaccctcgtctccgtgagctcc

SEQ ID NO: 8848 - RNA, 324 nt, synthetic construct
  misc_feature 1..324: note = derived and/or modified sequence opt1 from anti-HIV_CH02_LightChain
  source 1..324: mol_type = other RNA
gagatcgtgctgacccagagccccgccaccctctccgtcagcccgggcgagcgcgccacgctgtcctgccgggcgagccagaacgtgcacccccgctacttcgcctggtaccagcagaagcgggggcagagcccccgcctgctcatccactccggctccacccgggccgccgggatcgccgaccgcttcagcggcgggggctccggcatgcacttcaccctgaccatcacgcgggtggagcccgaggacttcgcggtctacttctgccagcagtacgggggcagcccgtacaccttcgggcagggcacccgcgtggagctgcgg

SEQ ID NO: 8849 - RNA, 399 nt, synthetic construct
  misc_feature 1..399: note = derived and/or modified sequence opt1 from anti-HIV_CH02_HeavyChain
  source 1..399: mol_type = other RNA
gaggtgcagctggtcgagagcggcgggtccgtggtgcgccccggcgggagcctccggctgtcctgccgcgccagcggcttcatcttcgagaactacgggctgacctgggtccgccaggtgccgggcaagggcctccactgggtgtccgggatgaactggaacggcggggacacccggtacgccgacagcgtccggggccgcttctccatgagccgggacaactccaacaacatcgcgtacctgcagatgaacaacctgcgcgtggaggacacggccctctactactgcgcccgggggaccgactacaccatcgacgaccagggccgcttctaccagggcagcgggaccttctggtacttcgacttctggggccgggggacgctggtgaccgtctccagc

SEQ ID NO: 8850 - RNA, 324 nt, synthetic construct
  misc_feature 1..324: note = derived and/or modified sequence opt1 from anti-HIV_CH03_LightChain
  source 1..324: mol_type = other RNA
gagatcgtgctgacccagagccccgccaccctctccctgagcccgggcgagcgcgccacgctgtcctgccgggcgagccagtccgtccaccccaagtacttcgcctggtaccagcagaagcccgggcagagcccccgcctcctgatctactccggcagcacccgggccgccgggatcgccgaccgcttctccggcgggggcagcggcatccacttcaccctgaccatcacgcgggtggagccggaggacttcgcggtgtacttctgccagcagtacgggggctccccctacaccttcgggcagggcaccaaggtcgagctccgc

SEQ ID NO: 8851 - RNA, 399 nt, synthetic construct
  misc_feature 1..399: note = derived and/or modified sequence opt1 from anti-HIV_CH03_HeavyChain
  source 1..399: mol_type = other RNA
gaggtgcagctggtcgagagcggcgggggcgtggtgcgccccgggggctccctccggctgagctgcgccgcctccgggttcatcttcgagaactacggcctgacctgggtccgccaggtgccgggcaaggggctccactgggtgagcggcatgaactggaacgggggcgacacccggtacgcggactccgtccgcgggcggttcagcatgtcccgcgacaacagcaacaacatcgcctacctgcagatgaagaacctgcgggtggacgacacggccctctactactgcgcccgcggcaccgactacaccatcgacgaccagggcatcttctacaaggggtccggcaccttctggtacttcgacctgtgggggcggggcacgctggtgaccgtcagctcc

SEQ ID NO: 8852 - RNA, 324 nt, synthetic construct
  misc_feature 1..324: note = derived and/or modified sequence opt1 from anti-HIV_CH04_LightChain
  source 1..324: mol_type = other RNA
gagatcgtgctgacccagagccccgacaccctctccctgagcccgggcgagcgcgccacgctgtcctgccgggccagccagtccgtccacagccgctacttcgcgtggtaccagcacaagcccgggcagccgccccggctcctgatctacggcgggtccacccgcgccaccggcatccccaaccggttcagcgccgggggctccggcacccagttcacgctgaccgtgaaccgcctcgaggccgaggacttcgccgtgtactactgccagcagtacgggcggagcccctacaccttcggccaggggaccaaggtcgagatccgc

SEQ ID NO: 8853 - RNA, 399 nt, synthetic construct
  misc_feature 1..399: note = derived and/or modified sequence opt1 from anti-HIV_CH04_HeavyChain
  source 1..399: mol_type = other RNA
gaggtgcagctggtcgagagcggcgggggcctcatccgccccgggggctccctgcggctgagctgcaaggggtccggcttcatcttcgagaacttcggcttcgggtgggtgcgccagggcccggggaagggcctcgagtgggtgagcgggaccaactggaacggcggcgactcccggtacggggacagcgtcaagggccgcttcaccatctcccgggacaacagcaacaacttcgtgtacctgcagatgaactccctgcgccccgaggacacggccatctactactgcgcccgggggaccgactacaccatcgacgaccagggcatccgctaccagggcagcgggaccttctggtacttcgacgtgtggggccgggggacgctcgtcaccgtgtccagc

SEQ ID NO: 8854 - RNA, 627 nt, synthetic construct
  misc_feature 1..627: note = derived and/or modified sequence opt1 from anti-HIV_CH103_LightChain
  source 1..627: mol_type = other RNA
tacgagctgacccagcccccgagcgtgtccgtcagccccggccagaccgccacgatcacgtgctccggggccagcaccaacgtgtgctggtaccaggtgaagcccggccagtcccccgaggtcgtgatcttcgagaactacaagcgcccgagcgggatccccgaccggttctccggcagcaagtccgggagcaccgcgacgctcaccatccgcggcacccaggccatcgacgaggccgactactactgccaggtgtgggactccttcagcaccttcgtcttcggctccgggacccaggtgaccgtgctgcggcagcccaaggccaaccccaccgtcaccctgttcccgcccagctccgaggagctccaggccaacaaggcgacgctggtgtgcctgatcagcgacttctaccccggcgccgtgaccgtcgcctggaaggccgactccagccccgtgaaggcgggggtggagaccaccacgccgtccaagcagagcaacaacaagtacgccgccagctcctacctcagcctgacccccgagcagtggaagtcccaccgcagctactcctgccaggtcacccacgagggcagcaccgtggagaagacggtggcccccaccgagtgctcc

SEQ ID NO: 8855 - RNA, 678 nt, synthetic construct
  misc_feature 1..678: note = derived and/or modified sequence opt1 from anti-HIV_CH103_HeavyChain
  source 1..678: mol_type = other RNA
caggtgcagctgcaggagagcggccccggggtcgtgaagtccagcgagaccctctccctgacctgcacggtgagcggcgggtccatgggcgggacctactggagctggctgcgcctctccccgggcaagggcctggagtggatcgggtacatcttccacaccggcgagaccaactacagcccctccctgaaggggcgggtcagcatctccgtggacacgagcgaggaccagttctccctccgcctgcggagcgtgaccgccgccgacaccgcggtctacttctgcgcctccctgccccgcggccagctcgtgaacgcctacttccggaactgggggcgcggcagcctggtgtccgtcaccgccgccagcacgaagggcccctccgtgttcccgctggcgcccagcagcaagtccaccagcgggggcaccgccgccctcgggtgcctggtgaaggactacttccccgagcccgtcaccgtgtcctggaacagcggcgccctgacgtccggcgtgcacaccttcccggcggtcctccagagctccgggctgtacagcctgtccagcgtggtgaccgtcccctccagctccctcggcacccagacgtacatctgcaacgtgaaccacaagcccagcaacaccaaggtggacaagaaggtcgagcccaagtcctgcgacaag

SEQ ID NO: 8856 - RNA, 321 nt, synthetic construct
  misc_feature 1..321: note = derived and/or modified sequence opt1 from anti-HIV_M66.6_LightChain
  source 1..321: mol_type = other RNA
gacatccagctgacccagagcccctccagcctctccgccagcgtgggcgaccgcgtcaccatcacgtgccgggcctcccagagcatcgggtcctacctgaactggtaccagcagaagccgggcaaggcgcccaagctgctcatctacgccgccagcaccctgcagtccggggtgcccagccgcttctccggcagcgggtccggcaccgacttcaccctgacgatcagctccctccagcccgaggacagcgccacctactactgccagcagtcctacagcaccccgttcaccttcggccccgggacgaaggtggacatccgg

SEQ ID NO: 8857 - RNA, 390 nt, synthetic construct
  misc_feature 1..390: note = derived and/or modified sequence opt1 from anti-HIV_M66.6_HeavyChain
  source 1..390: mol_type = other RNA
caggtgcagctggtccagagcggcgccgaggtgaagaagcccggggagtccctcaagatcagctgcaaggtgtccggctacaacttcgccagcgagtggatcgggtgggtccgccagatgccgggcaaggggctggagtggatgggcatcatctaccccggcgactccgacaccaagtacagcccctccttccagggccaggtgatcatcagcgcggacaagtccatcaacaccgcctacctgcagtggagctccctcaaggccagcgacacggccatctactactgcgcccggcagaaccactacgggtccgggagctacttctaccgcaccgcgtactactacgccatggacgtgtggggccaggggaccaccgtcacggtgtccagc

SEQ ID NO: 8858 - RNA, 327 nt, synthetic construct
  misc_feature 1..327: note = derived and/or modified sequence opt1 from anti-HIV_NIH45-46_LightChain
  source 1..327: mol_type = other RNA
gagatcgtgctgacccagagccccgccaccctctccctgagcccgggcgagacggccatcatctcctgccgcaccagccagtccgggagcctggcgtggtaccagcagcggcccggccaggcgccccgcctcgtcatctactccgggagcacccgggccgccggcatccccgaccgcttctccgggagccggtggggcgccgactacaacctgtccatcagcaacctggagtccggcgacttcggggtgtactactgccagcagtacgagttcttcggccaggggaccaaggtgcaggtcgacatcaagcgcacggtggccgccccg

SEQ ID NO: 8859 - RNA, 399 nt, synthetic construct
  misc_feature 1..399: note = derived and/or modified sequence opt1 from anti-HIV_NIH45-46_HeavyChain
  source 1..399: mol_type = other RNA
caggtgcgcctgagccagtccggcgggcagatgaagaagcccggcgagagcatgcggctctcctgccgcgccagcgggtacgagttcctgaactgcccgatcaactggatccggctggcccccggccgccggcccgagtggatggggtggctcaagccccgcggcggcgcggtcaactacgcccggaagttccaggggcgcgtgaccatgacccgggacgtgtactccgacacggccttcctggagctgcgcagcctcacctccgacgacaccgccgtctacttctgcacccggggcaagtactgcacggcccgcgactactacaactgggacttcgagcactgggggcggggcgcgccggtgaccgtgagctccgccagcaccaaggggccctccgtc

SEQ ID NO: 8860 - RNA, 330 nt, synthetic construct
  misc_feature 1..330: note = derived and/or modified sequence opt1 from anti-HIV_PG16_LightChain
  source 1..330: mol_type = other RNA
cagagcgccctgacccagcccgcctccgtgagcggctccccggggcagaccatcacgatcagctgcaacggcacctccagcgacgtcgggggcttcgactccgtgagctggtaccagcagtcccccgggaaggcgcccaaggtgatggtcttcgacgtgagccaccgcccctccggcatcagcaaccggttctccggcagcaagtccgggaacaccgccagcctcaccatctccggcctgcacatcgaggacgagggggactacttctgcagctccctgacggaccgcagccaccggatcttcggcgggggcaccaaggtgaccgtcctc

SEQ ID NO: 8861 - RNA, 411 nt, synthetic construct
  misc_feature 1..411: note = derived and/or modified sequence opt1 from anti-HIV_PG16_HeavyChain
  source 1..411: mol_type = other RNA
caggagcagctggtggagagcggcgggggcgtcgtgcagcccgggggctccctccgcctgagctgcctggcctccgggttcaccttccacaagtacggcatgcactgggtgcggcaggccccgggcaaggggctcgagtgggtcgcgctgatcagcgacgacggcatgcgcaagtaccactccgacagcatgtgggggcgggtgaccatctcccgcgacaacagcaagaacacgctgtacctccagttctccagcctgaaggtggaggacaccgccatgttcttctgcgcccgggaggccggcgggcccatctggcacgacgacgtcaagtactacgacttcaacgacggctactacaactaccactacatggacgtgtggggcaaggggaccaccgtgacggtctccagc

SEQ ID NO: 8862 - RNA, 315 nt, synthetic construct
  misc_feature 1..315: note = derived and/or modified sequence opt1 from anti-HIV_PGT122_LightChain
  source 1..315: mol_type = other RNA
accttcgtgagcgtcgcccccggccagaccgcccgcatcacgtgcggggaggagtccctgggcagccggtccgtgatctggtaccagcagcgcccggggcaggcgcccagcctcatcatctacaacaacaacgaccggccctccggcatccccgaccgcttcagcgggtccccgggcagcaccttcggcaccaccgccacgctgaccatcacctccgtggaggccggggacgaggccgactactactgccacatctgggacagccggcgccccaccaactgggtcttcggcgaggggacgaccctgatcgtgctc

SEQ ID NO: 8863 - RNA, 396 nt, synthetic construct
  misc_feature 1..396: note = derived and/or modified sequence opt1 from anti-HIV_PGT122_HeavyChain
  source 1..396: mol_type = other RNA
caggtgcacctccaggagagcggccccgggctggtcaagccgtccgagaccctgagcctgacctgcaacgtgtccggcacgctcgtgcgcgacaactactggagctggatccggcagcccctggggaagcagcccgagtggatcggctacgtccacgactccggggacaccaactacaaccccagcctgaagtcccgcgtgcacctcagcctggacaagtccaagaacctggtgagcctccggctgaccggcgtcaccgccgccgactccgcgatctactactgcgccacgaccaagcacggccgccggatctacggggtggtggccttcaaggagtggttcacctacttctacatggacgtctggggcaaggggaccagcgtgacggtgtccagc

SEQ ID NO: 8864 - RNA, 315 nt, synthetic construct
  misc_feature 1..315: note = derived and/or modified sequence opt1 from anti-HIV_PGT123_LightChain
  source 1..315: mol_type = other RNA
agctccatgagcgtgtcccccggcgagaccgccaagatcagctgcgggaaggagtccatcggcagccgcgccgtccagtggtaccagcagaagccggggcagccgccctccctgatcatctacaacaaccaggaccggcccgcgggcgtgcccgagcgcttcagcgcctcccccgacttccggcccgggaccacggccaccctcaccatcaccaacgtggacgccgaggacgaggccgactactactgccacatctacgacgcgcgcggcggcacgaactgggtcttcgaccgggggaccaccctgaccgtgctg

SEQ ID NO: 8865 - RNA, 396 nt, synthetic construct
  misc_feature 1..396: note = derived and/or modified sequence opt1 from anti-HIV_PGT123_HeavyChain
  source 1..396: mol_type = other RNA
cagctgcacctccaggagagcggccccgggctggtgaagccgcccgagaccctgtccctgacctgcagcgtctccggcgccagcatcaacgacgcctactggtcctggatccgccagagccccgggaagcggcccgagtgggtgggctacgtgcaccactccggggacacgaactacaacccgagcctcaagcgccgggtcaccttctccctggacaccgcgaagaacgaggtgagcctcaagctggtggacctgaccgccgccgactccgccacgtacttctgcgcccgcgcgctccacggcaagcggatctacggcatcgtcgccctgggggagctgttcacctacttctacatggacgtgtggggcaaggggaccgccgtgaccgtcagctcc

SEQ ID NO: 8866 - RNA, 315 nt, synthetic construct
  misc_feature 1..315: note = derived and/or modified sequence opt1 from anti-HIV_PGT125_LightChain
  source 1..315: mol_type = other RNA
cagagcgccctgacccagcccccgtccgccagcggctcccccgggcagagcatcaccatctcctgcaacggcacggcgaccaacttcgtgagctggtaccagcagttccccgacaaggcccccaagctcatcatcttcggggtcgacaagcgcccgcccggcgtgcccgaccggttctccgggagccgctccggcaccaccgccagcctgacggtgtcccggctgcagaccgacgacgaggccgtctactactgcggcagcctcgtggggaactgggacgtgatcttcggcgggggcaccaccctgacggtcctg

SEQ ID NO: 8867 - RNA, 411 nt, synthetic construct
  misc_feature 1..411: note = derived and/or modified sequence opt1 from anti-HIV_PGT125_HeavyChain
  source 1..411: mol_type = other RNA
cagagccagctgcaggagtccggcccccgcctcgtggaggccagcgagaccctgtccctgacctgcaacgtcagcggggagtccacgggcgcctgcacctacttctgggggtgggtgcggcaggcgccgggcaaggggctcgagtggatcggcagcctgtcccactgccagagcttctggggctccgggtggaccttccacaaccccagcctgaagtcccgcctcaccatcagcctggacacgcccaagaaccaggtgttcctgaagctcacctccctgaccgccgccgacaccgccacgtactactgcgcccggttcgacggcgaggtcctggtgtacaaccactggcccaagccggcgtgggtggacctctgggggcgcggcatccccgtcaccgtgaccgtgagctcc

SEQ ID NO: 8868 - RNA, 315 nt, synthetic construct
  misc_feature 1..315: note = derived and/or modified sequence opt1 from anti-HIV_PGT126_LightChain
  source 1..315: mol_type = other RNA
cagagcgccctgacccagcccccgtccgccagcggctcccccgggcagagcatctccatcagctgcaccggcacgtccaaccgcttcgtgagctggtaccagcagcaccccgggaaggcgcccaagctcgtcatctacggcgtgaacaagcggccgtccggggtgcccgaccgcttcagcggctccaagagcggcaacaccgcctccctgaccgtcagcgggctgcagaccgacgacgaggccgtgtactactgctccagcctcgtgggcaactgggacgtcatcttcgggggcgggacgaagctgaccgtgctg

SEQ ID NO: 8869 - RNA, 411 nt, synthetic construct
  misc_feature 1..411: note = derived and/or modified sequence opt1 from anti-HIV_PGT126_HeavyChain
  source 1..411: mol_type = other RNA
cagccccagctgcaggagagcggcccggggctcgtggaggcctccgagaccctgagcctgacctgcacggtctccggcgacagcaccgccgcgtgcgactacttctgggggtgggtgcgccagccgcccggcaaggggctcgagtggatcggcggcctgtcccactgcgccgggtactacaacaccggctggacctaccacaaccccagcctgaagtcccggctcacgatcagcctggacacccccaagaaccaggtgttcctgaagctcaactccgtcaccgccgccgacaccgccatctactactgcgcgcgcttcgacggggaggtgctggtgtaccacgactggcccaagcccgcctgggtcgacctgtggggccgggggacgctcgtgaccgtgaccgtcagctcc

SEQ ID NO: 8870 - RNA, 315 nt, synthetic construct
  misc_feature 1..315: note = derived and/or modified sequence opt1 from anti-HIV_PGT127_LightChain
  source 1..315: mol_type = other RNA
cagagcgccctgacccagcccccgtccgccagcggctcccccgggcagagcatcaccatctcctgcacgggcaccagcaacaacttcgtgtcctggtaccagcagtaccccgggaaggcgcccaagctcgtcatctacgaggtgaacaagcgcccgagcggcgtgcccgaccggttctccgggagcaagtccggcagcaccgcctccctgaccgtcagcggcctgcaggccgacgacgagggggtgtactactgctccagcctcgtgggcaactgggacgtcatcttcgggggcgggacgaagctgaccgtgctg

SEQ ID NO: 8871 - RNA, 405 nt, synthetic construct
  misc_feature 1..405: note = derived and/or modified sequence opt1 from anti-HIV_PGT127_HeavyChain
  source 1..405: mol_type = other RNA
cagccccagctgcaggagagcggcccggggctcgtggaggcctccgagaccctgagcctgacctgcacggtctccggcgacagcaccgggcgctgcaactacttctggggctgggtgcggcagccgcccgggaagggcctcgagtggatcggctccctgagccactgccgctcctactacaacaccgactggacctaccacaaccccagcctgaagtcccggctcacgatcagcctggacacccccaagaaccaggtgttcctgcgcctcacctccgtcaccgccgcggacacggccacctactactgcgcccggttcgggggcgaggtgctggtgtaccgcgactggcccaagcccgcctgggtcgacctgtgggggcggggcaccctcgtgaccgtgagctcc

SEQ ID NO: 8872 - RNA, 315 nt, synthetic construct
  misc_feature 1..315: note = derived and/or modified sequence opt1 from anti-HIV_PGT128_LightChain
  source 1..315: mol_type = other RNA
cagagcgccctgacccagcccccgtccgccagcggctcccccgggcagagcatcaccatctcctgcacgggcaccagcaacaacttcgtgtcctggtaccagcagcacgcggggaaggcccccaagctcgtcatctacgacgtgaacaagcgccccagcggcgtgccggaccggttctccgggagcaagtccggcaacaccgccagcctgaccgtctccggcctgcagacggacgacgaggccgtgtactactgcgggagcctcgtgggcaactgggacgtcatcttcgggggcgggaccaagctgaccgtgctg

SEQ ID NO: 8873 - RNA, 405 nt, synthetic construct
  misc_feature 1..405: note = derived and/or modified sequence opt1 from anti-HIV_PGT128_HeavyChain
  source 1..405: mol_type = other RNA
cagccccagctgcaggagagcggcccgaccctcgtggaggcctccgagaccctgagcctgacgtgcgccgtctccggggacagcaccgcggcctgcaactccttctggggctgggtgcgccagccgcccgggaagggcctcgagtgggtggggagcctgtcccactgcgccagctactggaaccggggctggacctaccacaacccctccctcaagagccgcctgaccctggccctggacacgcccaagaacctcgtcttcctgaagctgaactccgtgaccgccgcggacaccgccacctactactgcgcccggttcggcggggaggtgctccgctacacggactggcccaagcccgcctgggtcgacctgtggggccgggggaccctggtgaccgtgagctcc

SEQ ID NO: 8874 - RNA, 330 nt, synthetic construct
  misc_feature 1..330: note = derived and/or modified sequence opt1 from anti-HIV_PGT130_LightChain
  source 1..330: mol_type = other RNA
cagagcgccctgacccagcccccgtccgccagcggctccctcgggcagagcgtgaccatctcctgcaacggcacgagctccgacatcgggggctggaacttcgtcagctggtaccagcagttccccgggcgcgcgccccggctgatcatcttcgaggtgaacaagcgcccctccggcgtgccgggccggttcagcgggtccaagagcggcaactccgccagcctgaccgtctccgggctccagagcgacgacgagggccagtacttctgctccagcctgttcgggcgctgggacgtggtgttcggcggcgggaccaagctgaccgtcctc

SEQ ID NO: 8875 - RNA, 387 nt, synthetic construct
  misc_feature 1..387: note = derived and/or modified sequence opt1 from anti-HIV_PGT130_HeavyChain
  source 1..387: mol_type = other RNA
caggtgcagctgcaggagagcggccccgggctcgtcaagccggccgagaccctgtccctgacctgcagcgtgtccggcgagagcatcaacacggggcactactactggggctgggtgcgccaggtccccgggaagggcctcgagtggatcggccacatccactacaccaccgccgtgctgcacaacccctccctcaagagccggctgaccatcaagatctacacgctgcgcaaccagatcaccctgcggctctccaacgtgaccgcggccgacaccgccgtctaccactgcgtgcgcagcgggggcgacatcctgtactactacgagtggcagaagccccactggttctccccgtgggggcccggcatccacgtgacggtcagctcc

SEQ ID NO: 8876 - RNA, 330 nt, synthetic construct
  misc_feature 1..330: note = derived and/or modified sequence opt1 from anti-HIV_PGT131_LightChain
  source 1..330: mol_type = other RNA
cagagcgccctgacccagcccccgtccgccagcggctccctcgggcagagcctgaccatctcctgcagcggcacggggtccgacatcggcagctggaacttcgtgtcctggtaccagcagttccccgggcgcgcgcccaacctgatcatcttcgaggtcaaccggcgccggagcggcgtgcccgaccgcttctccggcagcaagtccgggaacaccgccagcctcaccgtgtccggcctgcggagcgaggacgaggccgagtacttctgctccagcctgtccgggcgctgggacatcgtcttcggcgggggcaccaaggtgacggtgctc

SEQ ID NO: 8877 - RNA, 387 nt, synthetic construct
  misc_feature 1..387: note = derived and/or modified sequence opt1 from anti-HIV_PGT131_HeavyChain
  source 1..387: mol_type = other RNA
caggtgcagctgcaggagagcggccccgggctcgtcaagccgtccgagaccctgagcctgacctgcacggtgtccggcgacagcatcaacaccgggcaccactactggggctgggtgcgccaggtccccgggaagggccccgagtggatcgcccacatccactacaacaccgccgtgctccacaaccccgcgctgaagtcccgggtgaccatcagcatcttcacgctgaagaacctcatcaccctgtccctgagcaacgtcaccgccgccgacaccgccgtgtacttctgcgtgcgctccggcggggacatcctctactacatcgagtggcagaagccgcactggttctacccctggggccccgggatcctggtcacggtgagctcc

SEQ ID NO: 8878 - RNA, 321 nt, synthetic construct
  misc_feature 1..321: note = derived and/or modified sequence opt1 from anti-HIV_PGT135_LightChain
  source 1..321: mol_type = other RNA
gagatcgtgatgacccagagccccgacaccctgtccgtcagcccgggcgagacggtgaccctctcctgccgcgccagccagaacatcaacaagaacctggcctggtaccagtacaagcccgggcagagcccccggctggtgatcttcgagacctactccaagatcgcggccttccccgcccgcttcgtcgcctccggcagcgggaccgagttcacgctcaccatcaacaacatgcagtccgaggacgtggccgtgtactactgccagcagtacgaggagtggccgcggaccttcggccaggggaccaaggtcgacatcaag

SEQ ID NO: 8879 - RNA, 399 nt, synthetic construct
  misc_feature 1..399: note = derived and/or modified sequence opt1 from anti-HIV_PGT135_HeavyChain
  source 1..399: mol_type = other RNA
cagctgcagatgcaggagagcggccccgggctcgtgaagccgtccgagaccctgagcctgtcctgcaccgtcagcggcgactccatccgcgggggcgagtggggcgacaaggactaccactgggggtgggtgcggcacagcgccggcaaggggctcgagtggatcggctccatccactggcgcgggacgacccactacaaggagagcctgcggcgccgggtgtccatgagcatcgacacctcccgcaactggttcagcctgcggctcgcctccgtcaccgcggccgacacggccgtgtacttctgcgcccgccaccggcaccacgacgtgttcatgctggtccccatcgccggctggttcgacgtgtgggggcccggcgtgcaggtcaccgtgagctcc

SEQ ID NO: 8880 - RNA, 321 nt, synthetic construct
  misc_feature 1..321: note = derived and/or modified sequence opt1 from anti-HIV_PGT136_LightChain
  source 1..321: mol_type = other RNA
gagatcgtgatgacccagagcccgcccaccctgtccgtcagccccggcgagacggccaccctctcctgccgcgccagccagaacgtgaagaacaacctggcctggtaccagctgaagcccgggcaggcgccccggctcctgatcttcgacgcctccagccgcgccggcgggatcccggaccggttctccggcagcgggtacggcaccgacttcaccctgacggtgaactccgtccagagcgaggacttcggcgactacttctgccagcagtacgaggagtggccccgcaccttcgggcagggcaccaaggtggacatcaag

SEQ ID NO: 8881 - RNA, 402 nt, synthetic construct
  misc_feature 1..402: note = derived and/or modified sequence opt1 from anti-HIV_PGT136_HeavyChain
  source 1..402: mol_type = other RNA
cagctgcagctccaggagagcggccccgggctggtgaagccgtccgagaccctgagcctgacctgcacggtctccggcgggagcatgcgcggcaccgactggggcgagaacgacttccactacgggtggatccggcagtccagcgccaagggcctcgagtggatcgggtccatccactggcgcggccggaccacccactacaagacgagcttccgctcccgggccaccctgagcatcgacacctccaacaaccgcttcagcctcaccttctccttcgtgacggcggccgacaccgccgtgtactactgcgcccggcacaagtaccacgacatcttccgcgtcgtgcccgtggccgggtggttcgacccctggggccaggggctgctggtcaccgtgagctcc

SEQ ID NO: 8882 - RNA, 321 nt, synthetic construct
  misc_feature 1..321: note = derived and/or modified sequence opt1 from anti-HIV_PGT137_LightChain
  source 1..321: mol_type = other RNA
gagatcatgatgacccagagccccgccatcctgtccgtgagcccgggcgaccgcgccaccctctcctgccgggcgagccagtccgtcaagaacaacctggcctggtaccagaagcgccccgggcaggcgccccggctgctcatcttcgacacgagctcccgcgccagcggcatccccgcccggttctccgggggcgggagcggcaccgagttcaccctgaccgtgaactccatgcagagcgaggacttcgccacgtactactgccagcagtacgaggagtggccgcgcaccttcggccaggggaccaaggtggagatcaag

SEQ ID NO: 8883 - RNA, 399 nt, synthetic construct
  misc_feature 1..399: note = derived and/or modified sequence opt1 from anti-HIV_PGT137_HeavyChain
  source 1..399: mol_type = other RNA
gaggtgcacctggaggagagcggccccgggctggtccgcccgtccgagaccctgagcctgacctgcacggcctccggcgggagcatccggggcggggagtggggcgactccgactaccactggggctgggtgcgccacagccccgagaaggggctcgagtggatcggctccatccactggcgggggaccacccactacaacgcccccttccgcggccgggggcgcctgagcatcgacctgtcccggaaccagttcagcctccgcctgacctccgtgacggcggaggacaccgccgtctactactgcgtgaagcacaagtaccacgacatcgtgatggtcgtgcccatcgccggctggttcgacccgtggggccaggggctccaggtgaccgtcagctcc

SEQ ID NO: 8884 - RNA, 336 nt, synthetic construct
  misc_feature 1..336: note = derived and/or modified sequence opt1 from anti-HIV_PGT141_LightChain
  source 1..336: mol_type = other RNA
gacaccgtggtcacccagagccccctgtccctcccggtgacgcccggcgaggccgccagcatgtcctgcagctccacccagagcctgcgccactccaacggggcgaactacctggcctggtaccagcacaagcccggccagagcccccggctcctgatccgcctggggtcccagcgggccagcggcgtgccggaccgcttctccgggagcggctccggcacccacttcaccctcaagatcagccgggtcgaggccgaggacgccgcgatctactactgcatgcaggggctgaaccgcccctggacgttcggcaaggggaccaagctggagatcaag

SEQ ID NO: 8885 - RNA, 423 nt, synthetic construct
  misc_feature 1..423: note = derived and/or modified sequence opt1 from anti-HIV_PGT141_HeavyChain
  source 1..423: mol_type = other RNA
caggtgcagctggtccagagcggccccgaggtgaagaagccggggtccagcgtgaaggtctcctgcaaggccagcggcaacaccttctccaagtacgacgtgcactgggtgcgccaggccaccgggcagggcctcgagtgggtcgggtggatgagccacgagggcgacaagacggagtccgcgcagcggttcaagggccgcgtgaccttcacccgggacaccagcgcctccacggcctacatggagctgcgcgggctgaccagcgacgacaccgccatctactactgcacccggggctccaagcaccgcctccgggactacgtgctgtacgacgactacgggctgatcaactaccaggagtggaacgactacctcgagttcctggacgtctggggccacgggacggccgtgaccgtgagctcc

SEQ ID NO: 8886 - RNA, 336 nt, synthetic construct; identical to SEQ ID NO: 8884
  misc_feature 1..336: note = derived and/or modified sequence opt1 from anti-HIV_PGT142_LightChain
  source 1..336: mol_type = other RNA

SEQ ID NO: 8887 - RNA, 423 nt, synthetic construct
  misc_feature 1..423: note = derived and/or modified sequence opt1 from anti-HIV_PGT142_HeavyChain
  source 1..423: mol_type = other RNA
caggtgcagctggtccagagcggccccgaggtgaagaagccggggtccagcgtgaaggtctcctgcaaggccagcggcaacaccttctccaagtacgacgtgcactgggtgcgccaggccaccgggcagggcctcgagtgggtcgggtggatcagccacgagcgggacaagacggagtccgcgcagcgcttcaagggccgggtgaccttcacccgcgacaccagcgccacgaccgcctacatggagctgcggggcctgacctccgacgacaccgccatctactactgcacgcgcgggagcaagcaccggctccgcgactacgtgctgtacgacgactacggcctgatcaactaccaggagtggaacgactacctcgagttcctggacgtctgggggcacggcaccgccgtgaccgtgtccagc

SEQ ID NO: 8888 - RNA, 336 nt, synthetic construct
  misc_feature 1..336: note = derived and/or modified sequence opt1 from anti-HIV_PGT143_LightChain
  source 1..336: mol_type = other RNA
gacaccgtggtcacccagagccccctgtccctcccggtgacgcccggcgaggccgccagcatgtcctgcaccagcacccagtccctgcgccacagcaacggggcgaactacctggcctggtaccagcacaagcccggccagagcccccggctcctgatccgcctggggtcccagcgggcctccggcgtgccggaccgcttcagcgggtccggcagcggcacccacttcacgctcaagatctcccgggtcgagcccgaggacgccgccatctactactgcatgcaggggctgaaccgcccctggaccttcggcaaggggaccaagctggagatcaag

SEQ ID NO: 8889 - RNA, 423 nt, synthetic construct
  misc_feature 1..423: note = derived and/or modified sequence opt1 from anti-HIV_PGT143_HeavyChain
  source 1..423: mol_type = other RNA
caggtgcagctggagcagagcggcgccgaggtcaagaagcccgggtccagcgtgaaggtgtcctgcaaggccagcggcaacaccttctccaagtacgacgtccactgggtgcgccaggcgaccgggcagggcctcgagtgggtggggtggatgagccacgagggcgacaagacggagtccgcccagcggttcaagggccgcgtcaccttcacccgggacaccagcgcctccacggcctacatggagctgcgcgggctgaccagcgacgacaccgccatctactactgcacccggggctccaagcaccgcctccgggactacgtgctgtacgacgactacgggctgatcaactaccaggagtggaacgactacctcgagttcctggacgtgtggggccacgggacggcggtcaccgtgagctcc

SEQ ID NO: 8890 - RNA, 336 nt, synthetic construct
  misc_feature 1..336: note = derived and/or modified sequence opt1 from anti-HIV_PGT144_LightChain
  source 1..336: mol_type = other RNA
gacaccgtggtcacccagagccccctgtccctcagcgtgacgccgggcgaggccgcctccatgagctgcacctccacccagagcctgcgccactccaacggggcgaactacctggcctggtaccagcacaagcccggccagagcccccggctcctgatccgcctggggtcccagcgggccagcggcgtgcccgaccgcttctccgggagcggctccggcacccacttcacgctcaagatcagccgggtcgaggccgacgacgccgcgatctactactgcatgcaggggctgaaccgcccgtggaccttcggcaaggggaccaagctggagatcaag

SEQ ID NO: 8891 - RNA, 423 nt, synthetic construct
  misc_feature 1..423: note = derived and/or modified sequence opt1 from anti-HIV_PGT144_HeavyChain
  source 1..423: mol_type = other RNA
caggtgcagctggtccagagcggcgccgaggtgaagaagcccgggtccagcgtgaaggtctcctgcaaggccagcggcaacaccttccgcaagtacgacgtgcactgggtgcggcaggcgaccgggcagggcctcgagtgggtcgggtggatgtcccacgagggcgacaagacggagagcgcccagcgcttcaagggccgggtgtccttcacccgcgacaacagcgcctccaccgcctacatcgagctgcgggggctgaccagcgacgacacggccatctactactgcaccggcgggtccaagcaccgcctccgggactacgtgctgtacgacgactacggcctgatcaaccagcaggagtggaacgactacctcgagttcctggacgtctgggggcacggcaccgcggtgaccgtgagctcc

SEQ ID NO: 8892 - RNA, 336 nt, synthetic construct
  misc_feature 1..336: note = derived and/or modified sequence opt1 from anti-HIV_PGT145_LightChain
  source 1..336: mol_type = other RNA
gaggtggtcatcacccagagccccctgttcctcccggtgacccccggcgaggccgcctccctgagctgcaagtgctcccacagcctgcagcactccacgggggcgaactacctcgcctggtacctgcagcgccccggccagacgccccggctgctcatccacctggccacccaccgcgccagcggggtgccggaccggttctccggcagcgggtccggcaccgacttcaccctgaagatcagccgcgtcgagtccgacgacgtgggcacctactactgcatgcaggggctccacagcccctggaccttcggccaggggaccaaggtggagatcaag

SEQ ID NO: 8893 - RNA, 420 nt, synthetic construct
  misc_feature 1..420: note = derived and/or modified sequence opt1 from anti-HIV_PGT145_HeavyChain
  source 1..420: mol_type = other RNA
caggtgcagctggtccagagcggcgccgaggtgaagaagcccgggtccagcgtgaaggtctcctgcaaggccagcggcaactccttcagcaaccacgacgtgcactgggtgcgccaggcgaccgggcagggcctcgagtggatggggtggatgtcccacgagggcgacaagaccggcctggcccagaagttccaggggcgggtcacgatcacccgcgacagcggcgcctccaccgtgtacatggagctgcgggggctcaccgccgacgacacggccatctactactgcctgaccggcagcaagcaccgcctgcgggactacttcctctacaacgagtacgggccgaactacgaggagtggggcgactacctggcgaccctggacgtgtggggccacgggaccgccgtcacggtgtccagc

SEQ ID NO: 8894 - RNA, 657 nt, synthetic construct
  misc_feature 1..657: note = derived and/or modified sequence opt1 from anti-HIV_PGT151_LightChain
  source 1..657: mol_type = other RNA
gacatcgtgatgacccagacgcccctgagcctctccgtcaccccgggccagcccgccagcatctcctgcaagagctccgagagcctgcgccagtccaacgggaagaccagcctgtactggtaccggcagaagcccggccagagcccccagctcctggtgttcgaggtgtccaaccgcttctccggggtcagcgaccggttcgtgggctccgggagcggcaccgacttcaccctgcgcatctcccgggtggaggccgaggacgtcggcttctactactgcatgcagagcaaggacttcccgctcacgttcgggggcgggaccaaggtggacctgaagcgcaccgtggcggccccctccgtcttcatcttcccgcccagcgacgagcagctgaagtccggcaccgccagcgtggtgtgcctcctgaacaacttctacccccgggaggccaaggtccagtggaaggtggacaacgccctgcagagcgggaactcccaggagagcgtgacggagcaggactccaaggacagcacctactccctcagctccaccctgaccctgagcaaggcggactacgagaagcacaaggtctacgcctgcgaggtgacgcaccagggcctctccagccccgtgaccaagtccttcaaccgcggcgagtgc

SEQ ID NO: 8895 - RNA, 720 nt, synthetic construct
  misc_feature 1..720: note = derived and/or modified sequence opt1 from anti-HIV_PGT151_HeavyChain
  source 1..720: mol_type = other RNA
cgcgtgcagctggtcgagagcggcgggggcgtggtgcagcccgggaagtccgtccggctcagctgcgtggtgtccgacttcccgttcagcaagtaccccatgtactgggtccgccaggcccccggcaaggggctggagtgggtggccgcgatctccggcgacgcctggcacgtggtctacagcaactccgtgcagggccggttcctggtgagccgcgacaacgtcaagaacaccctctacctggagatgaactccctgaagatcgaggacaccgccgtgtaccggtgcgcccgcatgttccaggagagcgggcccccgcggctcgaccgctggtccggccggaactactactactacagcgggatggacgtgtggggccaggggacgaccgtcaccgtgtccagcgcctccaccaagggccccagcgtgttccccctggcgccctccagcaagtccacgagcggcgggaccgccgccctgggctgcctcgtcaaggactacttcccggagcccgtgaccgtgagctggaactccggggccctgaccagcggcgtccacacgttccccgcggtgctgcagtccagcggcctctactccctgagctccgtggtcaccgtgcccagctccagcctggggacccagacctacatctgcaacgtcaaccacaagccgtccaacacgaaggtggacaagcgcgtggagcccaagagctgcgacaag

SEQ ID NO: 8896 - RNA, 657 nt, synthetic construct
  misc_feature 1..657: note = derived and/or modified sequence opt1 from anti-HIV_PGT152_LightChain
  source 1..657: mol_type = other RNA
gacatcgtgatgacccagacgcccctgagcctctccgtcgacccgggccagcccgccagcatctcctgcaagagctcccagagcctgcgccagtccaacgggaagaccagcctgtactggtaccagcagaagcccggccagagcccccagctcctgatcttcgaggtgtccaaccggttctccggggtgagcgaccgcttcgtcggctccgggagcggcaccgacttcaccctgcggatctcccgcgtggaggccgaggacgtgggcttctactactgcatgcagagcaaggacttcccgctcaccttcgggggcgggacgaaggtcgacctgaagcggaccgtggcggccccctccgtgttcatcttcccgcccagcgacgagcagctgaagtccggcaccgccagcgtcgtgtgcctcctgaacaacttctacccccgcgaggccaaggtgcagtggaaggtcgacaacgccctgcagagcgggaactcccaggagagcgtgaccgagcaggactccaaggacagcacgtactccctcagctccaccctgaccctgagcaaggcggactacgagaagcacaaggtgtacgcctgcgaggtcacccaccagggcctctccagccccgtgacgaagtccttcaaccggggcgagtgc

SEQ ID NO: 8897 - RNA, 720 nt, synthetic construct
  misc_feature 1..720: note = derived and/or modified sequence opt1 from anti-HIV_PGT152_HeavyChain
  source 1..720: mol_type = other RNA
cgcgtgcagctggtcgagagcggcgggggcgtggtgcagcccgggaagtccgtccggctcagctgcgtggtgtccgacttcccgttcagcaagtaccccatgtactgggtccgccaggcccccggcaaggggctggagtgggtggccgcgatctccgccgacgcctggcacgtggtctacagcggctccgtgcagggccggttcctggtgagccgcgacaactccaagaacatcctctacctggagatgaacaccctgaagatcgaggacaccgccgtctaccggtgcgcccgcatgttccaggagagcgggcccccgcggttcgactcctggagcggccgcaactactactactactccgggatggacgtgtggggccaggggacgaccgtgaccgtcagctccgcgagcaccaagggcccctccgtgttccccctcgcccccagctccaagagcacgagcggcgggaccgccgccctgggctgcctggtgaaggactacttcccggagcccgtcaccgtgtcctggaacagcggggcgctcacctccggcgtgcacacgttccccgccgtcctgcagagctccggcctgtacagcctctccagcgtggtgaccgtcccctccagctccctggggacccagacctacatctgcaacgtgaaccacaagccgagcaacacgaaggtcgacaagcgggtggagcccaagtcctgcgacaag

SEQ ID NO: 8898 - RNA, 309 nt, synthetic construct
  misc_feature 1..309: note = derived and/or modified sequence opt1 from anti-HIV_VRC-CH30_LightChain
  source 1..309: mol_type = other RNA
gacatccagatgacccagagcccctccagcctgtccgccagcctcggcgaccgcgtgaccatcacgtgccaggcctcccgggggatcggcaaggacctgaactggtaccagcagaagccggggaaggcgcccaagctgctcgtcagcgacgcctccatcctggagggcggggtgcccagccgcttctccggcagcggcttccaccagaacttctccctgaccatcagctccctccagcccgaggacgtggccacctacttctgccagcagtacgagaccttcgggcagggcacgaaggtcgacatcaag

SEQ ID NO: 8899 - RNA, 393 nt, synthetic construct
  misc_feature 1..393: note = derived and/or modified sequence opt1 from anti-HIV_VRC-CH30_HeavyChain
  source 1..393: mol_type = other RNA
caggtgcagctggtccagagcggcgccgccgtgcgcaagcccggggcgtccgtgaccgtcagctgcaagttcgccgaggacgacgactactccccgcactgggtgaaccccgcccccgagcactacatccacttcctccggcaggcccccggccagcagctggagtggctggcctggatgaacccgaccaacggggcggtgaactacgcctggcagctccacggccgcctgacggccacccgggacgggagcatgaccaccgccttcctggaggtccgctccctccggagcgacgacacggcggtgtactactgcgcccgcgcccagaagcggggccgctccgagtgggcctacgcccactggggccaggggacccccgtggcggtcagctcc

SEQ ID NO: 8900 - RNA, 309 nt, synthetic construct
  misc_feature 1..309: note = derived and/or modified sequence opt1 from anti-HIV_VRC-CH31_LightChain
  source 1..309: mol_type = other RNA
gacatccagatgacccagagcccctccagcctgtccgccagcctcggcgaccgcgtgaccatcacgtgccaggcctcccgggggatcggcaaggacctgaactggtaccagcagaaggcggggaaggccccgaagctgctcgtcagcgacgcctccaccctggagggcggggtgcccagccgcttctccggcagcggcttccaccagaacttctccctgaccatcagctccctccaggccgaggacgtggccacctacttctgccagcagtacgagacgttcgggcagggcaccaaggtcgacatcaag

SEQ ID NO: 8901 - RNA, 393 nt, synthetic construct
  misc_feature 1..393: note = derived and/or modified sequence opt1 from anti-HIV_VRC-CH31_HeavyChain
  source 1..393: mol_type = other RNA
caggtgcagctggtccagagcggcgccgccgtgcgcaagcccggggcgtccgtgaccgtcagctgcaagttcgccgaggacgacgactactccccgtactgggtgaaccccgcccccgagcacttcatccacttcctccggcaggcccccggccagcagctggagtggctggcctggatgaacccgaccaacggggcggtgaactacgcctggtacctcaacggccgcgtcacggccacccgggaccgcagcatgaccaccgccttcctggaggtgaagtccctgcggagcgacgacacggcggtgtactactgcgcccgcgcccagaagcgggggcgctccgagtgggcctacgcccactggggccagggcacccccgtcgtggtgagctcc

SEQ ID NO: 8902 - RNA, 309 nt, synthetic construct
  misc_feature 1..309: note = derived and/or modified sequence opt1 from anti-HIV_VRC-CH32_LightChain
  source 1..309: mol_type = other RNA
gacatccagatgacccagagcccctccagcctgtccgccagcctcggcgaccgcgtgaccatcacgtgccaggcctcccgggggatcggcaaggacctgaactggtaccagcagaagccggggcgcgcgcccaagctgctcgtcagcgacgcctccatcctggagggcggggtgcccacccggttcagcggctccggcttccaccagaacttcagcctgaccatctccagcctccaggccgaggacgtggccacctacttctgccagcagtacgagacgttcgggcagggcaccaaggtcgacatcaag

SEQ ID NO: 8903 - RNA, 393 nt, synthetic construct
  misc_feature 1..393: note = derived and/or modified sequence opt1 from anti-HIV_VRC-CH32_HeavyChain
  source 1..393: mol_type = other RNA
caggtgcagctggtccagagcggcgccgccgtgcgcaagcccggggcgtccgtgaccgtcagctgcaagttcgccgaggacgacgacttctccccgcactgggtgaaccccgcccccgagcactacatccacttcctccggcaggcccccggccagcagctggagtggctggcctggatgaagccgaccaacggggcggtgaactacgcctggcagctccagggccgcgtcacggtgacccgggaccgcagccagaccaccgccttcctggaggtgaagaacctgcggtccgacgacacggccgtctactactgcgcgcgcgcccagaagcgggggcgcagcgagtgggcctacgcccactggggccagggcacccccgtggtgatctccgcc

SEQ ID NO: 8904 - RNA, 309 nt, synthetic construct
  misc_feature 1..309: note = derived and/or modified sequence opt1 from anti-HIV_VRC-CH33_LightChain
  source 1..309: mol_type = other RNA
gacatccagatgacccagagcccctccagcctgtccgccagcctcggcgaccgcgtgaccatcacgtgccaggcctcccgggggatcggcaaggacctgaactggtaccagcagaagcgcgggcgggcgccgcgcctgctcgtcagcgacgcctccgtgctggagggcggggtgcccagccggttctccggcagcggcttccaccagaacttctccctgaccatcagcaccctccagcccgaggacgtcgccacctacttctgccagcagtacgagacgttcgggcagggcaccaaggtggacatcaag

SEQ ID NO: 8905 - RNA, 393 nt, synthetic construct
  misc_feature 1..393: note = derived and/or modified sequence opt1 from anti-HIV_VRC-CH33_HeavyChain
  source 1..393: mol_type = other RNA
caggtgcagctggtccagagcggcgccgccgtgcgcaagcccggggcgtccatcagcgtgtcctgcaagttcgccgacgccgacgactacagcccgcactggatgaaccccgcccccgagcactacatccacttcctccggcaggcccccggccagcagctggagtggctggcgtggatgaacccgaccaacggggccgtcaactacgcctggtacctcaacggccgcgtgaccgccacgcgggaccgctccatgaccaccgcgttcctggaggtgcggagcctgcgctccgacgacaccgccgtctactactgcgcccgggcccagaagcgcgcccggagcgagtgggcgtacgcccactgggggcagggcacgcccgtggtggtctccagc

SEQ ID NO: 8906 - RNA, 309 nt, synthetic construct
  misc_feature 1..309: note = derived and/or modified sequence opt1 from anti-HIV_VRC-CH34_LightChain
  source 1..309: mol_type = other RNA
gacatccagatgacccagagcccctccagcctgtccgccagcctcggcgaccgcgtgaccatcacgtgccaggcctcccgggggatcggcaaggacctgaactggtaccagcagaaggcggggaaggccccgaagctgctcgtcagcgacgcctccatcctggagggcggggtgcccagccgcttctccggcagcggcttccaccagaacttctccctgaccatcagctccctccagcccgaggacgtggccacctacttctgccagcagtacgagaccttcgggcagggcacgaaggtcgacatcaag

SEQ ID NO: 8907 - RNA, 393 nt, synthetic construct
  misc_feature 1..393: note = derived and/or modified sequence opt1 from anti-HIV_VRC-CH34_HeavyChain
  source 1..393: mol_type = other RNA
caggtgcagctggtccagagcggcgccgccgtgcgcaagcccggggcgtccgtgaccgtcagctgcaagttcgccgaggacgacgactggtccccgcactgggtgaaccccgcccccgagcactacatccacttcctccggcaggcccccggccagcagctggagtggctggcctggatgaacccgaccaacggggcggtgaactacgcctggcagctcaacggccgcctgacggccacccgggacaccagcatgaccacggccttcctggaggtcaagtccctccgcagcgacgacaccgcggtgtactactgcgcccgggcccagaagcgcgggcggtccgagtgggcctacgcccactggggccagggcacccccgtggtcgtgagctcc

SEQ ID NO: 8908 - RNA, 306 nt, synthetic construct
  misc_feature 1..306: note = derived and/or modified sequence opt1 from anti-HIV_VRC-PG04_LightChain
  source 1..306: mol_type = other RNA
gagatcgtgctgacccagagccccggcaccctctccctgagcccgggggagacggcctccctgagctgcaccgccgcgtcctacggccacatgacctggtaccagaagaagcccgggcagccgcccaagctcctgatcttcgccaccagcaagcgcgcctccggcatccccgaccggttcagcgggtcccagttcggcaagcagtacacgctgaccatcacccgcatggagcccgaggacttcgcccggtactactgccagcagctcgagttcttcggccaggggacccgcctggagatccggcgc

SEQ ID NO: 8909 - RNA, 375 nt, synthetic construct
  misc_feature 1..375: note = derived and/or modified sequence opt1 from anti-HIV_VRC-PG04_HeavyChain
  source 1..375: mol_type = other RNA
caggtgcagctggtccagagcggctccggggtgaagaagcccggcgccagcgtgcgcgtctcctgctggaccagcgaggacatcttcgagcggaccgagctcatccactgggtgcgccaggccccggggcagggcctggagtggatcgggtgggtgaagacggtcaccggcgcggtgaacttcggctcccccgacttccggcagcgcgtgagcctgacccgggaccgcgacctcttcaccgcccacatggacatccgggggctgacgcagggcgacaccgccacctacttctgcgcccgccagaagttctacaccgggggccaggggtggtacttcgacctgtggggccggggcacgctcatcgtcgtgtccagc

SEQ ID NO: 8910 - RNA, 303 nt, synthetic construct
  misc_feature 1..303: note = derived and/or modified sequence opt1 from anti-HIV_VRC-PG04b_LightChain
  source 1..303: mol_type = other RNA
gagatcgtgctgacccagagccccggcaccctctccctgagcccgggggagacggcctccctgagctgcaccgccgcgtcctacggccacatgacctggtaccagaagaagcccgggcagccgcccaagctcctgatcttcgccaccagcaagcgcgcctccggcatccccgaccggttcagcgggtcccagttcggcaagcagtacacgctgaccatcacccgcatggagcccgaggacttcgccggctactactgccagcaggtcgagttcttcgggcagggcacccggctcgagatccgc

SEQ ID NO: 8911 - RNA, 375 nt, synthetic construct
  misc_feature 1..375: note = derived and/or modified sequence opt1 from anti-HIV_VRC-PG04b_HeavyChain
  source 1..375: mol_type = other RNA
caggtgcagctggtccagagcggctccggggtgaagaagcccggcgccagcgtgcgcgtctcctgctggaccagcgaggacatcttcgagcggaccgagctcatccactgggtgcgccaggccccggggcagggcctggagtggatcgggtgggtgaagacggtcaccggcgcggtgaacttcggctcccccaacttccggcaccgcgtgagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtcgtgtccagc

SEQ ID NO: 8912 - RNA, 612 nt, synthetic construct
  misc_feature 1..612: note = derived and/or modified sequence opt1 from anti-HIV_VRC-PG20_LightChain
  source 1..612: mol_type = other RNA
cagagcgccctgacccagcccccgtccgtgagcggctcccccgggcagagcatcaccctctcctgcacgggcgccagcacctccgtcgcgtggtaccagcagtacgccgacaaggcgccccgcctgatcgtgttcgacgggaacaagcggcccagcgacatctccagccgcttctccggcagccagtccgggggcaccgccagcctgaccatctccggcctccagagcgaggacgaggcctactaccactgcaacgccttcgagttcttcgggggcgggacgaagctgaccgtgctgtcccagccgaaggccgcccccagcgtcaccctcttcccgccctccagcgaggagctgcaggccaacaaggcgaccctggtgtgcctcatcagcgacttctaccccggcgccgtgacggtcgcctggaaggccgactccagccccgtgaaggccggggtggagaccaccaccccctccaagcagagcaacaacaagtacgcggcctccagctacctgtccctgacgcccgagcagtggaagtcccacaagagctacagctgccaggtcacccacgagggctccaccgtggagaagaccgtggccccgacggagtgc

SEQ ID NO: 8913 - RNA, 681 nt, synthetic construct
  misc_feature 1..681: note = derived and/or modified sequence opt1 from anti-HIV_VRC-PG20_HeavyChain
  source 1..681: mol_type = other RNA
gaggtgcacctgatgcagagcggcaccgagatgaagaagcccggggcctccgtccgcgtgacctgccagacgagcggctacaccttctccgactacttcatccactggctccgccaggtgccggggcggggcttcgagtggatggggtggatgaacccccagtggggccaggtcaactacgcccggaccttccagggccgcgtgaccatgacgcgggacgtgtaccgcgaggtcgcgtacctggacctgcggagcctcaccttcgccgacaccgccgtgtacttctgcgcccgccggatgcgctcccaggaccgggagtgggacttccagcactgggggcagggcacccgcatcatcgtgagctccgccagcacgaaggggccctccgtcttccccctggcgccgagctccaagagcacctccggcgggaccgccgccctgggctgcctcgtgaaggactacttccccgagcccgtgaccgtcagctggaactccggcgccctgacgagcggggtgcacaccttccccgcggtgctgcagtccagcggcctctactccctgagcagcgtcgtgaccgtgccgtccagctccctggggacccagacgtacatctgcaacgtcaaccacaagcccagcaacaccaaggtggacaagaaggtggagcccaagtcctgcgacaag

SEQ ID NO: 8914 - RNA, 1059 nt, synthetic construct
  misc_feature 1..1059: note = derived and/or modified sequence opt1 from anti-HIV_VRC-PG20_G-Chain
  source 1..1059: mol_type = other RNA
gtgtggaaggacgccgacaccaccctgttctgcgccagcgacgcgaaggcccacgagacggaggtccacaacgtgtgggccacccacgcctgcgtgcccaccgaccccaacccccaggagatccacctcgagaacgtcaccgagaacttcaacatgtggaagaacaacatggtggagcagatgcaggaggacgtgatctccctgtgggaccagagcctgcagccctgcgtcaagctcacgggcgggtccgtgatcaagcaggcctgccccaagatcagcttcgacccgatccccatccactactgcacccccgcgggctacgtgatcctgaagtgcaacgacaagaacttcaacgggaccggcccctgcaagaacgtctccagcgtgcagtgcacccacgggatcaagccggtggtctccacgcagctgctcctgaacggcagcctggccgaggaggagatcatcatccgctccgagaacctcaccaacaacgccaagaccatcatcgtgcacctgaacaagagcgtggagatcaactgcacccggccctccaacggcgggagcggctccgggggcgacatccgcaaggcctactgcgagatcaacgggacgaagtggaacaaggtcctgaagcaggtcaccgagaagctcaaggagcacttcaacaacaagaccatcatcttccagccgcccagcggcggcgacctggagatcaccatgcaccacttcaactgccgcggggagttcttctactgcaacacgacccagctgttcaacaacacgtgcatcggcaacgagaccatgaaggggtgcaacggcaccatcaccctcccctgcaagatcaagcagatcatcaacatgtggcagggcaccgggcaggcgatgtacgccccgcccatcgacggcaagatcaactgcgtgtccaacatcaccgggatcctgctgacgcgggacggcggggccaacaacaccagcaacgagaccttccggcccggcggcgggaacatcaaggacaactggcgctccgagctctacaagtacaaggtggtgcagatcgag

SEQ ID NO: 8915 - RNA, 312 nt, synthetic construct
  misc_feature 1..312: note = derived and/or modified sequence opt1 from anti-HIV_VRC02_LightChain
  source 1..312: mol_type = other RNA
gagatcgtgctgacccagagccccggcaccctctccctgagcccgggggagacggccatcatctcctgccgcaccagccagtacggctccctggcctggtaccagcagcggcccgggcaggcgccccgcctcgtgatctacagcggctccacccgggccgccgggatccccgaccgcttcagcggctcccggtggggcccggactacaacctgaccatccgcaacctggagagcggggacttcggcctctactactgccagcagtacgagttcttcgggcagggcacgaaggtccaggtggacatcaagcgg

SEQ ID NO: 8916 - RNA, 363 nt, synthetic construct
  misc_feature 1..363: note = derived and/or modified sequence opt1 from anti-HIV_VRC02_HeavyChain
  source 1..363: mol_type = other RNA
caggtgcagctggtccagagcggcgggcagatgaagaagcccggcgagtccatgcgcatcagctgccaggcctccgggtacgagttcatcgactgcaccctcaactgggtgcggctggccccgggccgccggcccgagtggatggggtggctgaagccccgcggcggcgcggtgaactacgcccggcccctccaggggcgcgtcaccatgacgcgggacgtgtacagcgacaccgccttcctggagctgcgctccctcaccgccgacgacaccgccgtgtactactgcacgcggggcaagaactgcgactacaactgggacttcgagcactgggggcgcggcaccccggtcaccgtgagctcc

SEQ ID NO: 8917 - RNA, 309 nt, synthetic construct
  misc_feature 1..309: note = derived and/or modified sequence opt1 from anti-HIV_VRC03_LightChain
  source 1..309: mol_type = other RNA
gagatcgtgctgacccagagccccggcatcctctccctgagcccgggggagaccgccacgctgttctgcaaggcctcccagggcgggaacgcgatgacctggtaccagaagcgccggggccaggtcccccgcctcctgatctacgacaccagccggcgcgcctccggggtgcccgaccggttcgtgggcagcggctccgggaccgacttcttcctgacgatcaacaagctcgaccgcgaggacttcgccgtctactactgccagcagttcgagttcttcggcctggggagcgagctggaggtgcaccgg

SEQ ID NO: 8918 - RNA, 390 nt, synthetic construct
  misc_feature 1..390: note = derived and/or modified sequence opt1 from anti-HIV_VRC03_HeavyChain
  source 1..390: mol_type = other RNA
caggtgcagctggtccagagcggcgccgtgatcaagacccccgggtccagcgtgaagatctcctgccgcgccagcggctacaacttccgggactactccatccactgggtccgcctcatcccggacaaggggttcgagtggatcggctggatcaagcccctgtggggcgcggtgagctacgcccggcagctgcaggggcgcgtgtccatgacccggcagctcagccaggaccccgacgaccccgactggggcgtcgcctacatggagttctccgggctgacgccggccgacaccgccgagtacttctgcgtgcgccggggcagctgcgactactgcggggacttcccctggcagtactggggccaggggaccgtggtcgtggtgtccagc

SEQ ID NO: 8919 - RNA, 630 nt, synthetic construct
  misc_feature 1..630: note = derived and/or modified sequence opt1 from anti-HIV_VRC23_LightChain
  source 1..630: mol_type = other RNA
gagatcgtgatgacccagagccccgtcaccgtgtccgtgagccggggcgggacggccaccctgtcctgccgggccagccagggcgtcgggtccgacgtggcgtggtaccagcacaagccgggccagacgccccgcctcctgatctacggggccagcacccgggcctccggcgtgcccgagcgcttcagcggctccgggttccacgtcgacttcaccctgagcatctccggcctccagcccgaggacgtggccatctactactgccagcagtacgagaccttcgggcagggcaccaaggtggagatcaagcggaccgtcgccgcgccgagcgtgttcatcttcccgccctccgacgagcagctcaagagcgggacggcctccgtggtctgcctgctgaacaacttctacccccgcgaggccaaggtgcagtggaaggtggacaacgccctgcagagcggcaactcccaggagagcgtcaccgagcaggactccaaggacagcacctacagcctgtccagcaccctcacgctgtccaaggcggactacgagaagcacaaggtgtacgcctgcgaggtgacccaccagggcctgagctcccccgtcaccaagagcttcaaccgcggggagtgc

SEQ ID NO: 8920 - RNA, 672 nt, synthetic construct
  misc_feature 1..672: note = derived and/or modified sequence opt1 from anti-HIV_VRC23_HeavyChain
  source 1..672: mol_type = other RNA
gaggtgcagttcgtccagagcggcgccgaggtgaagaagcccggggcctccgtgcgcgtcagctgcgaggcgtccggctacagcttcaccgactacgtgctgcagtggatccggcaggccccggggcagcgccccgagtggatgggctggatcaagcccgagcgcggggccgtgtcctacgcgccccagttccagggccggctcaccctgacgcgggacctgtacaccgagaccgcctacatgcacttcaagaacctccgcagcgacgacaccgccatctactactgcgcccggggcgtccgccgggacgcctcctggtggctgcagttctgggggcagggcacgctggtgaccgtgagctccgccagcaccaaggggccgtccgtcttccccctcgcgcccagctccaagagcacctccggcgggacggccgccctgggctgcctggtgaaggactacttccccgagccggtgaccgtcagctggaactccggcgccctcaccagcggggtgcacaccttccccgccgtgctgcagtccagcggcctgtacagcctctccagcgtcgtgacggtgccctccagctccctggggacccagacctacatctgcaacgtcaaccacaagcccagcaacaccaaggtggacaagaaggtggagccgaagtcctgc

SEQ ID NO: 8921 - RNA, 1077 nt, synthetic construct
  misc_feature 1..1077: note = derived and/or modified sequence opt1 from anti-HIV_VRC23_G-Chain
  source 1..1077: mol_type = other RNA
gtgtggcgcgacgccgacaccaccctgttctgcgccagcgacgccaaggcctacgagacggagaagcacaacgtctgggccacccacgcctgcgtgcccaccgacccgaacccccaggagatccacctcgacaacgtgaccgagaagttcaacatgtggaagaacaacatggtcgagcagatgcacacggacatcatctccctgtgggaccagagcctgaagccctgcgtgaagctcaccggcgggtccgccatcacccaggcgtgccccaaggtgagcttcgagccgatccccatccactactgcacccccgccggcttcgccatcctgaagtgcaaggacgaggggttcaacggcacggggctgtgcaagaacgtctccaccgtgcagtgcacccacggcatcaagcccgtggtcagcacccagctcctgctgaacggctccctcgccgagaagaacatcacgatccggagcgagaacatcaccaacaacgcgaagatcatcatcgtgcagctggtgcagccggtcaccatcaagtgcatccgccccaacaacgggggctccgggagcggcggggacatccggcaggcccactgcaacgtgacccgctcccggtggaacaagacgctgcaggaggtggccgagaagctccgcacctacttcggcaacaagaccatcatcttcgccaacagctccggcggggacctggagatcaccacgcacagcttcaactgcggcggggagttcttctactgcaacacctccggcctgttcaacagcacctggtacgtcaactccacctggaacgacacggacagcacccaggagtccaacgacaccatcaccctcccctgccggatcaagcagatcatcaacatgtggcagcgcgccggccaggcgatgtacgcgcccccgatccccggggtgatcaagtgcgagagcaacatcacgggcctgctgctcacccgggacgggggcaaggacaacaacgtgaacgagaccttccgccccgggggcggcgacatgcgggacaactggcgcagcgagctgtacaagtacaaggtcgtggagatcgag

SEQ ID NO: 8922 - RNA, 648 nt, synthetic construct
  misc_feature 1..648: note = derived and/or modified sequence opt1 from anti-HIV_5CCK_LightChain
  source 1..648: mol_type = other RNA
cagagcgccctgacccagcccgcctccgtgagcgcgtccccgggccagagcatcaccatctcctgcagcgggacgcgctccgacgtcggcgggtacgacttcgtgagctggtaccagcagcaccccggcaaggtgcccaagctcatcatctacgaggtcaccaagcggccctccgggatcccgcagcgcttcagcggctccaagagcggcaacaccgcctccctgaccatcagcgggctgcaggccgacgacgaggccgactactactgctgctcctacgccaactacgacaagctcatcctgggcgggggcacgaagctgaccgtgctcgggcagcccaaggcgaaccccaccgtgaccctgttcccgcccagctccgaggagctgcaggccaacaaggccacgctcgtctgcctgatcagcgacttctaccccggcgccgtgaccgtggcgtggaaggccgacggctcccccgtcaaggccggggtggagaccaccaagcccagcaagcagagcaacaacaagtacgccgcctccagctacctgtccctcacgccggagcagtggaagtcccaccggagctacagctgccaggtgacccacgagggctccaccgtcgagaagaccgtggcgcccacggagtgcagc

SEQ ID NO: 8923 - RNA, 696 nt, synthetic construct
  misc_feature 1..696: note = derived and/or modified sequence opt1 from anti-HIV_5CCK_HeavyChain
  source 1..696: mol_type = other RNA
caggtgcagctggtccagagcggcgccgagatgaaggaccccggggcctccgtgaaggtgagctgccgcgcgtccggctacaagttcaccgactactacatgcactgggtccggcaggccccggggcagggcctcgagtgggtggggtgggtgaacaccaacggcggcttcacgaagtacggggccaagttccagggccgcgtcaccgtgacccgggacaccagcacgaacaccgtgttcctggagctgtcccgcctcaccttcggggacaccgccatgtacttctgcgcccggcccatgcgccccgtcagccacggcatcgactactccgggctgttcgtgttccagttctggggccggggcacgatggtgaccgtcagctccgcgagcaccaaggggccctccgtgttcccgctggcccccagctccaagagcacctccggcgggacggccgccctcggctgcctggtgaaggactacttccccgagcccgtcaccgtgagctggaactccggcgcgctgaccagcggggtgcacaccttcccggccgtcctccagtccagcggcctgtacagcctgtccagcgtggtgacggtcccctccagctccctcgggacccagacctacatctgcaacgtgaaccacaagcccagcaacaccaaggtggacaagaaggtcgagcccaagtcctgcgac

SEQ ID NO: 8924 - RNA, 648 nt, synthetic construct; identical to SEQ ID NO: 8800
  misc_feature 1..648: note = derived and/or modified sequence opt1 from anti-HIV_5AWN_LightChain
  source 1..648: mol_type = other RNA

SEQ ID NO: 8925 - RNA, 696 nt, synthetic construct
  misc_feature 1..696: note = derived and/or modified sequence opt1 from anti-HIV_5AWN_HeavyChain
  source 1..696: mol_type = other RNA
caggtgcagctgatgcagagcggcgcccagctccgcgaccccggggactccctgaagatcagctgcaaggcctccggctacaacttcatcgactaccacatccactgggtccggctggcgccggggcgcggcctcgagtggatggggtggatcgaccccgtgggcggcatcaccaagtacgccgggcagttccagggccggctgagcctgacccgcgacacgtccaccaacaccctcttcctggagctgagccggctcaccgccggggacacggccgtgtacttctgcgcccgctccatgcggcccgtcgaccacggcatcgactacagcgggctgttcgtgttccacttctggggccgcggctccgacgtgctggtcagctccgcgagcaccaaggggccctccgtgttcccgctcgcccccagctccaagagcacctccggcgggaccgccgccctgggctgcctggtgaaggactacttccccgagcccgtcacggtgagctggaactccggcgcgctcaccagcggggtgcacaccttcccggccgtcctgcagagctccggcctgtacagcctctccagcgtggtgaccgtcccctccagctccctggggacgcagacctacatctgcaacgtgaaccacaagcccagcaacaccaaggtggacaagaaggtcgagcccaagtcctgcgac

SEQ ID NO: 8926 - RNA, 645 nt, synthetic construct
  misc_feature 1..645: note = derived and/or modified sequence opt1 from anti-HIV_3QEG_LightChain
  source 1..645: mol_type = other RNA
gagatcgtgatgatgcagagccccggcaccctgtccctcagcccgggggagcgcgccaccctgtcctgccgggccagccagtccgtcagctccagctacctggcgtggtaccagcagaagcccggccaggcgccccgcctcctgatctacggggcctccagccgggccacgggcatccccgaccgcttctccgggagcggctccggcaccgacttcaccctgaccatcagccggctcgagccggaggacttcgccgtgtactactgccagcagtacgggtccagccccgagacgttcggccaggggaccaaggtggagatcaagcgcaccgtcgccgccccctccgtgttcatcttcccgcccagcgacgagcagctgaagtccggcaccgccagcgtggtctgcctgctcaacaacttctacccccgggaggccaaggtgcagtggaaggtggacaacgcgctgcagagcgggaactcccaggagagcgtcacggagcaggactccaaggacagcacctactccctgagctccaccctcaccctgagcaaggccgactacgagaagcacaaggtgtacgcctgcgaggtgacgcaccagggcctgtccagccccgtcaccaagtccttcaaccgcggcgagtgc

SEQ ID NO: 8927 - RNA, 717 nt, synthetic construct
  misc_feature 1..717: note = derived and/or modified sequence opt1 from anti-HIV_3QEG_HeavyChain
  source 1..717: mol_type = other RNA
caggtgcagctggtccagagcggcgccgaggtgaagaagcccgggtccagcgtgaaggtctcctgccgcgccagccggggcaccttctccagctacgggatcacctgggtgcgccaggcgccgggccaggggctcgagtggatgggcggcatcatccccatcttcgacgtgacgaactacgcccagaacttccaggggcgggtcgccatcaccaccgacgccgagatgtccaccgcctacatggagctgcgcagcctgaagtccgaggacagcgcggtgtactactgcgcctccgacagccgggacttctcctactacgagcccggcacgagctactcccactactacaacatcatggacgtgtgggggcagggcaccaccgtcaccgtgagctccgccagcacgaaggggccctccgtgttcccgctcgcccccagcagcaagtccaccagcggcggcaccgcggccctggggtgcctggtcaaggactacttccccgagcccgtgaccgtgtcctggaacagcggcgccctcacgtccggggtccacaccttcccggccgtgctgcagagctccggcctgtacagcctctccagcgtggtcaccgtgccctccagctccctgggcacccagacgtacatctgcaacgtgaaccacaagcccagcaacaccaaggtcgacaagcgcgtggagcccaagtcctgcgacaagacccac

SEQ ID NO: 8928 - RNA, 690 nt, synthetic construct
  misc_feature 1..690: note = derived and/or modified sequence opt1 from anti-HIV_1N0X_K-Chain
  source 1..690: mol_type = other RNA
caggtgcagctggtccagagcggcgccgaggtgaagaagccgggggcctccgtgaaggtcagctgccaggcgtccggctaccgcttcagcaacttcgtgatccactgggtgcggcaggccccggggcagcgcttcgagtggatgggctggatcaacccctacaacgggaacaaggagttctccgccaagttccaggaccgggtcaccttcaccgccgacacgagcgccaacaccgcgtacatggagctccgctccctgcggagcgccgacaccgccgtgtactactgcgcccgcgtgggcccctactcctgggacgacagcccccaggacaactactacatggacgtctggggcaaggggaccacggtgatcgtgtccagcgcgtccaccaagggcccgagcgtcttccccctggccccctccagcaagtccaccagcgggggcaccgccgccctcgggtgcctggtgaaggactacttccccgagccggtgacggtctcctggaacagcggcgccctgaccagcggcgtgcacaccttccccgcggtgctccagtccagcgggctgtactccctgagctccgtcgtgaccgtgcccagctccagcctcggcacgcagacctacatctgcaacgtcaaccacaagccctccaacaccaaggtggacaagaaggtggagcccaagagctgc

SEQ ID NO: 8929 - RNA, 645 nt, synthetic construct
  misc_feature 1..645: note = derived and/or modified sequence opt1 from anti-HIV_1N0X_M-Chain
  source 1..645: mol_type = other RNA
gagatcgtgctgacccagagccccggcaccctctccctgagcccgggggagcgcgccacgttctcctgccggagctcccacagcatccgctcccggcgcgtcgcctggtaccagcacaagcccggccaggcgccccggctggtgatccacggggtgagcaaccgcgcctccggcatcagcgaccggttctccgggagcggctccggcaccgacttcaccctcaccatcacgcgcgtcgagcccgaggacttcgccctgtactactgccaggtgtacggggccagctcctacaccttcggccaggggaccaagctggagcggaagcgcaccgtggccgcgccgagcgtcttcatcttcccgccctccgacgagcagctcaagagcggcacggcctccgtggtgtgcctgctgaacaacttctacccccgggaggccaaggtccagtggaaggtggacaacgccctccagagcgggaacagccaggagtccgtgaccgagcaggacagcaaggactccacctacagcctgtccagcaccctgacgctctccaaggcggactacgagaagcacaaggtctacgcctgcgaggtgacccaccagggcctgcgcagccccgtgaccaagtccttcaaccggggcgagtgc

SEQ ID NO: 8930 - RNA, 654 nt, synthetic construct
  misc_feature 1..654: note = derived and/or modified sequence opt1 from anti-HIV_3QEH_HeavyChain
  source 1..654: mol_type = other RNA
gacatcgtgatgacccagagccccctgtccctcccggtcacccccggcgaggccgccagcatctcctgccgcagctcccagagcctgctgcacacgaacgggttccagtacctcgactggtacctgcagaagcccggccagagcccccagctgctcatctacctggggtccaaccgggcgaccggcgtgccgcaccgcttctccgggagcggctccggcaccgagttcaccctgaagatcagccgggtggaggccgaggacgtcggggtgtactactgcatgcaggccaaggagtcccccacgttcggccaggggaccaaggtggagatcaagcgcaccgtcgccgcccccagcgtgttcatcttcccgccctccgacgagcagctcaagagcggcaccgcgtccgtggtctgcctgctgaacaacttctacccccgggaggccaaggtgcagtggaaggtggacaacgccctccagagcgggaactcccaggagagcgtcacggagcaggacagcaaggactccacctacagcctgtccagcaccctgaccctctccaaggccgactacgagaagcacaaggtgtacgcgtgcgaggtgacgcaccagggcctgagctcccccgtcaccaagagcttcaaccgcggcgagtgc

SEQ ID NO: 8931 - RNA, 696 nt, synthetic construct
  misc_feature 1..696: note = derived and/or modified sequence opt1 from anti-HIV_3QEH_G-Chain
  source 1..696: mol_type = other RNA
caggtgcagctggtccagagcggcgccgaggtgcgcaagcccggggcctccgtgaccgtcagctgcaagacctccggctacacgttcgtgaacttctacatcgtgtgggtccggcaggcgccggggcagggcctcgagtggatgggggtgatcaaccccttccgcggcgacacctacttcgcccagaagttcaagggccgggtgaccctgacccgcgacacgagcacctccaccgtcttcatggagctgagctccctccggagcgacgacaccgccatctactactgcgcccgcgacctggagatgcgggacgggaacaaccacggctcccacctggagttctgggggcagggcacgctcgtgaccgtgagctccgccagcaccaaggggccctccgtcttccccctggcgccgagctccaagagcacctccggcggcacggccgccctggggtgcctcgtgaaggactacttccccgagcccgtgaccgtcagctggaactccggcgccctgaccagcggggtgcacaccttccccgcggtgctgcagagctccggcctctacagcctgtccagcgtcgtgacggtgccgtccagctccctgggcacccagacctacatctgcaacgtcaaccacaagcccagcaacaccaaggtggacaagcgcgtggagcccaagtcctgcgacaagacgcac

SEQ ID NO: 8932 - RNA, 678 nt, synthetic construct
  misc_feature 1..678: note = derived and/or modified sequence opt1 from anti-HIV_2B1H_HeavyChain
  source 1..678: mol_type = other RNA
gagatccagctggagcagagcggcgccgaggtgaagaagtccggggagagcctcaagatctcctgccagaccagcggctactccttcagcgactactggatcgggtgggtccgccagatgcccggcaaggggctggagtggatgggcatcttctacccgggcgactccgacagccggtactcccccagcttcgaggggcaggtcaccatgtccgccgaccgcagcacgaacaccgcgcacctccagtggtccagcctgaagccctccgacaccgccctgtactactgcgcccggctgggcggggactacgaggacagcggcgccgacgccttcgacttctgggggcagggcaccctcgtgacggtgtccagcgcgtccaccaagggccccagcgtgttcccgctggcccccagctccaagagcacctccgggggcaccgccgccctggggtgcctcgtgaaggactacttccccgagcccgtcacggtgagctggaactccggcgcgctgaccagcggcgtgcacaccttcccggccgtcctgcagtccagcgggctctactccctgagctccgtggtgaccgtccccagctccagcctgggcacgcagacctacatctgcaacgtgaaccacaagccctccaacaccaaggtggacaagaaggtcgagcccaagagc

SEQ ID NO: 8933 - RNA, 645 nt, synthetic construct
  misc_feature 1..645: note = derived and/or modified sequence opt1 from anti-HIV_2B1H_LightChain
  source 1..645: mol_type = other RNA
cagagcgtgctgacccagcccccgtccgccagcggcacccccgggcagcggatctccatcagctgctccggcacgagctccaacgtcgagaacaactacgtgtactggtaccagcacctccccgggaccgcccccaagctgctgatctaccggaacgaccaccgcagctccggcatcccggaccggttcagcgcgtccaagagcgggacctccgccagcctcgccatctccggcctgcgccccgaggacgagggcgactactactgcgccgcctgggacgacagccgcgggggccccgactgggtgttcgggggcgggaccaagctgacggtcctcgcgcagcccaaggccgccccgtccgtgaccctgttcccgcccagctccgaggagctgcaggccaacaaggcgaccctcgtgtgcctgatcagcgacttctaccccggcgccgtcaccgtggcctggaaggccgacagctcccccgtgaaggccggcgtcgagacgaccacccccagcaagcagtccaacaacaagtacgcggccagctcctacctgagcctcacccccgagcagtggaagtcccacaagagctactcctgccaggtgacgcacgaggggagcaccgtggagaagaccgtcgcccccacc

SEQ ID NO: 8934 - RNA, 648 nt, synthetic construct
  misc_feature 1..648: note = derived and/or modified sequence opt1 from anti-HIV_3TNM_B-Chain
  source 1..648: mol_type = other RNA
cagagcgtgctgacccagcccccgtccgccagcggctcccccgggcagagcgtcaccatctcctgcacgggcaccagctccgacgtcgggggctacaactacgtgagctggtaccagcaccaccccgggaaggcccccaagctcatcatctccgaggtgaacaaccgcccgagcggcgtgcccgaccggttctccggcagcaagtccgggaacaccgcgagcctgaccgtgtccggcctgcaggccgaggacgaggccgagtactactgcagctcctacacggacatccacaacttcgtcttcgggggcgggaccaagctcaccgtgctgggccagcccaaggccgcccccagcgtgaccctgttcccgccctccagcgaggagctccaggcgaacaaggccacgctggtctgcctgatcagcgacttctaccccggcgccgtgaccgtggcctggaaggcggactccagccccgtcaaggccggggtggagaccaccacgccgtccaagcagagcaacaacaagtacgccgcctccagctacctctccctgacccccgagcagtggaagtcccaccgcagctacagctgccaggtgacccacgagggctccaccgtcgagaagacggtggcccccaccgagtgcagc

SEQ ID NO: 8935 - RNA, 693 nt, synthetic construct
  misc_feature 1..693: note = derived and/or modified sequence opt1 from anti-HIV_3TNM_A-Chain
  source 1..693: mol_type = other RNA
caggtgcagctgcaggagagcggccccgggctcgtcaagccgtcccagaccctgagcctgtcctgcaccgtgagcggcgggtccagctccagcggcgcccactactggtcctggatccgccagtaccccgggaagggcctcgagtggatcggctacatccactacagcgggaacacgtactacaacccctccctcaagagccggatcaccatctcccagcacaccagcgagaaccagttctccctgaagctgaacagcgtgaccgtcgccgacacggcggtgtactactgcgcccgcggcacccggctgcgcaccctgcggaacgccttcgacatctgggggcagggcaccatggtgacggtctccagcgcctccaccaaggggcccagcgtgttcccgctcgcccccagctccaagagcacctccggcggcaccgcggccctggggtgcctggtgaaggactacttccccgagcccgtcacggtgagctggaactccggcgccctcaccagcggggtgcacaccttcccggccgtcctgcagtccagcggcctgtactccctcagctccgtggtgaccgtccccagctccagcctgggcacgcagacctacatctgcaacgtgaaccacaagccctccaacaccaaggtggacaagcgcgtcgagcccaagagctgcgacaagacccacacg

SEQ ID NO: 8936 - RNA, 690 nt, synthetic construct
  misc_feature 1..690: note = derived and/or modified sequence opt1 from anti-HIV_3UJJ_HeavyChain
  source 1..690: mol_type = other RNA
gaggtgcagctggtccagagcggcgccgaggtgaagaagcccggggagtccctcaagatcagctgcaaggcctccggctacagcttctccagctactggatcgcgtgggtgcgccagatgccggggaagggcctggagtggatggggttcatctaccccgccgactccgacacccggtacagcccctccttccagggccagggcaccatcagcgccgacaagtccatcagcacggcctacctgcagtggtccagcctcaaggcctccgacaccgcgatgtactactgcgccatcctggggttctggggcgccaaccgcgggggcgggggcatggacgtctggggccaggggaccaccgtgatcgtgagctccgccagcacgaagggcccctccgtcttcccgctggcgcccagcagcaagtccaccagcgggggcaccgccgccctcggctgcctggtgaaggactacttccccgagcccgtgaccgtctcctggaacagcggggccctgacgtccggcgtgcacaccttcccggccgtgctccagagctccgggctgtacagcctgtccagcgtcgtgaccgtgccctccagctccctcggcacccagacgtacatctgcaacgtcaaccacaagcccagcaacaccaaggtggacaagaaggtggagcccaagtcctgcgacaagacc

SEQ ID NO: 8937 - RNA, 639 nt, synthetic construct
  misc_feature 1..639: note = derived and/or modified sequence opt1 from anti-HIV_3UJJ_LightChain
  source 1..639: mol_type = other RNA
agctacgagctgacccagcccccgtccgtgagcgtctcccccggccagaccgcccgcatcacgtgcagcggggacgccctccccgagaagtacgcgtactggtaccagcagaagtccggccaggcccccgtgctgatcatctacgaggacagcaagcggccgtccgggatccccgagcgcttcagcggctcccggagcgggaccatggccaccctgaccatctccggcgcccaggtggacgacgaggccgactactactgctacagcacgaactccggcgggaccttcttcgtcttcggcaccgggaccaaggtgacggtgctcggccagcccaaggcgaaccccaccgtcaccctgttcccgcccagctccgaggagctgcaggccaacaaggccaccctcgtgtgcctgatcagcgacttctaccccggggccgtgacggtcgcgtggaaggccgactccagccccgtgaaggccggcgtggagaccaccaccccgtccaagcagagcaacaacaagtacgccgccagctcctacctgagcctcacgcccgagcagtggaagtcccaccgcagctactcctgccaggtcacccacgagggcagcaccgtggagaagaccgtggcgcccacggagtgc

SEQ ID NO: 8938 - RNA, 669 nt, synthetic construct
  misc_feature 1..669: note = derived and/or modified sequence opt1 from anti-HIV_3UJI_HeavyChain
  source 1..669: mol_type = other RNA
caggtgcagctggtccagagcgccgccgaggtgaagaagcccggcgaggcgctcaagatctcctgcaaggggagcggctactccttcagcaactactggatcgcctgggtgcgccagatgccggggaagggcctggagtggatggggatcgtctaccccgacgactccgacagctcctacaacagctccttccagggccagatcaccttcagcgccgacaagtccatcagcaccgcctacctgcactggacgtccctccaggccagcgacaccgcgatgtactactgcgcccggctgggcttcgagggggactactccggcagcttcttcgactactgggggcagggcaccctgctcatcgtgtccagcgcctccaccaaggggcccagcgtgttccccctggccccgagctccaagagcacgtccggcggcaccgcggccctggggtgcctcgtcaaggactacttccccgagcccgtgaccgtgagctggaactccggcgccctgaccagcggggtccacacgttccccgccgtgctgcagtccagcggcctctactccctgagctccgtggtcaccgtgccgagctccagcctgggcacccagacctacatctgcaacgtgaaccacaagccctccaacacgaaggtcgacaagaaggtggagccc

SEQ ID NO: 8939 - RNA, 627 nt, synthetic construct
  misc_feature 1..627: note = derived and/or modified sequence opt1 from anti-HIV_3UJI_LightChain
  source 1..627: mol_type = other RNA
agctacgagctgacccagcccccgtccgtgagcgtctcccccggccagaccgccagcatcacgtgctccggggacatcctcggcgacaagtacgtgagctggtaccagcagaagtccgggcagagccccctgctggtgatctacgaggacaccaagcgcccctccggcatcccggaccggttcagcgggtccaagagcggcaacaccgccaccctcacgatctccggcacccaggcgatggacgaggccgactactactgccaggcctgggacagcaccctgggggtcgtgttcggcgggggcaccaaggtgacggtcctggggcagcccaaggccgccccctccgtgaccctcttcccgcccagctccgaggagctgcaggcgaacaaggccaccctggtgtgcctcatcagcgacttctaccccggcgccgtcaccgtggcctggaaggcggactccagccccgtgaaggccggcgtcgagacgaccacccccagcaagcagtccaacaacaagtacgccgccagctcctacctgagcctgaccccggagcagtggaagtcccacaagagctactcctgccaggtgacgcacgaggggagcaccgtggagaagaccgtcgccccc

SEQ ID NO: 8940 - RNA, 666 nt, synthetic construct
  misc_feature 1..666: note = derived and/or modified sequence opt1 from anti-HIV_2QSC_HeavyChain
  source 1..666: mol_type = other RNA
caggtgcagctggtccagagcggcgggggcctcgtgcagcccgggggctccctgcgcctgagctgcgccgccttcgggttcaacttctccagctacgtgatgcactgggtccggcaggcgccgggccagggcctcgagtacctgtccgccatcagctccgacggggagaccacctaccacgccaacagcgtgaagggccgcttcacgtccagccgggacaactccaagaacaccctgttcctccagatggggagcctgcgcaccgaggacgtggccgtctactactgcgcccgggaccgctactacgagacctccggcagcaacgcgttcgacgtgtgggggcagggcacgatggtggtcgtgtccagcgcctccaccaagggccccagcgtgttccccctggccccctgctcccggagcaccagcgagtccaccgccgcgctcgggtgcctggtcaaggactacttcccggagcccgtgacggtgagctggaactccggcgccctgaccagcggggtccacaccttccccgccgtgctccagtccagcggcctgtactccctgagctccgtggtcaccgtgcccagctccaacttcggcacgcagacctacacgtgcaacgtggaccacaagccgagcaacaccaaggtcgacaagaccgtggag

SEQ ID NO: 8941 - RNA, 645 nt, synthetic construct
  misc_feature 1..645: note = derived and/or modified sequence opt1 from anti-HIV_2QSC_LightChain
  source 1..645: mol_type = other RNA
aacagcgtgctgacccagtcccccagctccctcagcgcctccgtcggcgaccgcgtgaccatcacgtgccaggccagccaggacatctccaactacctgaactggtaccagcacaagccggggaaggcgcccaagctgctcatctacaccgccagcaacctggagaccggcgtgccctcccggttcagcgggggcgggtccggcacccacttcagcttcacgatcacctccctgcagcccgaggacgccgccacctacttctgccagcagtacgacaacctcggcgacctgagcttcgggggcgggaccaaggtcgagatcaagcgcacggtggccgcgccgtccgtgttcatcttcccgcccagcgacgagcagctgaagtccggcaccgccagcgtcgtgtgcctcctgaacaacttctacccccgggaggccaaggtgcagtggaaggtcgacaacgccctgcagtccgggaacagccaggagagcgtgaccgagcaggactccaaggacagcacctactccctcagctccacgctgaccctgagcaaggcggactacgagaagcacaaggtgtacgcctgcgaggtcacccaccagggcctctccagccccgtgaccaagtccttcaaccgcggcgagtgc

SEQ ID NO: 8942 - RNA, 690 nt, synthetic construct
  misc_feature 1..690: note = derived and/or modified sequence opt1 from anti-HIV_3MLZ_HeavyChain
  source 1..690: mol_type = other RNA
caggtgcagctgcaggagagcggccccgggctcgtcaagccgtccgagaccctgagcctgacctgcacggtgtccggcgggagcatctccggcttccactggagctggatccgccagccgcccgggaagggcctcgagtacatcggctacatctactactccgggagcacctcctacaaccccagcctgaagtcccgggtgagcatgtccgtcgacaccagccgcaaccagttctccctggagctcagctccgtgaccgccgccgacacggcggtgtactactgcgcccgggacttcggcgagtaccactacgacgggcgcggcttccagtgcgaggggttcgacctgtggggccagggcaccctggtcaccgtgagctccgccagcaccaaggggcccagcgtgttccccctcgccccctccagcaagtccacgagcggcgggaccgccgcgctgggctgcctggtcaaggactacttccccgagccggtgaccgtgtcctggaacagcggcgccctcacctccggggtccacacgttccccgccgtgctgcagagctccggcctgtacagcctctccagcgtggtcaccgtgccctccagctccctggggacccagacctacatctgcaacgtgaaccacaagcccagcaacacgaaggtcgacaagaaggtggagccgaagtcctgc

SEQ ID NO: 8943 - RNA, 642 nt, synthetic construct
  misc_feature 1..642: note = derived and/or modified sequence opt1 from anti-HIV_3MLZ_LightChain
  source 1..642: mol_type = other RNA
cagagcgtgctgacccagcccccgtccgtcagcgccgcccccggccagaaggtgaccatctcctgcagcgggtccagctccaacatcggcaacaacatggtgagctggtaccagcagcaccccgggacggcgcccaagctcctgatctacgagaactccaagcgcccgagcggcatccccgaccggttctccgggagccgctccggcaccagcgccaccctgggcatcatcgggctccagaccggcgacgaggccgagtactactgcgccacgtgggacgggtccctgcggaccgtcttcggcgggggcaccaagctgaccgtgctcagccagcccaaggccgcgccctccgtgacgctgttcccgcccagctccgaggagctgcaggccaacaaggccaccctcgtctgcctgatcagcgacttctaccccggcgccgtgaccgtggcgtggaaggccgacagctcccccgtccgcgccggggtggagaccacgaccccgagcaagcagtccaacaacaagtacgccgccagctcctacctgagcctcacccccgagcagtggaagtcccaccggagctactcctgccaggtgacccacgagggcagcacggtcgagaagaccgtggcgcccaccgagtgc

SEQ ID NO: 8944 - RNA, 684 nt, synthetic construct
  misc_feature 1..684: note = derived and/or modified sequence opt1 from anti-HIV_3MLX_I-Chain
  source 1..684: mol_type = other RNA
caggtgcagctgcaggagagcggccccgggctcgtcaagccgtccgagaccctgagcctgacctgcacggtgtccggcgggagcatctccggcttccactggagctggatccgccagccgcccgggaagggcctcgagtacatcggctacatctactactccgggagcacctcctacaaccccagcctgaagtcccgggtgagcatgtccgtcgacaccagccgcaaccagttctccctggagctcagctccgtgaccgccgccgacacggcggtgtactactgcgcccgggacttcggcgagtaccactacgacgggcgcggcttccagtgcgaggggttcgacctgtggggccagggcaccctggtcaccgtgagctccgccagcaccaaggggcccagcgtgttccccctcgccccctccagcaagtccacgagcggcgggaccgccgcgctgggctgcctggtcaaggactacttccccgagccggtgaccgtgtcctggaacagcggcgccctcacctccggggtccacacgttccccgccgtgctgcagagctccggcctgtacagcctctccagcgtggtcaccgtgccctccagctccctggggacccagacctacatctgcaacgtgaaccacaagcccagcaacacgaaggtcgacaagaaggtggagccgaag

SEQ ID NO: 8945 - RNA, 633 nt, synthetic construct
  misc_feature 1..633: note = derived and/or modified sequence opt1 from anti-HIV_3MLX_M-Chain
  source 1..633: mol_type = other RNA
agcgtgctgacccagcccccgtccgtcagcgccgcccccggccagaaggtgaccatctcctgcagcgggtccagctccaacatcggcaacaacatggtgagctggtaccagcagcaccccgggacggcgcccaagctcctgatctacgagaactccaagcgcccgagcggcatccccgaccggttctccgggagccgctccggcaccagcgccaccctgggcatcatcgggctccagaccggcgacgaggccgagtactactgcgccacgtgggacgggtccctgcggaccgtcttcggcgggggcaccaagctgaccgtgctcagccagcccaaggccgcgccctccgtgacgctgttcccgcccagctccgaggagctgcaggccaacaaggccaccctcgtctgcctgatcagcgacttctaccccggcgccgtgaccgtggcgtggaaggccgacagctcccccgtccgcgccggggtggagaccacgaccccgagcaagcagtccaacaacaagtacgccgccagctcctacctgagcctcacccccgagcagtggaagtcccaccggagctactcctgccaggtgacccacgagggcagcacggtcgagaagaccgtggcgcccacc

SEQ ID NO: 8946 - RNA, 684 nt, synthetic construct
  misc_feature 1..684: note = derived and/or modified sequence opt1 from anti-HIV_3MLW_I-Chain
  source 1..684: mol_type = other RNA
caggtgcagctggtccagagcggcgccgaggtgaagaaggccggggagtccctcgagatcagctgcaagggctccgggtacaccttcaccgaccactggatcgcgtgggtgcgccaggtccccggcaaggggctggagtggatgggcatgatctacccgggcgacagcgacacgcggtactcccccagcctgcaggggcgcgtgaccatgtccgccgacaagaccctcagcaccgcctacctgcagtggtcccggctggaggccagcgacacggccatgtactactgcgcgcgcctccactactccgaccggagcggctcctacttcaacgacgtgttccacatgtgggggcagggcaccaccgtcaccgtgagctccgccagcacgaaggggccctccgtgttccccctggccccgagctccaagagcaccagcggcggcaccgccgcgctggggtgcctcgtcaaggactacttccccgagcccgtgaccgtgtcctggaacagcggcgccctgacgtccggggtccacaccttccccgccgtgctgcagagctccggcctctacagcctgtccagcgtggtcaccgtgccgtccagctccctgggcacccagacgtacatctgcaacgtgaaccacaagcccagcaacaccaaggtcgacaagaaggtggagcccaagtcc

SEQ ID NO: 8947 - RNA, 645 nt, synthetic construct
  misc_feature 1..645: note = derived and/or modified sequence opt1 from anti-HIV_3MLW_M-Chain
  source 1..645: mol_type = other RNA
cagagcgtgctgacccagcccccgtccgccagcggcacccccgggcagcgcgtcacgatctcctgcagcggcaactccagcaacatcgagaacaactacgtgtactggtaccagcagctccccgggtccacccccaagctgctgatcttccgggacgaccagcgcccgagcggcgtgcccgaccggttctccgggagcaagtccggcaccagcgcctccctcgcgatcagcggcctgcgctccgaggacgaggccgactactactgcgccagctgggacgactcccgcgggggccccgactacgtcttcgggaccggcacgaaggtgaccgtgctggggcagcccaaggccaacccgaccgtcaccctcttcccgcccagctccgaggagctgcaggccaacaaggcgacgctggtgtgcctcatcagcgacttctaccccggcgccgtgaccgtcgcctggaaggccgacggcagccccgtgaaggcgggggtggagaccaccaagccctccaagcagagcaacaacaagtacgccgcctccagctacctgtccctgacgcccgagcagtggaagtcccaccggagctacagctgccaggtcacccacgagggctccaccgtggagaagaccgtggcccccacg

SEQ ID NO: 8948 - RNA, 678 nt, synthetic construct
  misc_feature 1..678: note = derived and/or modified sequence opt1 from anti-HIV_3MLV_N-Chain
  source 1..678: mol_type = other RNA
gaggtgcagctggtcgagagcggcggggaggtgaagcagcccggccagtccctcaagatcagctgcaagtccagcgggtacaacttcctggactcctggatcggctgggtgcgccagatcccggggaagggcctggagtggatcggcatcatctaccccgacgacagcgacgcccactactcccccagcttcgaggggcaggtcaccatgtccgtggacaagagcatctccaccgcctacctccagtggacgaccctgcaggcgagcgacaccggcaagtacttctgcacccggctgtacctcttcgagggggcccagtccagcaacgccttcgacctgtggggccaggggacgatgatcctggtgtccagcggcaccaccaagggcccctccgtcttcccgctcgcccccagctccaagagcaccagcgggggcacggccgcgctggggtgcctggtgaaggactacttccccgagcccgtgaccgtctcctggaacagcggcgccctcacctccggcgtgcacaccttcccggccgtgctgcagagctccgggctgtacagcctctccagcgtcgtgacggtgccctccagctccctgggcacccagacctacatctgcaacgtcaaccacaagcccagcaacaccaaggtggacaagaaggtggagcccaagtcc

SEQ ID NO: 8949 - RNA, 657 nt, synthetic construct
  misc_feature 1..657: note = derived and/or modified sequence opt1 from anti-HIV_3MLV_M-Chain
  source 1..657: mol_type = other RNA
agctacctgctcacccagcccccgtccgtgagcgtctcccccggccagaccgccagcatctcctgcagcggggacaagctggacgacaagtacgtgtcctggtactaccagcgccccggccagagccccgtgctgctcatgtaccaggacttcaagcggccgtccgggatccccgagcgcctgagcggctccaagagcgggaagacggccaccctgaccatctccggcacccagagcctcgacgagggcgactactactgccaggcgtgggacgcctccacgggggtcagcggcgggggcaccaagctgaccgtgctgttcggggagggcacccggctcacggtgctggcccagcccaaggccgccccctccgtcaccctgttcccgcccagctccgaggagctccaggcgaacaaggccaccctggtgtgcctgatcagcgacttctaccccggcgccgtgaccgtcgcctggaaggcggacagctcccccgtgaaggccggggtggagacgaccaccccgagcaagcagtccaacaacaagtacgccgccagctcctacctcagcctgacccccgagcagtggaagtcccacaagagctactcctgccaggtcacgcacgagggcagcaccgtggagaagaccgtggcccccacc

SEQ ID NO: 8950 - RNA, 654 nt, synthetic construct
  misc_feature 1..654: note = derived and/or modified sequence opt1 from anti-HIV_3MLU_LightChain
  source 1..654: mol_type = other RNA
tacctgctcacccagcccccgagcgtgtccgtcagccccggccagaccgcctccatcagctgctccggggacaagctggacgacaagtacgtgagctggtactaccagcgccccggccagtcccccgtgctgctcatgtaccaggacttcaagcggccgagcgggatccccgagcgcctgtccggcagcaagtccgggaagacggccaccctgaccatcagcggcacccagtccctcgacgagggcgactactactgccaggcgtgggacgccagcacgggggtctccggcgggggcaccaagctgaccgtgctgttcggggagggcacccggctcacggtgctggcccagcccaaggccgcccccagcgtcaccctgttcccgccctccagcgaggagctccaggcgaacaaggccaccctggtgtgcctgatctccgacttctaccccggcgccgtgaccgtcgcctggaaggcggacagcagccccgtgaaggccggggtggagacgaccaccccgtccaagcagagcaacaacaagtacgccgcctccagctacctctccctgacccccgagcagtggaagtcccacaagagctacagctgccaggtcacgcacgagggctccaccgtggagaagaccgtggcccccacc

SEQ ID NO: 8951 - RNA, 657 nt, synthetic construct
  misc_feature 1..657: note = derived and/or modified sequence opt1 from anti-HIV_3MLT_G-Chain
  source 1..657: mol_type = other RNA
agctacgacctgacccagcccccgtccgtgagcgtctcccccggccagaccgccagcatctcctgcagcggggacaagctcgacgacaagtacgtgtcctggtactaccagcgccccggccagagccccgtgctgctgatgtaccaggacttcaagcggccgtccgggatccccgagcgcctcagcggctccaagagcgggaagacggccaccctgaccatctccggcacccagagcctggacgagggcgactactactgccaggcgtgggacgcctccacgggggtcagcggcgggggcaccaagctcaccgtgctgttcggggacggcacccggctgacggtgctcggccagcccaaggccgccccctccgtcaccctgttcccgcccagctccgaggagctgcaggccaacaaggcgaccctcgtgtgcctgatcagcgacttctaccccggggccgtgaccgtcgcctggaaggccgacagctcccccgtgaaggcgggcgtggagacgaccaccccgagcaagcagtccaacaacaagtacgccgccagctcctacctgagcctcacccccgagcagtggaagtcccacaagagctactcctgccaggtcacgcacgaggggagcaccgtggagaagaccgtggcccccacc

SEQ ID NO: 8952 - RNA, 666 nt, synthetic construct
  misc_feature 1..666: note = derived and/or modified sequence opt1 from anti-HIV_3GO1_HeavyChain
  source 1..666: mol_type = other RNA
gaggtgcagctgcaggagagcggccccgggctcgtcaagccgtccgagaccctgagcctgacctgcacggtgtccggcgggcccatcaacaacgcctactggacctggatccgccagccgcccggcaaggggctcgagtacctgggctacgtgtaccacaccggcgtcaccaactacaaccccagcctgaagtcccggctcacgatcaccatcgacaccagccgcaagcagctgtccctgagcctcaagttcgtgaccgccgcggactccgccgtgtactactgcgcccgggagtgggccgaggacggggacttcggcaacgccttccacgtctgggggcagggcacgatggtggcggtgagctccgccagcaccaaggggccctccgtcttccccctggcccccagctccaagagcacctccggcggcaccgccgcgctggggtgcctcgtgaaggactacttcccggagcccgtgacggtcagctggaactccggcgccctgaccagcggggtgcacaccttccccgccgtgctgcagagctccggcctctacagcctgtccagcgtcgtgaccgtgccctccagctccctgggcacgcagacctacatctgcaacgtcaaccacaagccgagcaacaccaaggtggacaagcgcgtggagccc

SEQ ID NO: 8953 - RNA, 627 nt, synthetic construct
  misc_feature 1..627: note = derived and/or modified sequence opt1 from anti-HIV_3GO1_LightChain
  source 1..627: mol_type = other RNA
agctacgtgctgacccagcccccgtccgtcagcgtgtcccccggccagaccgcccgcatcacgtgcagcgccgaggcgctctccaaccagtacgcctactggtaccggcagcgccccgggcaggcgcccctgctgatcatctacaaggacaccaagcggccgagcggcatccccgagcgcttctccgggagcacctccggcaccacggtgaccctcaccatcagcggggtccaggccgaggacgaggccgactactactgccagtccgccgacagctccggcgactacgtgttcggcgggggcaccaaggtgacggtcctggggcagcccaaggccaaccccaccgtgaccctgttcccgcccagctccgaggagctccaggccaacaaggccaccctggtgtgcctgatcagcgacttctaccccggcgcggtcacggtggcctggaaggccgacgggtcccccgtgaaggccggcgtcgagaccaccaagccgagcaagcagtccaacaacaagtacgccgcgagcagctacctctccctgacccccgagcagtggaagtcccaccggagctacagctgccaggtgacgcacgagggctccaccgtggagaagaccgtcgccccc

SEQ ID NO: 8954 - RNA, 690 nt, synthetic construct
  misc_feature 1..690: note = derived and/or modified sequence opt1 from anti-HIV_4XCY_J-Chain
  source 1..690: mol_type = other RNA
caggtgcagctggtccagagcggcgccgaggtgaagcgccccgggtccagcgtgaccgtctcctgcaaggccagcggcgggtccttcagcacctacgcgctctcctgggtgcggcaggccccgggccgcgggctggagtggatgggcggcgtgatccccctgctcacgatcaccaactacgcgccccggttccaggggcgcatcaccatcaccgccgaccggagcacgtccaccgcctacctggagctgaacagcctccgccccgaggacaccgccgtctactactgcgcccgggagggcaccacggggtggggctggctggggaagccgatcggcgccttcgcccactggggccaggggaccctggtgaccgtgtccagcgcgtccaccaagggccccagcgtcttccccctcgccccctccagcaagtccacgagcgggggcaccgccgccctgggctgcctggtgaaggactacttcccggagcccgtgaccgtctcctggaacagcggggccctcaccagcggcgtgcacacgttccccgcggtgctgcagtccagcgggctgtactccctcagctccgtcgtgaccgtgcccagctccagcctgggcacccagacctacatctgcaacgtcaaccacaagccgtccaacacgaaggtggacaagaaggtggagcccaagagctgc

SEQ ID NO: 8955 - RNA, 645 nt, synthetic construct
  misc_feature 1..645: note = derived and/or modified sequence opt1 from anti-HIV_4XCY_K-Chain
  source 1..645: mol_type = other RNA
gagatcgtgctgacccagagccccggcacccagtccctcagcccgggggagcgggccacgctgtcctgccgggccagccagtccgtcggcaacaacaagctggcgtggtaccagcagcgccccgggcaggcgccccggctcctgatctacggcgccagctcccgccccagcggggtggccgaccggttctccggcagcggctccgggaccgacttcaccctgaccatcagccgcctcgagccggaggacttcgccgtgtactactgccagcagtacggccagtccctgagcacgttcgggcagggcaccaaggtcgaggtgaagcggaccgtggccgccccctccgtcttcatcttcccgcccagcgacgagcagctgaagtccgggaccgccagcgtggtgtgcctcctgaacaacttctacccccgcgaggccaaggtccagtggaaggtggacaacgcgctgcagtccggcaacagccaggagagcgtgacggagcaggactccaaggacagcacctactccctcagctccaccctgaccctgagcaaggccgactacgagaagcacaaggtctacgcctgcgaggtgacgcaccagggcctctccagccccgtgaccaagtccttcaaccgcggggagtgc

SEQ ID NO: 8956 - RNA, 630 nt, synthetic construct
  misc_feature 1..630: note = derived and/or modified sequence opt1 from anti-HIV_4YBL_C-Chain
  source 1..630: mol_type = other RNA
gtgctgacccagcccccgagcgcctccggcagccccgggcagtccgtcaccatcagctgcacgggcacctccagcgacgtcgggggctacaactacgtgtcctggtaccagcaccaccccgggaaggcccccaagctcatcatcagcgaggtgaacaaccgcccgtccggcgtgcccgaccggttcagcggctccaagagcgggaacaccgcgtccctgaccgtgagcggcctgcaggccgaggacgaggccgagtactactgctccagctacacggacatccacaacttcgtcttcgggggcgggaccaagctcaccgtgctgggccagcccaaggccgccccctccgtgaccctgttcccgcccagctccgaggagctccaggcgaacaaggccacgctggtctgcctgatcagcgacttctaccccggcgccgtgaccgtggcctggaaggcggacagctcccccgtcaaggccggggtggagaccaccacgccgagcaagcagtccaacaacaagtacgccgccagctcctacctcagcctgacccccgagcagtggaagtcccaccgcagctactcctgccaggtgacccacgagggcagcaccgtcgagaagacggtggccccc

SEQ ID NO: 8957 - RNA, 672 nt, synthetic construct
  misc_feature 1..672: note = derived and/or modified sequence opt1 from anti-HIV_4YBL_B-Chain
  source 1..672: mol_type = other RNA
caggtgcagctgcaggagagcggccccgggctcgtcaagccgtcccagaccctgagcctgtcctgcaccgtgagcggcgggtccagctccagcggcgcccactactggtcctggatccgccagtaccccgggaagggcctcgagtggatcggctacatccactacagcgggaacacgtactacaacccctccctcaagagccggatcaccatctcccagcacaccagcgagaaccagttctccctgaagctgaacagcgtgaccgtcgccgacacggcggtgtactactgcgcccgcggcacccggctgcgcaccctgcggaacgccttcgacatctgggggcagggcaccatggtgacggtctccagcgcctccaccaaggggcccagcgtgttcccgctcgcccccagctccaagagcacctccggcggcaccgcggccctggggtgcctggtgaaggactacttccccgagcccgtcacggtgagctggaactccggcgccctcaccagcggggtgcacaccttcccggccgtcctgcagtccagcggcctgtactccctcagctccgtggtgaccgtccccagctccagcctgggcacgcagacctacatctgcaacgtgaaccacaagccctccaacaccaaggtggacaagcgcgtcgagcccaag

SEQ ID NO: 8958 - RNA, 630 nt, synthetic construct
  misc_feature 1..630: note = derived and/or modified sequence opt1 from anti-HIV_4R4N_X-Chain
  source 1..630: mol_type = other RNA
gacatccagatgacccagagcccctccttcgtgagcgcctccgtcggcgaccgcgtgaccatcacgtgccgggccagccaggggatctccagctacctggcgtggtaccagcagaagccgggcaaggcccccaagctcgtgatctacgccgcctccaccctgcagagcggggtcccctcccgcttcagcggctccgggagcggcaccgagttcaccctgacgatctccagcctccagcccgaggacttcgccacctactactgccagcacctgatcggcctgcggtccttcgggcagggcaccaagctcgagatcaagcgcaccgtggcggccccgagcgtgttcatcttcccgccctccgacgagcagctcaagagcgggacggcctccgtcgtgtgcctgctgaacaacttctacccccgggaggccaaggtgcagtggaaggtcgacaacgcgctgcagagcggcaacagccaggagtccgtgaccgagcaggacagcaaggactccacctacagcctgtccagcaccctcacgctgtccaaggccgactacgagaagcacaaggtgtacgcctgcgaggtcacccaccaggggctgagctcccccgtgaccaagagcttcaaccgc

SEQ ID NO: 8959 - RNA, 660 nt, synthetic construct
  misc_feature 1..660: note = derived and/or modified sequence opt1 from anti-HIV_4R4B_F-Chain
  source 1..660: mol_type = other RNA
caggtgcagctgcagcagtggggcgccgggctcctgaagcccagcgagaccctgtccctgacctgcggcgtctacggggagagcctctccggccactactggagctgggtgcgccagccgcccgggaagcggctggagtggatcggcgagatcaagcacaacggctcccccaactaccaccccagcctcaagtcccgcgtgacgatcagcctggacatgtccaagaaccagttcagcctgaacctcacctccgtcaccgccgcggacaccgccgtgtacttctgcgcccggcgcagcaactggccgtacctgcccttcgacccctgggggcagggcacgctggtgaccgtctccagcgcctccaccaaggggcccagcgtgttcccgctcgccccctccagcaagtccaccagcggcgggacggcggccctgggctgcctggtgaaggactacttccccgagcccgtcaccgtgagctggaactccggcgccctcaccagcggggtgcacaccttcccggccgtcctgcagtccagcggcctgtactccctcagctccgtggtgacggtccccagctccagcctggggacccagacctacatctgcaacgtgaaccacaagccctccaacaccaaggtggacaagaaggtcgagcccaag

SEQ ID NO: 8960 - RNA, 750 nt, synthetic construct
  misc_feature 1..750: note = derived and/or modified sequence opt1 from anti-HIV_3JUY_D-Chain
  source 1..750: mol_type = other RNA
caggtgcagctggtccagagcggcgccgaggtgaagaagcccggggcctccgtgaaggtcagctgccaggcgtccggctaccgcttcagccacttcaccgtgcactgggtgcggcaggccccggggcagcgcttcgagtggatgggctggatcaacccctacaacgggaacaaggagttctccgccaagttccaggaccgggtcaccttcacggccgacaccagcgccaacaccgcgtacatggagctccgctccctgcggagcgccgacaccgccgtgtactactgcgcccgcgtgggcgagtggggctgggacgactccccctacgacaactactacatggacgtctgggggaagggcacgaccgtgatcgtgagctccgggggcgggggcagcggcgggggcgggtccggcggcgggggcagcgagatcgtcctgacccaggcgcccgggaccctctccctgagcccgggcgagcgggccacgttctcctgccgcagctcccacagcatccggagccgccgggtggcctggtaccagcacaagcccgggcaggcgccccgcctggtgatccacggcgtctccaaccgggccagcggcatctccgaccgcttcagcgggtccggcagcgggaccgacttcaccctcaccatcacgcgggtggagcccgaggacttcgccctgtactactgccaggtgtacggcgcctccagctacaccttcgggcagggcaccaagctggagcgcaag

SEQ ID NO: 8961 - RNA, 369 nt, synthetic construct
  misc_feature 1..369: note = derived and/or modified sequence opt1 from anti-HIV_4KG5_HeavyChain
  source 1..369: mol_type = other RNA
cagctggtgcagagcggccccgaggccaagcgcccggggtccagcgtcaaggtgtcctgcaaggccagccgggacaccttcaacaactacgtgctcaactgggtccgccaggcgcccggccaggggctggagtggatgggcgggatcggccccatcatcgagaccgccgactacgccgagaagttccggggccgcctgtccatcacggccgacgagagcaccaccaccgcctacatggagctctccagcctgacgtccgacgacaccgcggtgtactactgcgcccggagcccctactccagcctgaccgacacctactactactacatggacctctgggggaagggcacgaccgtgaccgtctccagc

SEQ ID NO: 8962 - RNA, 336 nt, synthetic construct
  misc_feature 1..336: note = derived and/or modified sequence opt1 from anti-HIV_4KG5_LightChain
  source 1..336: mol_type = other RNA
ctgacccagagccccgactccctcgccgtgagcctgggcgagcgcgccaccatcaactgcaagtccagccagtccatcctggacagctccaacaaccggaactacctcacgtggtaccagcagaagccggggcagccgcccaagctgctgatctactgggcgagcacccgcgagtccggcgtccccgaccggttcagcgggtccggcagctccaccgacttcaccctcacgatcagctccctgcaggccgaggacgtggccgtgtactactgccagcagtacttcagcacccccgggatcaccttcggccagggcacccgcctggagatcaagcgg

SEQ ID NO: 8963 - RNA, 309 nt, synthetic construct
  misc_feature 1..309: note = derived and/or modified sequence opt1 from anti-HIV-1_LightChain
  source 1..309: mol_type = other RNA
gagatcgtgctgacccagagccccgccaccctctccctgagcccgggcgagcgcgccacgctgtcctgccgggcgagccagtccgtctacaccaagctcgcctggtaccagcagaagcccgggcagccgccccgcctgctgatctacgacgccagcaaccgggccgccggcatccccgcgcgcttctccgggagcggctccgggaccgagttcaccctcacgatcaagcggatggagcgcgaggacttcgccgtgtactactgccagatcctggagttcttcggccagggcaccaccatcgacatgaac

SEQ ID NO: 8964 - RNA, 312 nt, synthetic construct
  misc_feature 1..312: note = derived and/or modified sequence opt1 from anti-HIV-1_LightChain
  source 1..312: mol_type = other RNA
gacatccagatgacccagagcccctccagcgtgtccgccagcgtcggcgaccgcgtgaccatcacgtgccgggcctcccaggggatcctgagctcccagctcgcgtggcaccagcagcgccggggccagccgccccgcctgctgatctacgggggcagcaaccgggcccccgggatccccgagcgcttcaccggctccggcagcgggaccgacttcgtgctcaccatcaagcggctgcagcgcgacgacttcgccgtctactactgccagatcctggagttcttcggccgggggacgcgcgtggagatgaac

SEQ ID NO: 8965 - RNA, 312 nt, synthetic construct
  misc_feature 1..312: note = derived and/or modified sequence opt1 from anti-HIV-1_LightChain
  source 1..312: mol_type = other RNA
ggcctgctcctgacccagagccccgggccggtgtccttcttccccggcgagcgcgccaccgtcagctgccgggcctcccacagcgtgaactccgcggccatcaactggtaccagcagaagcgcgggcagccgccccggctgatcatcgtggacggcagcacgcgcgccaccgccgtccccgagcggttctccgccaccgggagcggcaccgagttcacgctcgtgatctcccgcctggagcccgaggacttcgcggtgtacttctgccagcacctccagttcttcggcctggggaccaaggtcgacatcaag

SEQ ID NO: 8966 - RNA, 312 nt, synthetic construct
  misc_feature 1..312: note = derived and/or modified sequence opt1 from anti-HIV-1_LightChain
  source 1..312: mol_type = other RNA
gccttcgtgatgacccagagccccggcaccctggccctctccccgggggagcgcgcgacgctgagctgccggacctcccaggagatcctgagcaaccagctcgcctggcaccagcagcgccggggccagccgccccgcctgctgatctacgggggctccaaccgggcccccgggatccccgagcgcttcaccggcagcggctccgggaccgacttcgtcctcacgatcaaccggctggagcgcgacgacttcgccgtgtactactgccagatcctggagttcttcggccgggggacccgcgtggagatgaac

SEQ ID NO: 8967 - RNA, 312 nt, synthetic construct
  misc_feature 1..312: note = derived and/or modified sequence opt1 from anti-HIV-1_LightChain
  source 1..312: mol_type = other RNA
ggcatcgtgctgacccagagccccgacaccctctccctgagcccgggggaccgcgccacgctgtcctgcaagaccagccagtccatcgccagcgagcacctcgcgtggtaccagcagcggcccggccagccgccccgcctgctgatcttcggggcctccaaccgggccagcggcatccccacccgcttctccgggagcggctccggcgccgacttcaccctcagcatcacgcggctggagcccgaggacttcgccgtctactactgccagttctccgagttcttcgggcgcggcgcgcgggtggaggtgaag

SEQ ID NO: 8968 - RNA, 312 nt, synthetic construct
  misc_feature 1..312: note = derived and/or modified sequence opt1 from anti-HIV-1_LightChain
  source 1..312: mol_type = other RNA
cagttcgtgatgacccagagccccgccaccctgtccagctccccgggcgggacggccaccctcagctgccgcacctcccacagcatcctgaactcccagctggcgtggcaccagcagcggcgcggccagcccctccggctgctgatctacggggccagcaaccgcgcccccggcatccccgagcggttctccgccagcgggtccggcaccgagttcgtcctcacgatcaagcgcatggagcgggaggacttcgccgtgtactactgccagatcctggagttcttcggccaggggaccaccatcgacatgaac

SEQ ID NO: 8969 - RNA, 354 nt, synthetic construct
  misc_feature 1..354: note = derived and/or modified sequence opt1 from anti-HIV-1_HeavyChain
  source 1..354: mol_type = other RNA
cgcgtgcacctggtccagagcggcacccaggtgaagaagcccggggcctccgtgaaggtcagctgcgagacctccggcttcaagttcctcgacagcctgatccactgggtgcggcaggccccggggcagggcctgtactggatggggtggatcaagccctaccgcggctccgtgaactacgacggctacttccgggggcgcgtcagcatgacgcgggacatctacaccgacaccgcgtacctcgagctgtccggcctgcgcagcgacgacaccgccatctactactgcgccttcggggccggcgacgggtgggacctcgtgtggggccagggcacgctggtgatcgtctccagc

SEQ ID NO: 8970 - RNA, 354 nt, synthetic construct
  misc_feature 1..354: note = derived and/or modified sequence opt1 from anti-HIV-1_HeavyChain
  source 1..354: mol_type = other RNA
cgcgtgcacctggtccagagcggcacccaggtgaagaagcccggggcctccgtgaaggtcagctgcgagacctccggcttcaagttcctcgacagcctgatccactgggtgcggcaggccccggggcagggcctgtactggatggggtggatcaagcccttccgcggctccgtgaactacgacggctacttccgggggcgcgtcagcatgacgcgggacatctacaccgacaccgcgtacatggagctctccggcctgcgcagcgacgacaccgccatctactactgcgccttcggggccggcgacgggtgggacctggtgtggggccagggcacgctcgtgatcgtctccagc

SEQ ID NO: 8971 - RNA, 354 nt, synthetic construct
  misc_feature 1..354: note = derived and/or modified sequence opt1 from anti-HIV-1_HeavyChain
  source 1..354: mol_type = other RNA
caggtgcacctggtccagagcggcacccaggtgaagaagcccggggcctccgtgcgcgtcagctgcgagacctccggcttcaagttcctcgacagcatcatccactggttccggcaggccccgggggagggcctgttctggatggggtggatcaagccctacacgggctccgtgaactacgtgcgccggtaccagggccgcgtcagcatgacccgggacgtgtactccgacaccgcgtacatggacctgagcgggctcaactccgacgacaccgccgtgtacttctgcacgtacggcgccggggacggctggaacctggtctgggggcagggcaccctggtgatcgtgagcgcc

SEQ ID NO: 8972 - RNA, 363 nt, synthetic construct
  misc_feature 1..363: note = derived and/or modified sequence opt1 from anti-HIV-1_HeavyChain
  source 1..363: mol_type = other RNA
caggtgcgcctggtccagagcggcaaccaggtgcggaagcccggggcctccgtgcgcatcagctgcgaggcctccggctacaagttcatcgaccacttcatccactgggtccgccaggtgccggggcacggcctcgagtggctggggtggatcaacccccggggcggcggggtgaactacagccggggcttccaggggaagctgtccatgaccatgacccgcgacaacttcgaggagacggcgtacctcgacctgagccggctgaaccccggcgacaccgccgtctactactgcgcccgcgggttcgccggctacgagtggtccttcctctggggccaggggaccctggtgatcgtgagctcc

SEQ ID NO: 8973 - RNA, 357 nt, synthetic construct
  misc_feature 1..357: note = derived and/or modified sequence opt1 from anti-HIV-1_HeavyChain
  source 1..357: mol_type = other RNA
caggtgagcctggtccagtccggcaaccagctcaagaagcccggggccagcgtgcgcatctcctgcgagaccagcggctacaacttcctgaaccacttcatccactgggtgcggcaggtcccggggcacggcctggagtggctcgggtggatcaacccccgcggcggcggggtgaactactcccggaacttccagggcaaggtgagcctgacccgcaacatcgacatggagacggtctacctggacgtgcgggggctcacccccggcgacaccgccgtgtactactgcgcgcgcgggttcggcggctccgactggaacttcgtctgggggcagggcacccggatcacggtgagcgcc

SEQ ID NO: 8974 - RNA, 357 nt, synthetic construct
  misc_feature 1..357: note = derived and/or modified sequence opt1 from anti-HIV-1_HeavyChain
  source 1..357: mol_type = other RNA
cgcatcaacctgcaccagagcggctcccaggtgaagcggagcggggcctccgtccgcatcagctgcgagacctccggcttcaagttcatggacagccacctccactgggtgcgccaggtggccgggcagggcttcgagtggatggggtggatcttcacctccggcggcggggtcaactacgcgcggcagttccagggccggctgacgctgacccgcgacgtgttcaccgacaccgtgttcatggacctcagcggggtcaacgtgggcgacacgggggtgtactactgcgtcaagggcaccggcgggaacgagtggggcttctcctgggggcagggcaccgtggtggtcgtgagcccc

SEQ ID NO: 8975 - RNA, 357 nt, synthetic construct
  misc_feature 1..357: note = derived and/or modified sequence opt1 from anti-HIV-1_HeavyChain
  source 1..357: mol_type = other RNA
cgcatcaacctggaccagagcggctcccaggtgaagaagtccggggccagcgtccggatcagctgcgagacctccggcttcaagttcatggacagccacctccactgggtgcgccaggtggccgggcagcccttcgagtggatgggctggatcttcacctccgggggcggcgtcaactacgcgcggcagttccaggggcgcctgacgctgacccgggacgtgttcagcgagaccgtgttcatggacctctccggcctgaacgccggggacaccggcgtctacttctgcgtgaaggggacgggcggcaacgagtgggggttcgtgtggggccaggggaccgtcgtggtggtcagcccg

SEQ ID NO: 8976 - RNA, 357 nt, synthetic construct
  misc_feature 1..357: note = derived and/or modified sequence opt1 from anti-HIV-1_HeavyChain
  source 1..357: mol_type = other RNA
cgcatcgagctgcaccagagcggctcccaggtgaagaagtccggggccagcgtccggatcagctgcgagacctccggcttcaagttcatggacagccacctccactgggtgcgccaggtggccgggcagcggttcgagtggatgggctggatcttcacctccgggggcggcgtcaactacgcgcgccagttccaggggcggctgcgcctgacgcgggacgtgttcagcgagtccgtgttcatggacctcagcggcctgaactccggggacaccggcgtctactactgcgtgaaggggaccggcggcaacgagtgggggttcgtgtggggccaggggagcctggtcgtggtgtccccc

SEQ ID NO: 8977 - RNA, 372 nt, synthetic construct
  misc_feature 1..372: note = derived and/or modified sequence opt1 from anti-HIV-1_HeavyChain
  source 1..372: mol_type = other RNA
caggccctggtgcagagcggctcccagatgaagaagcccggggacagcgtccgcctctcctgccagaccagcgactccgccatcaccaagtacttcatccactggatccggcaggcgccgggcaaggggctggagtggatcgcctggatcagcccctacggcgggcgcgtgaactacggctggcaggtccgggaccgcgccacgctgacccggaacatccacatggagaccgtgtacatggacctccgcggcctgcggcccgacgacaccgccacgtactactgcgccatgcgcgactactgccgggacgacaactgcaaccgctgggacctggggcactggggccaggggtccctcatcgtggtgagcgcg

SEQ ID NO: 8978 - RNA, 357 nt, synthetic construct
  misc_feature 1..357: note = derived and/or modified sequence opt1 from anti-HIV-1_HeavyChain
  source 1..357: mol_type = other RNA
caggtgaccctggtccagagcggcaaccagctcaagcgccccggggcctccgtgcggatcagctgcgagacctccggctacaacttcatggaccacttcatccactgggtgcgccaggtcccggggcacggccccgagtggctggggtgggtgaacccccggggcggcggggtgaactacagccgcaagttccagggccggttctccatgacgcgcgacgtctacatggagaccgcctacctggacgtgaccgggctcagccccgcggacaccgccgtgtactactgcgcccggggcttcgggggctccgactggagcttcctgtggggccaggggacgctgatcatcgtctccagc

SEQ ID NO: 8979 - RNA, 324 nt, synthetic construct
  misc_feature 1..324: note = derived and/or modified sequence opt1 from anti-HIV-1_LightChain
  source 1..324: mol_type = other RNA
gagatcgtgctgacccagagccccggcaccctctccctgagcgccggggagcgcgcctccctgagctgccgggcctcccagacgctcaacagcaacttcttcgcctggtaccaccagaagccgggccaggcgccccgcctgctgatctacggggcctccaaccgggccaccggcatccccgaccgcttcagcgggtccggcagcggctccgacttcaccctcaccatcagccggctggagcccgaggacttcgggaagtactactgcgagcagtacgacgtctccccgcgcacgttcggccaggggaccaaggtggagatcaag

SEQ ID NO: 8980 - RNA, 324 nt, synthetic construct
  misc_feature 1..324: note = derived and/or modified sequence opt1 from anti-HIV-1_LightChain
  source 1..324: mol_type = other RNA
gaggtggtcctgacccagtcccccggcaccctctccctgagcccgggggagcgcgccacgctgtcctgccgggccagccagtccatcaacagcaacttcttcgcctggtaccaccagaagcccggccaggcgccccgcctcctgatctacggggcctccagccgggccaccggcatccccgaccgcatctccgggaccggcagcggcgccgacttcaccctgacgatcaccgggctcgagccggaggacttcggcctgtactactgccagcagtacgacttcagcccccggaccttcgggcagggcacccgcgtggagatcaag

SEQ ID NO: 8981 - RNA, 324 nt, synthetic construct
  misc_feature 1..324: note = derived and/or modified sequence opt1 from anti-HIV-1_LightChain
  source 1..324: mol_type = other RNA
gaggtggtcctgacccagtcccccggcaccctctccctgagcccgggggagcgcgccacgctgtcctgccgggccagccagaccatcaactccaacttcttcgcctggtaccaccagaagcccggccaggcgccccgcctcctgatctacggggccagctcccgggccaccggcatccccgaccgcatcagcgggtccggcagcggcaccgacttcacgctgaccatcaccgggctcgagccggaggacttcggcctgtactactgccagcagttcgacttcagcccccggaccttcgggcagggcacgcgcgtggagatcaag

SEQ ID NO: 8982 - RNA, 324 nt, synthetic construct
  misc_feature 1..324: note = derived and/or modified sequence opt1 from anti-HIV-1_LightChain
  source 1..324: mol_type = other RNA
gagatcgtgctgacccagtcccccggcaccctctccctggccccgggggagcgcgccacgctgagctgccgggcctcccagagcatctccaccacctacctcgcctggtaccagcagaagcccggccaggcgccccgcctgctgatctacgagaccagctcccgggccagcgacatccccgaccgcttctccgggagcggctccgggacggacttcaccctcaccatcagccggctggagccggaggacttcgccgtctactactgccaccagtacgaccgcagcccccggaccttcggccagggcacgaaggtggagatcaag

SEQ ID NO: 8983 - RNA, 336 nt, synthetic construct
  misc_feature 1..336: note = derived and/or modified sequence opt1 from anti-HIV-1_LightChain
  source 1..336: mol_type = other RNA
gacatcgtgatgacccagagccccgcctccctgagcgtcaccccgggcgagacggcctccatcagctgcaagtgctcccgcagcctccgggaggaggtggggtacaactacctggactggtacctgcagcgccccggcaagagcccccagctcctgatctacgtggggtccttccgggcgcccggcgtctccgagcgcttccgggggagcggcgagcacaaggacttcaccctgaagatcgcccgcgtggagccgggcgacgccgggatctactactgcatgcagggcatcgacacgccccggaccttcgggcagggcaccaccctcgagatcaac

SEQ ID NO: 8984 - RNA, 321 nt, synthetic construct
  misc_feature 1..321: note = derived and/or modified sequence opt1 from anti-HIV-1_LightChain
  source 1..321: mol_type = other RNA
gacatccagatgacccagagcccctccagcctgtccgccagcgtgggcgaccgcgtcaccatcacgtgccgggcctcccaggcgttccgcaacgacctcgggtggtaccagcacaagccgggcaaggcccccgagcggctgatctacgccaccagcaccctggagtccggggtgcccagccgcttctccggcagcgggtccggcaccaacttcacgctcaccatcagctccctgcaggccgaggacttcgccacctactactgcctgcagtacaacaccttcccccggacgttcggccaggggaccaaggtggagatcaag

SEQ ID NO: 8985 - RNA, 333 nt, synthetic construct
  misc_feature 1..333: note = derived and/or modified sequence opt1 from anti-HIV-1_LightChain
  source 1..333: mol_type = other RNA
aacttcatgctgacccagccccacagcgtgtccgagagcccgggcaagaccgtcacgatctcctgcgcccgcacccgcgggggcatcgacagcgcctacgtgcactggtaccagcagcgccccgggtccgtgcccaccaccgtcatcttcgaggacaaccggcggcccccgggcgtgcccgaccggttcagcgggtccatcgacacgagctccaacaccgcgagcctcaccatctccggcctgaagaccgaggacgaggccgactactactgccagagctacgacgacacgtacttctgggtgttcggcgggggcaccaagctgaccgtcctc

SEQ ID NO: 8986 - RNA, 333 nt, synthetic construct
  misc_feature 1..333: note = derived and/or modified sequence opt1 from anti-HIV-1_LightChain
  source 1..333: mol_type = other RNA
aacttcatgctgacccagccccacagcgtgtccgagagcccgggcaagaccgtcacgatctcctgcgcccgcacccgggggaccatcgacagcgcctacgtgcactggtaccagcagcgccccggcgcggtgcccaccacggtcatcttcgaggacgaccggcgcccctccggggtgccggaccggttcagcggctccatcgacagctccagcaactccgccagcctcaccatctccgggctgaagaccgaggacgaggccgactactactgccagagctacgactccaactactactgggtgttcggcggcgggaccaagctgacggtcctc

SEQ ID NO: 8987 - RNA, 396 nt, synthetic construct
  misc_feature 1..396: note = derived and/or modified sequence opt1 from anti-HIV-1_HeavyChain
  source 1..396: mol_type = other RNA
caggtgcagctgcagcagagcggccccgccctcgtcaagccgtccgagaccctgagcctgacctgctccgtgagctccgggcgcgtgagctcctactactggagctggatccggcagtcccccggcaaggggctcgagtggatcggctacatccactacgaccccgacacgaacaccaactaccgcacccactaccaccccagcctgcgggggcgcgtcgtgatctccgtggacagctccaagagccaggtctccctgaaggtgcggagcgtgaccgccgcggactccgccctctactactgcgcccgccaccggtacgacccgtggagcaagggctacgacatccgctcccccttcgacttctggggccaggggacgctggtcaccgtgagcagc

SEQ ID NO: 8988 - RNA, 396 nt, synthetic construct
  misc_feature 1..396: note = derived and/or modified sequence opt1 from anti-HIV-1_HeavyChain
  source 1..396: mol_type = other RNA
caggtgcacctccagcagagcggccccgggctggtcaagccgtccgagaccctgagcctgacctgcacggtgtccggcgggcgcgtgagctcctactactggagctggatccggcagtcccccggcaaggggctcgagtggatcggctacatccactacgaccccgacaccagcaccaactaccgcacccactaccacccctccctgcggggccgcgtcgtgatcagcgtggacacgtccaagaaccaggtcagcctgaccgtgcggtccgtgaccgccgccgacagcgcgctctactactgcgcccgccaccggtacgacgtctggtccaacgggtacgacatccgcagcccgtacgacttctggggccgggggaccctggtgacggtgtccagc

SEQ ID NO: 8989 - RNA, 396 nt, synthetic construct
  misc_feature 1..396: note = derived and/or modified sequence opt1 from anti-HIV-1_HeavyChain
  source 1..396: mol_type = other RNA
caggtgcacctggagcagagcggccccgccctcgtcaagccgtccgagaccctgagcctgacctgcacggtgtccgggggccgcgtgagctcctactactggagctggatccggcagtcccccgggaagggcctcgagtggatcgggtacatccactacgaccccgacaccagcaccaactaccgcacccactaccacccctccctgcggggccgcgtcgtgatcagcgtggactccagcaagaaccaggtctccctgaaggtgcggagcgtgacggccgcggactccgccctctactactgcgcccgccaccggtacgacgtctggagcaagggctacgacatccgctccccgttcgacttctgggggcggggcaccctggtgaccgtgagctcc

SEQ ID NO: 8990 - RNA, 390 nt, synthetic construct
  misc_feature 1..390: note = derived and/or modified sequence opt1 from anti-HIV-1_HeavyChain
  source 1..390: mol_type = other RNA
caggtggtcttccagaagcccggcccgggggtggtgaagcccagcgagaccctgtccctgacctgcacggtcagcggcgggcgcgtgcggtcctactactggagctggatccgcctcccgcccggccaggggctggagtggatcggctacatccactacgacgagaccaccgagtacaagcggtcctacaaccccagcctcaagtcccgcatcaccatcagcatggacacgtccaagaaccaggtgagcctgaagctgtccagcgtcaccgccgccgacgcggccgtgtactactgcgcccggcaccgctacgaccggtggtccgacagctacgacatccgctcccccttcgacatctggggccaggggaccgtggtcaccgtgagcgcc

SEQ ID NO: 8991 - RNA, 396 nt, synthetic construct
  misc_feature 1..396: note = derived and/or modified sequence opt1 from anti-HIV-1_HeavyChain
  source 1..396: mol_type = other RNA
caggtgcagctgcagcagtggggcgccgggctcctgaagcccagcgagaccctgtccctgacctgcgccatctacggcagctccttcagcgggcactactggatgtggatccgccagtccccggcgaagacgctcgagtggatcgccgagatcaaccacaccggcgggacccggtacaaccccagcctggcctcccgcgtccgggtgttcagcgacacctccaagaaccagttcagcctcaacatgacgtccctgaccgccgccgacaccggcatctactactgcgtgcgcggccacctgagccgggaccgcctcgggcagtacgcgttctggtccggcgccctgatcgactacctggacccctgggggcagggcaccctcgtcacggtgagctcc

SEQ ID NO: 8992 - RNA, 387 nt, synthetic construct
  misc_feature 1..387: note = derived and/or modified sequence opt1 from anti-HIV-1_HeavyChain
  source 1..387: mol_type = other RNA
caggtgcagctgcaccagtggggcgccgggctcctgaagcccagcgagaccctgtccctgacctgcgccgtctacggcagcttcacggggttccagtggacctgggtgcgccagaccccgggcaaggggctcgagtggatcggcgagatcaaccactccggcctgctcgtgaccgggaagacggactacaaccccagcctggagtcccgggtcaccatcagcgtggacacctccaagaaccagttcagcctgaagctcacctccgtgacggcggccgacaccggcgtctactactgcgcccgcgccgggggcatgagcgactgggcctacccctactactacgggatggacgtgtggggccagggcaccatggtgaccgtctccagc

SEQ ID NO: 8993 - RNA, 357 nt, synthetic construct
  misc_feature 1..357: note = derived and/or modified sequence opt1 from anti-HIV-1_HeavyChain
  source 1..357: mol_type = other RNA
caggtgcagctggtcgagagcggcgggggcgtggtgcagcccgggcgctccctcaccctgagctgcgccacctccggcttcgacttcagctcctacgggttccactgggtccggcaggccccgggcaagggcctgcagtgggtgagcatcatctcccacgacgggagcatcaagaactacggcgactccatgaaggggcgcttcagcgtgtcccgggacaacgcgaaggacatcctctacctgcagatgaacagcctgcgccccgacgacacggccctctaccactgcgtccggggcgacggggagaacggcggcaccgactactgggggctgggcaccctggtgaccgtgtccgcc

SEQ ID NO: 8994 - RNA, 357 nt, synthetic construct
  misc_feature 1..357: note = derived and/or modified sequence opt1 from anti-HIV-1_HeavyChain
  source 1..357: mol_type = other RNA
caggtggacctggtcgagagcggcgggggcgtggtgcagcccgggaagtccctcaagctgagctgcaccgcctccggcttcaccttcacgagctacgggatgcactgggtccgccagatcccgggcaagggcctggagtgggtggccatcatctcccacgacgggaccatcaagaactacggcgacagcgtgaaggggcggttcaccatctcccgcgacaacgcgatgaacatcctctacctgcagatgaacaacctgcggggcgacgacaccgccctctactactgcgtccgcggggacggcgagaacggcgggacggactactggggccaggggaccgtggtgaccgtcagctcc

SEQ ID NO: 8995 - RNA, 369 nt, synthetic construct
  misc_feature 1..369: note = derived and/or modified sequence opt1 from anti-HIV_V3_HeavyChain
  source 1..369: mol_type = other RNA
gaggtgcagctggtccagagcggcgccgaggtgaagaagcccggggagtccctcaagatcagctgccagggcttcgggtacaccttctccacctactggatcggctgggtgcgccagatgccggggaagggcctggagtggctgggcatcatctaccccgaggacagcgagacgatctactcccccagcttccaggggcaggccaccatctccgcggacaagagcctctccaccgcctacctgcagtggagcggcctgcgggcctccgacagcgccatctactactgcgcccgcctcgggtactgcggctccaccagctgctccttcttcgacttctgggggcggggcacgctggtcaccgtgagctcc

SEQ ID NO: 8996 - RNA, 369 nt, synthetic construct
  misc_feature 1..369: note = derived and/or modified sequence opt1 from anti-HIV_V3_HeavyChain
  source 1..369: mol_type = other RNA
gaggtgcagctggtccagagcggcgccgaggtgaccaagcccggggagtccctcaagatcagctgcaagggctccgggtacagcttctccacccactggatcgcctgggtgcgccagatgccgggccgggggctggagtggatgggcttcatctaccccgacgacagcgacacgcgctactcccccagcctgcagggccacgtcatcatctccgcggacaagagcctctccaccgcctacctgcagtggagctccctgaaggccagcgacaccgccatgtactactgcgcccggctcgggggcgacgagtaccagtccagcgggggcatggacgtgtgggggcagggcaccacggtgatcgtctccagc

SEQ ID NO: 8997 - RNA, 393 nt, synthetic construct
  misc_feature 1..393: note = derived and/or modified sequence opt1 from anti-HIV_V3_HeavyChain
  source 1..393: mol_type = other RNA
gaggtgcagctggtccagagcggcgccgaggtgaagaagcccggggccaccgtgaagatctcctgcaaggtcagcggctacaccctcacggactactacatccactgggtgcagcaggcgccggggcgcggcctggagtggctggggctcgtggaccccgagaacggcgagaccctgtacgccgagaagttccagggccgggtcaccctgaccgccgacacgtccaccgacaccgcctacatggagctcaagagcctgcgctacgaggacaccgccgtgtactactgcgcgacggaggggccgccctcctactacgacagcggcacctacgccaagtccctgcccgccagcttcgcctgctgggggcagggcaccctcgtgaccgtctccagc

SEQ ID NO: 8998 - RNA, 369 nt, synthetic construct
  misc_feature 1..369: note = derived and/or modified sequence opt1 from anti-HIV_V3_HeavyChain
  source 1..369: mol_type = other RNA
caggtgcagctgcaggagagcggccccgggctcgtcaagccgtccgagaccctgagcctgacctgcacggtgtccggcgggagcatcaacaactactactggtcctggatccgccagccgcccggcaaggggctcgagtacatcggctacatcttctacagcggctccaccaactacaaccccagcctgaagtcccgggtgaccttcagcgtcgacacctccaagaaccagttcagcctgaagctcacgtccgtgaccgccaccgacaccgccgtgtactactgcgcccgcgggcccctgctgtacttcggcgcgccccggacgcacttcgactactgggggcagggcgccctcgtcaccgtgagctcc

SEQ ID NO: 8999 - RNA, 372 nt, synthetic construct
  misc_feature 1..372: note = derived and/or modified sequence opt1 from anti-HIV_V3_HeavyChain
  source 1..372: mol_type = other RNA
gaggtgcagctggtccagagcggcgccgaggtgaagaagcccggggagtccctcaagatcagctgcaagggctccgggtacagcttctccagccactggatcggctgggtgcgccagctgccggggaagggcctggagtggatgggcatcatctaccccgacgactccgacaccaagtacaaccccagcttccaggggcaggtcaccatctccgccgaccggagcatctccacggcgtacctccagtggagctccctgaaggccagcgacaccgccatgtactactgcgcccgcgtgggctacgactcctacgggtacagcggctccaacttcgacgagtgggggcagggcaccctggtgaccgtcagctcc

SEQ ID NO: 9000 - RNA, 357 nt, synthetic construct
  misc_feature 1..357: note = derived and/or modified sequence opt1 from anti-HIV_V3_HeavyChain
  source 1..357: mol_type = other RNA
gaggtgcagctggtccagagcggcgccgaggtgaagaagcccggggagtccctcaagatcagctgcaagggctccgggtacaacttcaacagcgactggatcggctgggtgcgccagatgcccgggaagggcctggagtgggtcggcatgatctaccccgacgacttcgaggtgcggcactccccgcccttccaggggcgcgtgaccatgagcgtcgacaagtccatcagcaccgcctacctgcagtggtccagcctcaagtccagcgacacgggcatgtacttctgcgcgcggctggacgggaacgccgccgccttcgactactggggccaggggacccaggtgaccgtgtccagc

SEQ ID NO: 9001 - RNA, 360 nt, synthetic construct
  misc_feature 1..360: note = derived and/or modified sequence opt1 from anti-HIV_V3_HeavyChain
  source 1..360: mol_type = other RNA
gacgtgcagctggtccagagcggcgccgaggtgaagaaggccggggagtccctcaagatcagctgccgcccctccggctacaacttcgcggactactggatcgggtgggtgcggcagatgccgggcaaggggctggagtggatgggcatcatcttccccgacgacagcgacacccgctacggcccctccttcgaggggcaggtcaccatcagcgccgacaagtccatcaacacggcctacctgcagtggaacagcctcaaggcctccgacaccgccatgtacttctgcgcgcggcacggcgggagcggcgccgcccccggggactactggggccagggcaccctggtgaccgtgtccagc

SEQ ID NO: 9002 - RNA, 363 nt, synthetic construct
  misc_feature 1..363: note = derived and/or modified sequence opt1 from anti-HIV_V3_HeavyChain
  source 1..363: mol_type = other RNA
gaggtgcagctggtccagagcggcgccgaggtgaagaagcccggggccaccgtgaagatctcctgcaaggtcagcggctacaccttcacggactacttcatgcactgggtgcaggaggcgccggggaagggcctcgcctggatggggctggtggaccccgagaacggcgacaccgtctacgccgagaagctgcagggccgcgtgaccatgtccgccgacaccagccgggacacggcctacatggagctcacctccctgcgcagcgaggacaccgcggtgtactactgcgccatcgggaagtccgtcgccggcaccagcgcctacgacatctgggggcagggcacgatggtgaccgtgtccagc

SEQ ID NO: 9003 - RNA, 369 nt, synthetic construct
  misc_feature 1..369: note = derived and/or modified sequence opt1 from anti-HIV_V3_HeavyChain
  source 1..369: mol_type = other RNA
caggtgcagctggtccagagcggcgccgaggtgcgcaagcccggggcctccgtgaaggtcagctgcaaggcgtccggcgacaccttcaacaaccacgacatcaactgggtgcggcaggccccggggcagggccccgagtgggtggggtggatgaaccccaagagcggcaacgccggctacgcccagaagttccaggggcgcgtcaccatgacgcgggacacctccatcagcaccgcctacatggagctccgctccctgaccagcgaggacacgggcgtgtactactgcgcgcggctgaccgtggactgcgacgacgggggctgctacggggactactggggccagggcaccctcgtcaccgtgtccagc

SEQ ID NO: 9004 - RNA, 354 nt, synthetic construct
  misc_feature 1..354: note = derived and/or modified sequence opt1 from anti-HIV_V3_HeavyChain
  source 1..354: mol_type = other RNA
gaggtgtacctgcagcagagcggcgccgagctcaaggagcccggggccaacgtcaagatctcctgcaaggcgttcggcttcatcttcaccgactacttcatccactggctgcgccaggccccggggaagggcccccagtgggtgggggtggtcgaccccgaggacggcagcaccacgtacgccgaggccttccagggccgggtgtccatcaccgccgaccgcagcaccgacaccgcgtacatggacctggccgggctcacgtccgacgacaccgccgtgtactactgcgccctgatgtggaacgagagcggccccgacaactgggggcagggcaccctggtcatcgtgtccagc

SEQ ID NO: 9005 - RNA, 393 nt, synthetic construct
  misc_feature 1..393: note = derived and/or modified sequence opt1 from anti-HIV_V3_HeavyChain
  source 1..393: mol_type = other RNA
gaggtgcaggtcgtggagttcggcggggaggtgaagaagcccggcgccagcgtcaaggtgtcctgcgaggccagcgggtacaccttcgccaagttcgccatccactgggtgcgccaggccccgcggcagggcctggagtggatggggtggatcaacggcgacgacggcaagaccgagtactcccagaagttccaggaccgcgtcacgatgacccgggacaccagcgcctccaccgtgtacatggagctcagctccctgcgcagcgaggacacggccctgtactactgcgcgcgggccatgtaccccgacaccgtgaccgggaacgacaaccccgcgcccccgcccttcgagggcgactactgggggcagggcaccctcgtcacggtgtccagc

SEQ ID NO: 9006 - RNA, 393 nt, synthetic construct
  misc_feature 1..393: note = derived and/or modified sequence opt1 from anti-HIV_V3_HeavyChain
  source 1..393: mol_type = other RNA
gaggtgcagctggtcgagagcggcgggggcctcgtgaagcccgggggctccctgcgcctgacctgcgtggccagcgggttcaccttctccgacgtctggctcaactgggtgcggcaggccccgggcaagggcctggagtgggtggggcgcatcaagagccggacggacggcgggaccaccgactacgcggcctccgtcaagggccgcttcaccatcagccgggacgactccaagaacacgctgtacctccagatgaacagcctgaagaccgaggacaccgccgtgtactcctgcaccacggacgggttcatcatgatccgcggcgtgagcgaggactactactactactacatggacgtctggggcaaggggaccaccgtgaccgtgtccagc

SEQ ID NO: 9007 - RNA, 387 nt, synthetic construct
  misc_feature 1..387: note = derived and/or modified sequence opt1 from anti-HIV_CD4bs_HeavyChain
  source 1..387: mol_type = other RNA
gaggagcagctggtggagagcggcgggggcctcgtcaagcccgggggctcccagcgcctgagctgcgccgcctccgagttcaccttcagccggtacaccatgaactgggtgcgccaggcgccggggaagggcctggagtgggtgtccagcatctccggcaacgacaacaacatctactacgccgacagcgtcaaggggcggttcacgatctcccgcgacaacgcccggaacagcctctacctgcagatcaactccctgcgcgtggaggacaccgccgtgtactactgcgcccggggccccctcgacagctacgacttctggtccgggagccgccactactacggcctggacgtctgggggcagggcaccaccgtgacggtgtccagc

SEQ ID NO: 9008 - RNA, 372 nt, synthetic construct
  misc_feature 1..372: note = derived and/or modified sequence opt1 from anti-HIV_CD4bs_HeavyChain
  source 1..372: mol_type = other RNA
caggtgcagctggtccagagcggctccgagctcaagaagcccggggccagcgtgaaggtgtcctgcaaggccagcggctacaccttcacctcccacatcatcaactgggtccgccaggcgccggggcagggcctggagtggatggggtggatcaacacgaacaccggcaaccccacctacgcccagggcttcaccgggcggttcgtgttcagcctggacacgtccgtgagcatggcctacctccagatctccagcctgaaggccgaggacaccggcgtctactactgcgcccgcgggttccggcagtggctggtggcgcgcatcacctacttcgactactggggccaggggaccctcgtgacggtctccagc

SEQ ID NO: 9009 - RNA, 369 nt, synthetic construct
  misc_feature 1..369: note = derived and/or modified sequence opt1 from anti-HIV_CD4bs_HeavyChain
  source 1..369: mol_type = other RNA
gagctgcgcctccaggccagcggccccgggctggtgaagccgtccgagaccctgagcctcgtctgctccgtgagcggcgtgtccatcagcgactcctactggaactggatccggcagcccgccgggaagggcctggagtggatcgggcgcgtctacacccggggcacgcacacctacaaccccagcctgggcgggcgcgcgaccgtgtccggcgacaccaacaagaacgaggtgagcctcaagctgatgtccgtcacggccgccgacaccgccgtgtactactgcgcccgggcgctgagcggggactggacccgccggtacttctacatggacgtgtggggccgcgggacccccgtcacggtgtccagc

SEQ ID NO: 9010 - RNA, 381 nt, synthetic construct
  misc_feature 1..381: note = derived and/or modified sequence opt1 from anti-HIV_CD4bs_HeavyChain
  source 1..381: mol_type = other RNA
cagctgcagctccaggagagcggcccccgcctggtgaagccgtccgagaccctgagcctgacctgcacggtctccgggggcagcatctccagcggggactactactggacctggatccggcagccgcccggcgaggggctggagtacatcggctacatctactccggcgggagcaccgactacaacccctccctcaagagccgcgcctccatcagccaggacacctccacgaacgagttcagcctcaagctgacctccgtgaccgccgcggacaccgccgtgtacttctgcgcccgggaccgccgggtcctgctctggttcggcgagccccgccgggggctggacttctggggccccgggacgctggtgaccgtgagctcc

SEQ ID NO: 9011 - RNA, 396 nt, synthetic construct
  misc_feature 1..396: note = derived and/or modified sequence opt1 from anti-HIV_CD4bs_HeavyChain
  source 1..396: mol_type = other RNA
gaggtgcagctggtcgagagcggcgggggcctcgtgaagcccgggggctccctgcgcctgagctgcgccgcctccgggttcaccttcagctccgcgtggatgagctgggtgcggcaggccccgggcaagggcctcgagtgggtcgggcgcatcaagtccaagagcgacggcgagaccacggactacgccgcccccgtgaaggggcggttcaccatctcccgcgacaacctggagagcaccctgtacctccagctgaactccctgaagaccgaggacacggccgtgtactactgcgcgaccgccacccccagctactacgacatcatgaccggcaactacaagtactactactacatggacgtctgggggaagggcacgaccgtgaccgtgtccagc

SEQ ID NO: 9012 - RNA, 363 nt, synthetic construct
  misc_feature 1..363: note = derived and/or modified sequence opt1 from anti-HIV_CD4bs_HeavyChain
  source 1..363: mol_type = other RNA
caggtgcagctggtcgagagcggcgggggcctcgtgaagcccgggggctccctgcgcctgagctgcgccgcctccgggttcatcttccgggaccactacatgacctggatccgccaggcgcccggcaagggcctcgagtgggtgagctacatctccagctccagcaacaacatccagtacgccgactccgtcaaggggcggttcaccgtgagccgcgacaacgccaagaactccctgtacctgcagatgaacagcctccgggccgacgacacggccgtgtactactgcgcgcgctccggccccttctacaactacgggccgcccaacaactggggccaggggaccctggtcaccgtgagctcc

SEQ ID NO: 9013 - RNA, 378 nt, synthetic construct
  misc_feature 1..378: note = derived and/or modified sequence opt1 from anti-HIV_CD4bs_HeavyChain
  source 1..378: mol_type = other RNA
caggtgcagctggtcgagagcggcgggggcgtggtgcagcccgggggctccctcaccctgagctgcaccgcctccgggttcccgttcaacagctacgccatgcactgggtccgccaggcgcccggcaagggcctggagtgggtgtccatgacgagccacgacgggggcaacaaggacttcgtggactccgtcaaggggcggttcaccatcagccgcgacaactcccggaacaccctcttcctgcagatgaacagcctgtcccaggacgacaccggcgtgtactactgcgtgcgcgggaagctcgaggactacaacttctggggccactaccgggacttcgacagctggggccaggggacgctggtcaccgtgtccgcc

SEQ ID NO: 9014 - RNA, 405 nt, synthetic construct
  misc_feature 1..405: note = derived and/or modified sequence opt1 from anti-HIV_CD4bs_HeavyChain
  source 1..405: mol_type = other RNA
gagccccacgtggtcgagagcggcgggggcatggccaagcccgggggctccctgcgcctcagctgcgccgggtccggcttcaccttcaccaacgcgtggatgaactgggtgcggcaggccccgggcaaggggctggagtgggtgggcctgatcaagagcaagtccgacgggggcacgaccgactacgccgccgacgtcgaggggcgcttcaccatcagccgggacgacctcgagtccaccatgttcctggagatgcacagcctgcagatcgaggacacggccgtgtacttctgcaccacccagtacccccgctactacgacctcatgaccggcaactacaagcggcgctacttctccagcggcatggacgtgtgggggcagggcacggcggtcaccgtgtccagc

SEQ ID NO: 9015 - RNA, 384 nt, synthetic construct
  misc_feature 1..384: note = derived and/or modified sequence opt1 from anti-HIV_CD4bs_HeavyChain
  source 1..384: mol_type = other RNA
caggtgcagctgcaggagagcggccccgggctcgtcaagccgtcccagaccctgagcctgacctgcacggtgtccggcgacagcgtgtccagcgggaactactactggtcctggatccgccagcccgccggcaagcccctcgagtggatcgggcacatcagcaccggcggcgggaccaagaacaacccctccctgcagagccgggtcaccatctccctggacagctccaagaaccaggtgagcctctccctgagctccgtgacggccgcggacaccgccgtctacacgtgcgcccgcggcccgccccggagcctgtggttcggggaccccacctactcctacatggacgtgtggggcaaggggaccaccgtgaccgtcagcagc

SEQ ID NO: 9016 - RNA, 372 nt, synthetic construct
  misc_feature 1..372: note = derived and/or modified sequence opt1 from anti-HIV_CD4bs_HeavyChain
  source 1..372: mol_type = other RNA
caggtgcagctggtccagagcggcgccgaggtgaagaagcccgggtccagcgtgaaggtctcctgcaaggccagcggcgggaccttcaactcccacgcgttcacctgggtgcgccaggccccgggccaggggctcgagtggatgggcggcatcatccccacgctggggctggccaacgacgcccagaagttccagggccggttcaccatcaccgccgacgagagcaccacgaccgtgtacatggagctctccagcctgcgctccgaggacaccgcggtctactactgcgcccggcgcccctactacgaccaggtgagcggggtgggcgccttcgacatctgggggcagggcacccgggtcacggtgtccagc

SEQ ID NO: 9017 - RNA, 390 nt, synthetic construct
  misc_feature 1..390: note = derived and/or modified sequence opt1 from anti-HIV_V2_HeavyChain
  source 1..390: mol_type = other RNA
caggtgcagctggtccagagcggcgccgaggtgaagaagcccgggtccagcgtgaaggtctcctgcgaggccagcggcgtgacctccagctcctacaccatcagctgggtgcgcctcgcgccggggcagggcctggagtggatggggcggatcacgcccatcttcgacatcaccaactacgcccagaagttccagggccgcgtcaccctgaccgccgacaagtccacgggcaccacctacatggagctcagctccctgcggagcgacgacaccgccgtgtactactgcgcccgcgacaagtccgacgtggtcgtggtgacgagcatccggcccgcgtactactacgggatggacgtctggggccaggggaccaccgtgaccgtgtccagc

SEQ ID NO: 9018 - RNA, 366 nt, synthetic construct
  misc_feature 1..366: note = derived and/or modified sequence opt1 from anti-HIV_V2_HeavyChain
  source 1..366: mol_type = other RNA
caggtgcagctggtccagagcggcgccgaggtgaagaagcccgggtccagcgtgaaggtctcctgcaaggccagcggcgggaccttccgctcctacgcgatcagctgggtgcggcaggccccgggccaggggctcgagtggatgggcggcatcatccccatcttcgggaccgccgactacgcccagaagttccagggcaaggtgacgatcaccgccgacgagtccaccagcaccgcgtacatggagctgtccagcctgacgtccgaggacaccgccatgtactactgcgcccgcagccgggaccacttcttcgacacccgcgtcttccaggggtggggccaggggaccctcgtgacggtgtccagc

SEQ ID NO: 9019 - RNA, 363 nt, synthetic construct
  misc_feature 1..363: note = derived and/or modified sequence opt1 from anti-HIV_V2_HeavyChain
  source 1..363: mol_type = other RNA
caggtgcagctggtccagagcggcgccgaggtgaagaagcccgggtccagcgtgaaggtctcctgcaaggccagcggcgggaacttcaacacctacaccatctcctgggtgcgccaggcgccgggccaggggctcgagtggatgggccggatcatccccatcttcggcatcgtgaaccccgcccagaagttccccgggcgcgtcacgatcaacgtggacaagagcaccaacaccgcctacatggagctgtccagcctgcggtccgaggacaccgccgtgtactactgcgccacgagcggcgtcgggctccacttcggctacttcgactactgggggcagggcacccaggtgaccgtgtccagc

SEQ ID NO: 9020 - RNA, 378 nt, synthetic construct
  misc_feature 1..378: note = derived and/or modified sequence opt1 from anti-HIV_V2_HeavyChain
  source 1..378: mol_type = other RNA
caggtgcagctgcagcagtggggccccgggctcctgaagccgagcgagaccctgtccctgacctgcgccgtctacggcgggagcttcggccgctactactggtcctggatccggcagagctccggggagggcctcgagtggctgggccagatcgaccacacggggagcaccacctacaacccctccctcaagggccgcgtgaccatcagcatcgactccagcacgaaccagttctccctgaaggtgaccagcgtcatcgccgcggacaccgccgtgtactactgcgcccgggccccctccgggtaccccggcgtgagcctgtaccagtactacgggctcgacgtctggggccagggcaccacggtgaccgtgtccccg

SEQ ID NO: 9021 - RNA, 366 nt, synthetic construct
  misc_feature 1..366: note = derived and/or modified sequence opt1 from anti-HIV_V2_HeavyChain
  source 1..366: mol_type = other RNA
caggtgcagctggtccagagcggcgccgaggtgaagaagcccgggtccagcgtgaaggtctcctgcaaggccagcggcgggaccttctccaactacgcgatcagctgggtgcgccaggccccgggccaggggctcgagtggatgggcggcatcatccccatcttcgggaccacggactacgcccagaagttccagggccgggtgaccatcaccgccgacgcctccaccagcacggcgtacatggagctgtccagcctgcgctccgacgacaccgccgtctactactgcgcccggagccgcgggcactacttcgacacccgggtgttcgagggctgggggcagggcaccctcgtgacggtctccagc

SEQ ID NO: 9022 - RNA, 372 nt, synthetic construct
  misc_feature 1..372: note = derived and/or modified sequence opt1 from anti-HIV_V2_HeavyChain
  source 1..372: mol_type = other RNA
caggtgcacctggtccagagcggcaccgaggtgaagaagcccggggcctccgtgaccgtcagctgcaaggcctccggctacagcttcacggggtactacctccactgggtgcgccaggcgcccggccaggggctggagtggatgggctggatcaaccccaactccggcgggacctactacgcccagaacttccaggcccgggtgaccatgacccgcgacacgagcatctccaccgtctacatggacctgagccggctccgctccgacgacaccgccgtgtactactgcgtgcggcgcgccgtcctgaccgcgctgccgccccggtactacttcgacttctggggccaggggacgctcgtgaccgtgagctcc

SEQ ID NO: 9023 - RNA, 318 nt, synthetic construct
  misc_feature 1..318: note = derived and/or modified sequence opt1 from anti-HIV_V3_LightChain
  source 1..318: mol_type = other RNA
agcctggagctcacccagcccccgtccgtgagcgtctcccccggccagaccgtgagcatcacgtgctccgggaacctgctgggcgacaaggacgccagctggtaccagctcaagcccgggcagtcccccatcctggtgatctacctggacaccgagcgcccgagcggcatccccgagcggttctccgggagcaagtccggcaacaccgccaccctcacgatcagcggcacccaggcgatggacgaggccgagtacttctgccaggcctgggacaccaccacggtcctgttcgggggcgggacccgcctgaccgtgctc

SEQ ID NO: 9024 - RNA, 324 nt, synthetic construct
  misc_feature 1..324: note = derived and/or modified sequence opt1 from anti-HIV_V3_LightChain
  source 1..324: mol_type = other RNA
agcgacgagctgacccagcccccgtccgtgagcgtctcccccggccagaccgcccgcatcacgtgcagcggggacgccctccccgagaagtacgcgtactggtaccagcagaagtccggccaggcccccgtgctggtgatcgacgaggacaacaagcggccgttcgggacccccgagcgcttcagcggctcccggagcgggaccatggccaccctgacgatcaccggcgcccagatggaggacgaggccgactactactgctccagcaccgactcccgcggcacctactgggtcttcgggggcgggacgaagctcaccgtgctg

SEQ ID NO: 9025 - RNA, 336 nt, synthetic construct
  misc_feature 1..336: note = derived and/or modified sequence opt1 from anti-HIV_V3_LightChain
  source 1..336: mol_type = other RNA
cagagcgtgctgacccagcccccgtccgtcagcgccgcccccggccagaaggtgaccatctcctgcagcgcggggaactccaagatcggcgacaactacatcagctggtaccagcacgtgcccggggccgcccccaagctcctgatctacgagaacgacaagcgcccgtccggcatccccgaccggttcagcgggtccaagagcggcacgtccgccagcctgggcatcaccgggctccagaccggcgacgaggccgactactactgcgcggcctgggacaactccctgagctccgccctgtacgtcttcgggaccggcacgaaggtgaccgtgctc

SEQ ID NO: 9026 - RNA, 339 nt, synthetic construct
  misc_feature 1..339: note = derived and/or modified sequence opt1 from anti-HIV_V3_LightChain
  source 1..339: mol_type = other RNA
gacatcgtgatgacccagagccccgactccctggccgtcagcctcggcgagcgcgccaccatcaactgcaagtccagccagaacgtgttctactccagcaacaaccggaactacctggcgtggtaccagcagcgccccgggcagccgcccaagctcctgttctactgggcctccacgcgggagagcggcgtgcccgaccgcttctccgggagcggctccgggaccgacttcaccctgaccatcagctccctgcagacggaggacgtcgccatctactactgccagcagtactacaacaccccgcccaccttcggccccggcaccaaggtggagatcaag

SEQ ID NO: 9027 - RNA, 318 nt, synthetic construct
  misc_feature 1..318: note = derived and/or modified sequence opt1 from anti-HIV_V3_LightChain
  source 1..318: mol_type = other RNA
agctacgagctgacccagcccccgtccgtgagcgtctcccccggccagaccgccacgatcacgtgcagcggggacctcctgggcgacaagtacgcctcctggtaccgccagaagcccgggcagagccccgtgctggtgatctacgaggacaccaagcggccgtccggcctccccgagcgcttcagcgggtccaacagcggcaacaccgcgaccctgaccatctccgagacccaggccatggacgaggccgactactactgccaggcctgggacacccggacggtcgtgttcggcgggggcaccaagctgaccgtgctc

SEQ ID NO: 9028 - RNA, 327 nt, synthetic construct
  misc_feature 1..327: note = derived and/or modified sequence opt1 from anti-HIV_V3_LightChain
  source 1..327: mol_type = other RNA
cagagcgtgctgacccagcccccgtccgtcagcgccgcccccggccagaaggtgaccatctcctgcagcgggcgctccagcgacatcgagaacaagttcgtgtcctggtaccagcagctccccggcacggcgcccaagctgctgatctacgaggacaacaagcggccgagcgggatccccgaccgcttctccggcagcaagtccgggaccagcgccaccctcggcatcaccggcctgcagacgggggacgaggccgactactactgcggcacctgggacaacaacctgcgggccgggttcggcgggggcacccacctcaccgtcctg

SEQ ID NO: 9029 - RNA, 324 nt, synthetic construct
  misc_feature 1..324: note = derived and/or modified sequence opt1 from anti-HIV_V3_LightChain
  source 1..324: mol_type = other RNA
agctacgagctgacccagcccccgtccgtgagcgtctcccccggccagaccgcccgcatcacgtgcagcggggacgccctccccaacaagtacgcgttctggtaccagcagaagtccggccaggcccccgtgctggtgatcttcgacgacaaccggcgcccggccgggatccccgagcggttcagcggctcccgcagcgggaccctggccaccctcaccatctccggcgcccaggtcgaggacgaggcggactactactgctacagcacggacaacgacggcaagtacttcgtgttcgggtccggcaccatggtgaccgtcctg

SEQ ID NO: 9030 - RNA, 318 nt, synthetic construct
  misc_feature 1..318: note = derived and/or modified sequence opt1 from anti-HIV_V3_LightChain
  source 1..318: mol_type = other RNA
agctacgagctgacccagcccccgtccgtgagcgtctcccccggccagaccgccagcatcacgtgctccgggcacaagctcggcgacaagtacgccagctggtaccagcacaagcccgggcagtcccccgtgctggtgatctacgaggacacccagcgcccgagcggcatccccgagcggatctccgggagcaagtccggcaacaccgcgaccctgacgatcagcggcacccaggccatggacgaggccgactactactgccaggcctgggactcccgcgccgcggtcttcgggggcgggacccggctcaccgtgctg

SEQ ID NO: 9031 - RNA, 327 nt, synthetic construct
  misc_feature 1..327: note = derived and/or modified sequence opt1 from anti-HIV_V3_LightChain
  source 1..327: mol_type = other RNA
cagagcgccctgacccagcccgcctccgtgagcggctccccggggcagagcatcaccatctcctgcacgggcatcagctccgacatcgggaccgacaactacgtcagctggtaccagcagcaccccggcaaggcgcccaagctcatcatctacgaggtgtccaaccgccccagcgggatctcccaccggttcagcggctccaagagcggcaacaccgcctccctgatcatcagcgggctccaggtggaggacgaggcccactactactgcaactcctaccgcagcgacaccctggtcttcggcgggggcacgaaggtgaccgtgctg

SEQ ID NO: 9032 - RNA, 333 nt, synthetic construct
  misc_feature 1..333: note = derived and/or modified sequence opt1 from anti-HIV_V3_LightChain
  source 1..333: mol_type = other RNA
cagagcgtgctgacccagcccccgtccgccagcggcacccccgggcagcgcgtcacgatctcctgcagcggctccagctccaacatcgggagcaacaccgtgaactggtaccagcacctccccggcaccgcccccaagctgctgatctactccaacgaccagcggccgagcggggtgcccgaccgcttctccggcagctccagcggcacctccgcgagcctcgccatctccgggctgcagagcgaggacgaggccgactactactgcgccgcctgggacgactccctgaacggccccttcgtcttcgggacgggcaccaaggtgaccgtgctc

SEQ ID NO: 9033 - RNA, 318 nt, synthetic construct
  misc_feature 1..318: note = derived and/or modified sequence opt1 from anti-HIV_V3_LightChain
  source 1..318: mol_type = other RNA
gacatccagatgacccagagcccctccagcctgtccgccagcgtgggcgaccgcatcaccatcacgtgccggacctcccagagcatcgacaaccacctcaactggtaccagcacaagccggggaaggcccccaagctgctgatctccgcggccagccgcctccagtccggcgtccccagccggttcaccgggtccggcagcgggaccgagttcacgctgaccatctccagcctgcagcccgaggacttcgccgtgtactactgccagcagtcctacatcaccatcaccttcggcccgggcacgaaggtggacatcaag

SEQ ID NO: 9034 - RNA, 321 nt, synthetic construct
  misc_feature 1..321: note = derived and/or modified sequence opt1 from anti-HIV_V3_LightChain
  source 1..321: mol_type = other RNA
gagatcgtgatgacccagagccccgccaccctgtccgtcagcccgggcgagggggtgacgctctcctgccgcgccagccagtccgtgagctccaacatcctgtggtaccagcagcggcccggccaggcgccccgcctgctcctgtacggggccagcacccgggccaccggcatccccgcccgcttctccgggagcggctccggcaccgagttcacgctgaccatcaacagcatgcagtccgaggacttcgccatctactactgccagcagtaccacgactggctctggaccctggggcagggcacccaggtcgagatcaag

SEQ ID NO: 9035 - RNA, 327 nt, synthetic construct
  misc_feature 1..327: note = derived and/or modified sequence opt1 from anti-HIV_V3_LightChain
  source 1..327: mol_type = other RNA
agctacgagctgacccagcccccgtccgtgagcgtctcccccggccagaccgccagcatcacgtgctccggggacaagatgggcgagcgctacaccagctggtaccagcagaagcccgggcagtcccccgtgctcgtgatgagcgagaacatcaagcggccggccggcatccccgagcgcttctccgggagctccagcggcaacaccgcgatcctgaccatctccggcacgcaggccgtcgacgaggccgactactactgccaggtgtgggacaccaccaccacgagctacgtgatcttcgggggcgggaccaagctgaccgtcctc

SEQ ID NO: 9036 - RNA, 321 nt, synthetic construct
  misc_feature 1..321: note = derived and/or modified sequence opt1 from anti-HIV_V3_LightChain
  source 1..321: mol_type = other RNA
gacatccagatgacccagagcccctccagcctgtccgccagcgtgggcgaccgcgtcaccatcacgtgccaggcctcccaggacatcgggaactacctcaactggtaccaccagaagccgggcaaggcgcccaagctgctgatctacgacgccagcaacgtggagaccggggtggcctcccggttcagcggctccgggagcggcaccgacttcaccctcacgatctccagcctgcagcccgaggacatcggcacctacttctgccagcagtacgagtccctgccctgggccttcgggggcgggaccaaggtcgagatccgc

SEQ ID NO: 9037 - RNA, 333 nt, synthetic construct
  misc_feature 1..333: note = derived and/or modified sequence opt1 from anti-HIV_V3_LightChain
  source 1..333: mol_type = other RNA
aacttcaagctgacccagccccacagcgtgtccgagagcccgggcaagaccgtcacgatctcctgcacccgcaccagcgggaccatcgccacgaactacgtgcagtggttccagcagcggcccggctccagccccaccaccatgatctacgagaacgacaagcgcccctccggggtgccggaccggttcagcggctccatcgacaccagctccaacagcgcctccctcacgatcagcgggctgaagaccgaggacgaggcggactactactgccagtcctacaacagcaccgacatcgtcgtgttcggcggcgggaccaagctgacggtgctc

SEQ ID NO: 9038 - RNA, 327 nt, synthetic construct
  misc_feature 1..327: note = derived and/or modified sequence opt1 from anti-HIV_V3_LightChain
  source 1..327: mol_type = other RNA
cagagcgtgctgacccagcccccgtccgtcagcgccgcccccggccagaaggtgaccatctcctgcagcgggtccagctccaacatcggcaacaacatggtgagctggtaccagcagcaccccgggacggcgcccaagctcctgatctacgagaactccaagcgcccgagcggcatccccgaccggttctccgggagccgctccggcaccagcgccaccctgggcatcatcgggctccagaccggcgacgaggccgagtactactgcgccacgtgggacgggtccctgcggaccgtcttcggcgggggcaccaagctgaccgtgctc

SEQ ID NO: 9039 - RNA, 324 nt, synthetic construct
  misc_feature 1..324: note = derived and/or modified sequence opt1 from anti-HIV_V3_LightChain
  source 1..324: mol_type = other RNA
agctacgagctgacccagcccccgtccgtgagcgtctcccccggccagaccgcccgcatcacgtgcagcggggacgccctccccaaccagtacggctactggtaccagcagaagcccgggcaggcgccggtgctggtgatcttcaaggactccgagcggcccagcggcatccccgagcgcttctccgggagctccagcggcaccaccgtcaccctgacgatctccggcgtgcaggccgaggacgaggccgactactactgccagagcgccgactccagcgggaactacgaggtgttcggcgggggcaccaagctcaccgtcctg

SEQ ID NO: 9040 - RNA, 330 nt, synthetic construct
  misc_feature 1..330: note = derived and/or modified sequence opt1 from anti-HIV_V3_LightChain
  source 1..330: mol_type = other RNA
cagagcgtgctgacccagcccccgtccgtcagcgaggcgccccgccagcgggtgaccatctcctgcagcggctccagctccaacatcgggaacaacgccgtgaactggtaccagcaggtccccggcaaggcccccaagctcctgatctactacgacgacctgctcccgagcggggtgtccgaccgcttcagcggctccaagagcgggtccagcgcctccctggccatcagcggcctgcagtccgaggacgaggccgactactactgcgccgcgtgggacgacagcctcaaggtgtacgtcttcggcacggggacctccgtgaccgtgctg

SEQ ID NO: 9041 - RNA, 333 nt, synthetic construct
  misc_feature 1..333: note = derived and/or modified sequence opt1 from anti-HIV_V3_LightChain
  source 1..333: mol_type = other RNA
gacatcgtgatgaaccagagcccgccctccctggccgtcacccccggcgagcccgccagcatctcctgccgcgcgagccagtccctcctgtacagcgacgggcacaactacctggactggtacctccagaagcccggccaggccccgcagctgctgatctacctcgggtccacccgggccagcggcgtgcccgaccgcttctccgggagcggctccggcacggacttcaccctgaagatcagccgggtggaggccgaggacgtcggggtgtactactgcatgcagcccctgcagtcctacaccttcggccaggggaccaagctcgagatcaag

SEQ ID NO: 9042 - RNA, 321 nt, synthetic construct
  misc_feature 1..321: note = derived and/or modified sequence opt1 from anti-HIV_V3_LightChain
  source 1..321: mol_type = other RNA
gcctacgagctgacccagcccccgagcgtgtccgtcagccccggccagaccgcccgcatcacgtgctccggggacgcgctccccaaccagtacgcctactggtaccaccagcggcccggccaggccccggtgctggtgatccacaaggacaccgagcgccccagcgggatccccgcccggttctccggcagctccagcgggaccaccgtcacgctgaccatctccgaggtgcaggccgaggacgagggcgactactactgccagagcgcggacacctccgcctacgtggtcttcggcgggggcaccaagctcacggtgctg

SEQ ID NO: 9043 - RNA, 330 nt, synthetic construct
  misc_feature 1..330: note = derived and/or modified sequence opt1 from anti-HIV_V3_LightChain
  source 1..330: mol_type = other RNA
cagagcgtgctgacccaggccccctccagctccggcaccccggggcagagcgtcacgatctcctgcagcggctccagctccaacatggagatcaactacgtgtactggtaccgccagttccccgggaccgcgccccagctcctgatctacaacgacaaccagcggcccagcggcgtgccggaccgcttctccgccagcaagtccgggaccagcgcctccctggccatcggcggcctccggagcgaggacgaggccgactacttctgcgccgtctggcacggggaccgcggcgggcccgtgttcggcgggggcaccaagctgacggtgctg

SEQ ID NO: 9044 - RNA, 327 nt, synthetic construct
  misc_feature 1..327: note = derived and/or modified sequence opt1 from anti-HIV_V3_LightChain
  source 1..327: mol_type = other RNA
agctacgagctgaagcagccccgctccgtgagcgtctccccgggccagaccgcccggatcacgtgcagcggggacgccatgcccaaccagtacgcgtactggtaccagcagcgccccggccgggcccccgtgctcctgatcttcaaggacaacgagcgcgcctccgggatcccggagcggatcagcggctccagctccgggaccaccgccaccctgaccatcaaccgcgtgcaggccgaggacgaggcggactacctctgccagagcgccgactccagcggcgccttcccctgggtcttcggcgggggcacgaccctgaccgtgctg

SEQ ID NO: 9045 - RNA, 324 nt, synthetic construct
  misc_feature 1..324: note = derived and/or modified sequence opt1 from anti-HIV_V3_LightChain
  source 1..324: mol_type = other RNA
agctacgagctgacccagcccccgtccgtgagcgtctcccccggccagaccgcccgcatcacgtgcagcggggacgccctccccaaggagtacgcgtactggtaccagcagaagtccggccaggcccccgtgctggtgatctacgaggacacccggcgcccgagcgggatccccgagcggttctccggcagctccagcgggaccatggccaccctgacggtctccggcgcccacgtggacgacgaggccgactactactgctacagccgcgacacctccgcgaaccagtgggtgttcggcgggggcaccaagctcaccgtcctg

SEQ ID NO: 9046 - RNA, 318 nt, synthetic construct
  misc_feature 1..318: note = derived and/or modified sequence opt1 from anti-HIV_V3_LightChain
  source 1..318: mol_type = other RNA
gagatcgtgctgacccagagccccgccaccctctccctgagcccgggcgagcgcgccacgctgtcctgccgggcgagccagtccatcagcacctacctcgggtggtaccagcagaagcccggccaggcgccccgcctgctgatctacgacgcctccaaccgggccaccgggatccccgcccgcttcagcggctccgggagcggcaccgacttcacgctcaccatctccagcctggagccggaggacttcgccgtctactactgccagcagcggtacacctggatcaccttcggccaggggacgcgcctggagatcaag

SEQ ID NO: 9047 - RNA, 327 nt, synthetic construct
  misc_feature 1..327: note = derived and/or modified sequence opt1 from anti-HIV_V3_LightChain
  source 1..327: mol_type = other RNA
agctacgagctgacccagcccccgtccgtgagcgtctcccccggccagaccgcccgcatcacgtgcagcggggacgccctccccaaccagtacgtgtactggtaccagcagcggcccggccaggcgccggtggtcgtgctgtacaaggacaccgagcgcccctccgggatccccgagcggttcagcggctccagctccgggaccaccgtgacgctgaccatcagcggcgtccaggccgaggacgaggccgactactactgccagtccgccgacaacagcggcgcctaccccctcttcttcgggggcgggaccaagctgaccgtgctg

SEQ ID NO: 9048 - RNA, 333 nt, synthetic construct
  misc_feature 1..333: note = derived and/or modified sequence opt1 from anti-HIV_V3_LightChain
  source 1..333: mol_type = other RNA
cagagcgtgctgacccagcccccgtccgtcagcgccgcccccggccagaaggtgaccatctcctgcagcgggtccagctccaacatcggcaacaactacgtgctctggtaccagcagttccccgggacggcgcccaagctgctgatctacggcaacaacaagcgcccgagcgggatccccgaccggttctccggcagcaagtccggcaccagcgccaccctcgggatcaccggcctgcagacgggggacgaggccgactacttctgcgccacctgggactccggcctgagcgccgactgggtcttcgggggcggcaccaagctcaccgtgctg

SEQ ID NO: 9049 - RNA, 321 nt, synthetic construct
  misc_feature 1..321: note = derived and/or modified sequence opt1 from anti-HIV_V3_LightChain
  source 1..321: mol_type = other RNA
gacatccagatgacccagagcccctccagcctgtccgccagcgtgggcgaccgcgtcaccatcacgtgccgggcctcccaggagatcgacaactacctcgcgtggtaccagcagcgcccggggaaggcccccaagagcctgatctacgccgcctccagcctgcagggcggggtgccgcccaagttctccggcagcgggtccggcaccgagttcaccctcaccatcagctccctgcaggccgaggacttcgcgacgtactactgccagcagtacaacgcctaccccctgaccttcggccaggggacccggctcgacatcaac

SEQ ID NO: 9050 - RNA, 324 nt, synthetic construct
  misc_feature 1..324: note = derived and/or modified sequence opt1 from anti-HIV_V3_LightChain
  source 1..324: mol_type = other RNA
agctacgagctgacccagcccccgtccctcagcgtgtcccccggccagaccgccagcatcacgtgctccggggacggcctgcccaagcagtacgggtactggtaccagcagaagcccggccaggccccgctgctcgtcatcctgaaggacaccgagcgccccagcgggatccccgagcggttctccggcagctccagcggcaccaccgtgacgctgaccatctccggggtgcaggcggaggacgaggccgactactactgccagagcgtcgactccaccggcagctactacgtgttcgggcccggcaccaaggtgacggtcctc

SEQ ID NO: 9051 - RNA, 324 nt, synthetic construct
  misc_feature 1..324: note = derived and/or modified sequence opt1 from anti-HIV_V3_LightChain
  source 1..324: mol_type = other RNA
agctacgagctgacccagcccccgtccgtgagcgtctcccccggccagaccgcccgcatcacgtgcagcggggacgtgctccccaagaagtacgcctactggtaccagcagaagtccggcctggcgcccgtgctggtcatctacgaggacaaccggcgcccgagcgggatccccgagcggttctccggcagctccagcgggaccatggccaccctcaccatctccggcgcccaggtggaggacgagggcgactactactgcagctccacggacagctccggggaccactacgtgttcggcaccgggaccaaggtcaccgtgctg

SEQ ID NO: 9052 - RNA, 321 nt, synthetic construct
  misc_feature 1..321: note = derived and/or modified sequence opt1 from anti-HIV_V3_LightChain
  source 1..321: mol_type = other RNA
gcctacgagctgacccagcccccgagcgtgtccgtcagccccggccagaccgcccgcatcacgtgctccgcggaggccctcagcaaccagtacgcctactggtaccggcagcgccccgggcaggcgcccctgctgatcatctacaaggacaccaagcggccgtccggcatccccgagcgcttcagcgggtccaccagcggcaccacggtgaccctcaccatctccggggtgcaggccgaggacgaggccgactactactgccagagcgccgactccagcggcgactacgtcttcggcgggggcaccaaggtgacggtgctg

SEQ ID NO: 9053 - RNA, 333 nt, synthetic construct
  misc_feature 1..333: note = derived and/or modified sequence opt1 from anti-HIV_CD4bs_LightChain
  source 1..333: mol_type = other RNA
cagcccgtgctgacccagagctccagcgcctccgccagcctcggctccagcgtcaagctgacctgcacgctggggtccggccacagcgggtccatcatcgcctggcaccagcagcagccgggcaaggcgccccgctacctcatgaaggtgcagagctccgggagctacaacaagggctccggcgtgcccgaccggttcagcgggtccagctccggcgccgaccgctacctgaccatcagcaacctgcagttcgaggacgagggggactactactgcgagacctgggacaccaacaagtacgtcttcggcacggggaccaaggtgaccgtgctc

SEQ ID NO: 9054 - RNA, 324 nt, synthetic construct
  misc_feature 1..324: note = derived and/or modified sequence opt1 from anti-HIV_CD4bs_LightChain
  source 1..324: mol_type = other RNA
gagctggtgctcacccagagccccggcaccctgtccctgagcccgggggagcgcgccacgctctcctgccgggccagccagtccgtcgcgagctactacctggcctggtaccagcagaagcccggccaggcgccccgcctgctcatctacggggcctccagccgggccaccggcatccccgaccgcttctccgggagcgtgtccggcaccgacttcaccctgacgatcagccggctggagccggaggacttcgccctctactactgccagcagtacggctccagccccctgtccttcgggggcgggaccaaggtggagatccgc

SEQ ID NO: 9055 - RNA, 333 nt, synthetic construct
  misc_feature 1..333: note = derived and/or modified sequence opt1 from anti-HIV_CD4bs_LightChain
  source 1..333: mol_type = other RNA
cagagcgccctgacccagcccccgtccatgagcggctcccccgggcagagcatcaccatctcctgcacgggcagcgggtccgacgtgggcagccacaacttcgtctcctggtaccagcagcaccccgcccgcgtgcccaagctcctgatctacgcggtggggaaccggccgagcggcgtctccgagcgcttcagcggctccaagagcgggaacaccgcctacctgaccatctccggcctccaggccgacgacgaggccgactactactgcagctcccacaccacggggaccaccctggaggtgttcggcgggggcacccggctgacggtgctc

SEQ ID NO: 9056 - RNA, 333 nt, synthetic construct
  misc_feature 1..333: note = derived and/or modified sequence opt1 from anti-HIV_CD4bs_LightChain
  source 1..333: mol_type = other RNA
gacatcgtgatgacccagagccccctgtccctcccggtcacccccggcgagcccgccagcatctcctgccgcagctccgagagcctgctgcactccaacgggttcatctacctcgactggtacctgcagaagcccggccagagcccgcagctgctcatctacctggggtccaagcgggccagcggcgtgtccgaccgcttcagcgggtccggcagcggcacggcgttcaccctgaagatctcccgggtggaggccgaggacgtcggggtgtactactgcatgcaggccctcgagagccgcaccttcggccaggggaccaagctggagatcaag

SEQ ID NO: 9057 - RNA, 327 nt, synthetic construct
  misc_feature 1..327: note = derived and/or modified sequence opt1 from anti-HIV_CD4bs_LightChain
  source 1..327: mol_type = other RNA
gagatcgtgctgacccagagccccggcaccctctccctgagcccgggggagcgcgccacgctgtcctgccgggccagccagtccgtcagctccagctacctcgcgtggtaccagcagaagcccggccagagcccccgcctgctgatctacggggcctcctcccgggccaccggcatccccgaccgcttcagcgggtccggcagcggcaccgacttcaccctcacgatctcccggctggagccggaggacttcgccgtgtactactgccagcactacgggagctccagcatcttcaccttcggccccgggaccaaggtggacatccgc

SEQ ID NO: 9058 - RNA, 330 nt, synthetic construct
  misc_feature 1..330: note = derived and/or modified sequence opt1 from anti-HIV_CD4bs_LightChain
  source 1..330: mol_type = other RNA
aacttcatgctgacccagccccacagcgtgtccggcagcccggggaagaccgtcacgatctcctgcacccgcagctccggcagcatcgccgggaactacgtgcagtggtaccagcagcggcccggcacctcccccaccacggtgatctacgagaacgaccagcgcagctccggggtccccgaccggttcagcggctccatcgacagctccagcaactccgccagcctcaccatctccggcctgaagaccgaggacgaggcggactactactgccacagctacgacgccaccaaccaggtgttcgggggcgggacgaagctgaccgtgctc

SEQ ID NO: 9059 - RNA, 333 nt, synthetic construct
  misc_feature 1..333: note = derived and/or modified sequence opt1 from anti-HIV_CD4bs_LightChain
  source 1..333: mol_type = other RNA
gacgtggtcgtgacccagagccccctgtccctcccggtgaccctgggccagcccgccagcatctcctgccgcagctcccagagcctggtctactccgacgggacgacccacctcaactggtaccaccagcggcccggccagcccccgcgccggctgatctaccgcgtgagcaaccgggactccggggtgcccgaccgcttcagcggctccgggagcggcaccgacttcaccctgcggatctcccgcgtcgaggccgaggacgtgggcctctactactgcatgctggcgacgcaccccttcaccttcgggcccggcaccaaggtggagatcaag

SEQ ID NO: 9060 - RNA, 336 nt, synthetic construct
  misc_feature 1..336: note = derived and/or modified sequence opt1 from anti-HIV_CD4bs_LightChain
  source 1..336: mol_type = other RNA
cagagcgtgctgacccagcccccgtccgtcagcggcgcccccgggcagaccgtgacgatctcctgcaccggcagctccagcaacatcgggccctcctacgacgtgcagtggtaccagcagttccccggccgcgccccgaagctcctgatcagcgggaacaacaaccgggcgtccggcgtccccgaccgcttcagcggctccaagagcgggacctccgccagcctggccatcaccggcctccagtccgaggacgaggccgactactactgccagacgtacgacagctccctgagcgggcacgtggtgttcggcgggggcacccggctgaccgtcctc

SEQ ID NO: 9061 - RNA, 321 nt, synthetic construct
  misc_feature 1..321: note = derived and/or modified sequence opt1 from anti-HIV_CD4bs_LightChain
  source 1..321: mol_type = other RNA
gacatccagatgacccagagcccctccaccctgagcgcctccgtgggcgaccgcgtcacgatcacgtgccgggccagcgcgtccatctacacctggctcgcctggtaccagcagcgcccggggaaggcccccgaggtgctgatctacaaggccagcaccctgaagtccggcgtgcccagccggttctccgggagcggctccgggaccgagttcaccctcaccatcagctccctgcagcccggcgacttcgccacctactactgccagcagtacacgacctacccgctgaccttcggcgggggcaccacggtcgagatcaag

SEQ ID NO: 9062 - RNA, 330 nt, synthetic construct
  misc_feature 1..330: note = derived and/or modified sequence opt1 from anti-HIV_CD4bs_LightChain
  source 1..330: mol_type = other RNA
cagagcgccctgacccagcccgcctccgtgagcggctccccggggcagagcatcaccatctcctgcacgggcaccagcaacgacatcgggacctacaacctcgtctcctggtaccagcaccaccccaacaaggcgcccaaggtggtggtctacgagaacaacaagcgccccagcggcatctccaaccggttcagcgggtccaagagcggcaacaccgcctccctgacgatcagcggcctgcaggccgaggacgaggccgactactactgctgctcctacgccgggagctccacctgggtgttcggcgggggcaccaagctcaccgtgctg

SEQ ID NO: 9063 - RNA, 321 nt, synthetic construct
  misc_feature 1..321: note = derived and/or modified sequence opt1 from anti-HIV_V2_LightChain
  source 1..321: mol_type = other RNA
gacatccagatgacccagagcccctccaccctgagcgcctccgtgggcgaccgcgtcacgatcacgtgccgggccagccagaccatctccagctggctcgcgtggtaccagcagaagtccgggaccgccccgaagctgctgatctacaaggccagctccatcgtgagcggcgtgccctcccgcttcagcgggtccggcagcgggaccgagttcaccctcaccatcacctccctgcagcccgacgacttcgccacgtactactgccagcagtacaacagctcccccgagaccttcggccagggcaccaaggtcgagatcaag

SEQ ID NO: 9064 - RNA, 318 nt, synthetic construct
  misc_feature 1..318: note = derived and/or modified sequence opt1 from anti-HIV_V2_LightChain
  source 1..318: mol_type = other RNA
gagatcgtgctgacccagagccccggcaccctctccctgagcccgggggagcgcgccacgctgtcctgccgggccagccagtccgtcagctcctacctcgcgtggtaccagcagaagcccggccaggcgccccgcctgctgatctacgacgccagctcccgggccaccgggatccccgaccgcttcagcggctccgggagcggcaccgacttcaccctcacgatctcccggctggagccggaggacttcgccgtgtactactgccagcactacgccggcagccgcaccttcgggcagggcaccaaggtggagatcaag

SEQ ID NO: 9065 - RNA, 333 nt, synthetic construct
  misc_feature 1..333: note = derived and/or modified sequence opt1 from anti-HIV_V2_LightChain
  source 1..333: mol_type = other RNA
cagagcgtgctgacccagcccccgtccgtcagcggcgcccccgggcagcgcgtgaccatctcctgcacgggcagctccagcaacatcggggcccactacgacgtgcactggtaccagcagctccccggcaccgcgcccaagctgctgatctacgggaactccaaccggccgagcggcgtccccgaccgcttctccggcagcaagtccgggaccagcgcctccctcgccatcaccggcctgcaggccgaggacgaggccgactactactgccagagctacgactccagcctgtccgggtacgtgttcggcacggggaccaaggtgaccgtcctc

SEQ ID NO: 9066 - RNA, 324 nt, synthetic construct
  misc_feature 1..324: note = derived and/or modified sequence opt1 from anti-HIV_V2_LightChain
  source 1..324: mol_type = other RNA
gacaccgtgatgacccagagccccgccacgctgtccgtcagcccgggcgagcgcgtgaccctctcctgccgggccagccagatcatcaacaccaacctggcgtggtaccagaagcgccccgggcaggcgccccggctgctcatctacgccgcctccgcccgcgccaccggcatccccgcccggttcagcgggtccggcagcgggacggagttcaccctgaccatctccggcctgcagagcgaggactccgccgtgtactactgccagcagtacaagcactggccgccctacaccttcggccgcgggacgaagctcgagatccgg

SEQ ID NO: 9067 - RNA, 321 nt, synthetic construct
  misc_feature 1..321: note = derived and/or modified sequence opt1 from anti-HIV_V2_LightChain
  source 1..321: mol_type = other RNA
gagatcgtgctgacccagagccccggcaccctctccctgagcccgggggagcgcgccacgctgtcctgccgggccagccagtccgtcagctccagctacctcgcctggtaccagcagaagcccggccaggcgccccgcctgctgatctacggggcctccagccgggccaccggcatccccgaccgcttctccgggagcggctccggcaccgacttcaccctcacgatcagccggctggagccggaggacttcgccgtgtactactgccagcagtacgggtccagccgcaccttcggccaggggaccaaggtggagatcaag

SEQ ID NO: 9068 - RNA, 321 nt, synthetic construct
  misc_feature 1..321: note = derived and/or modified sequence opt1 from anti-HIV_V2_LightChain
  source 1..321: mol_type = other RNA
gacatccagatgacccagagcccctccagcctgtccgccagcgtgggcgaccgcgtcaccatcacgtgccgggcctcccagagcatctccgggaacctcaactggtaccagcagaagccgggcaaggcgcccaacctgctgatctacggggccagctccctccagagcggcgtgccctcccgcttcagcgggtccggcagcggcaccgacttcaccctgaccatctccagcctgcagcccgaggacttcgccacgtaccactgccagcagtcccacagcacctcctggaccttcgggcagggcaccaaggtggtcatcaag

SEQ ID NO: 9069 - RNA, 327 nt, synthetic construct
  misc_feature 1..327: note = derived and/or modified sequence opt1 from anti-HIV_10E8
  source 1..327: mol_type = other RNA
gccagcgagctgacccaggaccccaccgtgtccgtcgccctcggccagacggtgaccatcacgtgccgcggggacagcctgcggaaccactacacctcctggtaccagcagaagaccggccaggcgccggtgctgctcatctaccccaagcacaaccgcagccccgggatctccgaccggttcagcgcctccagctccggcaacaccgccagcctgaccatcaccggggcccagacggaggacgagggcgactactactgctccagccgcgacaagtccggcagccggctggtcaccttcgggggcgggaccgaggtgaccggcctc

SEQ ID NO: 9070 - RNA, 327 nt, synthetic construct
  misc_feature 1..327: note = derived and/or modified sequence opt1 from anti-HIV_10E8
  source 1..327: mol_type = other RNA
gccagcgagctgacccaggaccccaccgtgtccgtcgccctcggccagacggtgaccatcacgtgccgcggggacagcctgcggaaccactacacctcctggtaccagcagaagaccggccaggcgccggtgctgctcatctaccccaagcacaaccgcagccccgggatctccgaccggttcagcgcctccagctccggcaacaccgccagcctgaccatcaccggggcccagacggaggacgagggcgactactactgctccagccgcgacaagtccggcagccggctggtcaccttcgggggcgggaccaaggtgaccgtggtc

SEQ ID NO: 9071 - RNA, 327 nt, synthetic construct
  misc_feature 1..327: note = derived and/or modified sequence opt1 from anti-HIV_10E8
  source 1..327: mol_type = other RNA
gccagcgagctgacccaggaccccaccgtgtccgtcgccctcggccagacggtgaccatcacgtgccgcggggacagcctgcggaactactacacctcctggtaccagcagaagccgggccaggcgcccgtgctgctcatctaccccaagcacaaccggcccccggggatcagcgaccgcttctccgccagctccagcggcaacaccgcctccctgaccatcaccggggcccagaccgaggacgagggcgactactactgcagctcccgcgacaagagcggctcccggctggtcacgttcgggggcgggaccaaggtgaccggcctc

SEQ ID NO: 9072 - RNA, 327 nt, synthetic construct
  misc_feature 1..327: note = derived and/or modified sequence opt1 from anti-HIV_10E8
  source 1..327: mol_type = other RNA
gccagcgagctgacccaggaccccaccgtgtccgtcgccctcggccagacggtgaccatcacgtgccgcggggacagcctgcggaactactacacctcctggtaccagcagaagccgggccaggcgcccgtgctgctcatctaccccaagcacaaccggcccccggggatcagcgaccgcttctccgccagctccagcggcaacaccgcctccctgaccatcaccggggcccagaccgaggacgagggcgactactactgcagctcccgcgacaagagcggctcccggctggtcacgttcgggcgcggcaccaagctcaccgtggtg

SEQ ID NO: 9073 - RNA, 327 nt, synthetic construct
  misc_feature 1..327: note = derived and/or modified sequence opt1 from anti-HIV_10E8
  source 1..327: mol_type = other RNA
gccagcgagctgacccaggaccccaccgtgtccgtcgccctcggccagacggtgaccatcacgtgccgcggggacagcctgcggaaccactacacctcctggtaccagcagaagaccggccaggcgccggtgctgctcatctaccccaagcacaaccgcagccccgggatctccgaccggttcagcgcctccagctccggcaacaccgccagcctgaccatcaccggggcccagacggaggacgagggcgactactactgctccagccgcgacaagtccggcagccggctggtcaccttcgggggcgggaccaaggtgaccgtgctc

SEQ ID NO: 9074 - RNA, 327 nt, synthetic construct
  misc_feature 1..327: note = derived and/or modified sequence opt1 from anti-HIV_10E8
  source 1..327: mol_type = other RNA
gccagcgagctgacccaggaccccaccgtgtccgtcgccctcggccagacggtgaccatcacgtgccgcggggacagcctgcggaactactacacctcctggtaccagcagaagccgcgccaggcgcccgtgctgctcatctaccccaagcacaaccggcccccgggcatcagcgaccgcttctccgccagctccagcgggaacaccgcctccctgaccatcaccggcgcccagaccgaggacgagggggactactactgcagctcccgggacaagagcggctcccgcctggtcacgttcggcgggggcaccaagctcaccgtgctg

SEQ ID NO: 9075 - RNA, 327 nt, synthetic construct
  misc_feature 1..327: note = derived and/or modified sequence opt1 from anti-HIV_10E8
  source 1..327: mol_type = other RNA
gccagcgagctgacccaggaccccaccgtgtccgtcgccctcggccagacggtgaccatcacgtgccgcggggacagcctgcggaactactacacctcctggtaccagcagaagccgggccaggcgcccgtgctgctcatctaccccaagcacaaccggcccccggggatcagcgaccgcttctccgccagctccagcggcaacaccgcctccctgaccatcaccggggcccagaccgaggacgagggcgactactactgcagctcccgcgacaagagcggctcccggctggtcacgttcgggggcgggaccaagctcaccgtgctg

SEQ ID NO: 9076 - RNA, 327 nt, synthetic construct
  misc_feature 1..327: note = derived and/or modified sequence opt1 from anti-HIV_10E8
  source 1..327: mol_type = other RNA
gccagcgagctgacccaggaccccaccgtgtccgtcgccctcggccagacggtgaccatcacgtgccgcggggacagcctgcggaaccactacacctcctggtaccagcagaagaccggccaggcgcccatcctgctcatctaccccaagcacaaccgcccgcccgggatcagcgaccggttctccgccagctccagcggcaacaccgcctccctgaccatcaccggggcccagacggaggacgagggcgactactactgcagctcccgcgacaagagcggctcccggctggtgaccttcgggggcgggaccaagctcaccgtcctg

SEQ ID NO: 9077 - RNA, 327 nt, synthetic construct
  misc_feature 1..327: note = derived and/or modified sequence opt1 from anti-HIV_10E8
  source 1..327: mol_type = other RNA
agctccgacctgacccaggaccccgccgtgagcgtcgccctcggccagaccgtgcgcatcacgtgccagggggactccctgcggcgctactacgcgggctggtaccagcagaagccggggcaggcccccgtgctggtcgtgtacggccgggacaaccgccccagcgggatccccgaccggttctccggcagcacctccggcaacaccgccagcctcaccatcgccggggcccaggcggaggacgacgccgactactactgctccagccgcgacaagtccggcagccggctgtccgtgttcgggggcgggacgaagctgaccgtcctc

SEQ ID NO: 9078 - RNA, 327 nt, synthetic construct
  misc_feature 1..327: note = derived and/or modified sequence opt1 from anti-HIV_10E8
  source 1..327: mol_type = other RNA
gccagcgagctgacccaggaccccgccgtgtccgtcgcgttcgagaagaccgtgacgatcacgtgccagggcgacagcctccgctcccactacgtgagctggtaccagaagcggccggggcaggcccccgtcctggtgttctacggcaagaacaaccgcccctccgggatccccgaccggttcagcggctccaccagcgggaacaccgcctccctgaccatcgccggcgcccaggcggaggacgacgccgactactactgcagctcccgcgacaagagcggctcccggctcagcgtgttcgggggcgggaccaagctgaccgtcccg

SEQ ID NO: 9079 - RNA, 327 nt, synthetic construct
  misc_feature 1..327: note = derived and/or modified sequence opt1 from anti-HIV_10E8
  source 1..327: mol_type = other RNA
gccagcgagctgacccaggaccccgccgtgtccgtcgcgctcaagcagaccgtgacgatcacgtgccgcggcgacagcctgcggtcccactacgtgagctggtaccagcagaagccggggcaggcccccgtcctggtgttctacggcaagaacaaccgcccctccgggatccccgaccggttcagcggctccagctccgggaacaccgccagcctcaccatcgccggcgcccaggcggaggacgacgccgactactactgctccagccgcgacaagtccggcagccggctgtccgtgttcgggggcgggaccaagctgaccgtcctc

SEQ ID NO: 9080 - RNA, 327 nt, synthetic construct
  misc_feature 1..327: note = derived and/or modified sequence opt1 from anti-HIV_10E8
  source 1..327: mol_type = other RNA
agctccgagctgacccaggaccccggcgtgagcgtcgccctcaagcagaccgtgacgatcacgtgccgcggggactccctgcggagccactacgtgtcctggtaccagaagaagccgggccaggcccccgtcctggtgttctacgggaagaacatcggccccagcgggatccccgaccgcttctccggcagcacctccggcaacaccgcgagcctcaccatcgccggggcccaggccgaggacgacgccgactactactgctccagccgggacaagtccggcagccgcctgtccgtgttcgggggcgggaccaagctgaccgtcctc

SEQ ID NO: 9081 - RNA, 327 nt, synthetic construct
  misc_feature 1..327: note = derived and/or modified sequence opt1 from anti-HIV_10E8
  source 1..327: mol_type = other RNA
gccagcgagctgacccaggaccccgccgtgtccgtcgcgctcaagcagaccgtgacgatcacgtgccgcggcgacagcctgcggtcccactacgtgagctggtaccagaagaagccggggcaggcccccgtcctggtgttctacggcaagaacaaccgcccctccgggatccccgaccggttcagcggctccagctccgggaacaccgccagcctcaccatcgccggcgcccaggcggaggacgacgccgactactactgctccagccgcgacaagtccggcagccggctgtccgtgttcgggggcgggaccaagctgaccgtcctc

SEQ ID NO: 9082 - RNA, 327 nt, synthetic construct
  misc_feature 1..327: note = derived and/or modified sequence opt1 from anti-HIV_10E8
  source 1..327: mol_type = other RNA
gccagcgagctgacccaggaccccggcgtgtccgtcgccctcaagcagaccgtgacgatcacgtgccgcggggacagcctgcggtcccactacgtgagctggtaccagaagcgcccgggccaggcgcccgtcctggtgttctacgggaagaacaaccggccctccggcatccccgaccgcttcagcgggtccaccagcggcaacaccgcctccctcaccatcgccggcgcccaggccgaggacgacgcggactactactgcagctcccgggacaagagcgggtcccgcctgagcgtgttcggcgggggcaccaagctgaccgtcctc

SEQ ID NO: 9083 - RNA, 327 nt, synthetic construct
  misc_feature 1..327: note = derived and/or modified sequence opt1 from anti-HIV_10E8
  source 1..327: mol_type = other RNA
gccagcgagctgacccaggaccccggcgtgtccgtcgccctcgagcagaccgtgacgatcacgtgccgcggggacagcctgcggtcccactacgtgagctggtaccagaagaagccgggccaggcgcccgtcctggtgttctacgggaagaacaaccgcccctccggcatccccgaccggttcagcgggtccaccagcggcaacaccgcctccctcaccatcgccggcgcccaggccgaggacgacgcggactactactgcagctcccgcgacaagagcgggtcccggctgagcgtgttcggcgggggcaccaagctgaccgtcctc

SEQ ID NO: 9084 - RNA, 327 nt, synthetic construct
  misc_feature 1..327: note = derived and/or modified sequence opt1 from anti-HIV_10E8
  source 1..327: mol_type = other RNA
gccagcgagctgacccaggaccccggcgtgtccgtcgccctcaagcagaccgtgacgatcacgtgccgcggggacagcctgcggtcccactacgtgagctggtaccagaagaagccgggccaggcgcccgtcctggtgttctacgggaagaacaaccgcccctccggcatccccgaccggttcagcgggtccaccagcggcaacaccgcctccctcaccatcgccggcgcccaggccgaggacgacgcggactactactgcagctcccgcgacaagagcgggtcccggctgagcgtgttcggcgggggcaccaagctgaccgtcctc

SEQ ID NO: 9085 - RNA, 327 nt, synthetic construct
  misc_feature 1..327: note = derived and/or modified sequence opt1 from anti-HIV_10E8
  source 1..327: mol_type = other RNA
agctccgagctgacccaggaccccggcgtgagcgtcgccctcaagcagaccgtgacgatcacgtgccgcggggactccctgcggagccactacgtgtcctggtaccagaagaagccgggccaggcccccgtcctggtgttctacgggaagaacaaccgccccagcggcatccccgaccggttctccgggagcacctccggcaacaccgcgagcctcaccatcgccggcgcccaggccgaggacgacgccgactactactgctccagccgcgacaagtccgggagccggctgtccgtgttcggcgggggcaccaagctgaccgtcctc

SEQ ID NO: 9086 - RNA, 327 nt, synthetic construct
  misc_feature 1..327: note = derived and/or modified sequence opt1 from anti-HIV_10E8
  source 1..327: mol_type = other RNA
agctccgagctgacccaggagaccggcgtgagcgtcgccctcgggcgcacggtgaccatcacgtgccggggcgactccctgcgcagccactacgcctcctggtaccaggagaagcccgggcaggcgccgaagctcctgttctacggcaagaacaaccggcccagcgggatccccgaccgcttctccggcagcgcctccggcaaccgggccagcctgaccatctccggggcccaggccgaggacgacgcggagtactactgcagctcccgcgacaagagcggctcccggctgagcgtgttcgggggcgggaccaagctcgccgtcctg

SEQ ID NO: 9087 - RNA, 327 nt, synthetic construct
  misc_feature 1..327: note = derived and/or modified sequence opt1 from anti-HIV_10E8
  source 1..327: mol_type = other RNA
agctccgagctgacccaggagaccggcgtgagcgtcgccctcgggcgcacggtgaccatcacgtgccggggcgactccctgcgcagccactacgcctcctggtaccagaagaagcccgggcaggcgccgaagctcctgttctacggcaagaacaaccggcccagcgggatccccgaccgcttctccggcttcgccagcggcaaccgggcctccctgaccatcagcggggcccaggccgaggacgacgcggagtactactgctccagccgcgacaagtccggcagccggctgtccgtgttcgggggcgggaccaagctcaccgtcctg

SEQ ID NO: 9088 - RNA, 327 nt, synthetic construct
  misc_feature 1..327: note = derived and/or modified sequence opt1 from anti-HIV_10E8
  source 1..327: mol_type = other RNA
agctccgagctgacccaggagaccggcgtgagcgtcgccctcgggcgcacggtgaccatcacgtgccggggcgactccctgcgcagccactacgcctcctggtaccagaagaagcccgggcaggcgccgaagctcctgttctacggcaagaacaaccggcccagcgggatccccgaccgcttctccggcagcgcctccggcaaccgggccagcctgaccatctccggggcccaggccgaggacgacgcggagtacatctgcagctcccgcgacaagagcggctcccggctgagcgtgttcgggggcgggaccaagctcaccgtcctg

SEQ ID NO: 9089 - RNA, 327 nt, synthetic construct
  misc_feature 1..327: note = derived and/or modified sequence opt1 from anti-HIV_10E8
  source 1..327: mol_type = other RNA
agctccgagctgacccaggagaccggcgtgagcgtcgccctcgggcgcacggtgaccatcacgtgccggggcgactccctgcgcagccactacgcctcctggtaccagaagaagcccgggcaggcgccgaagctcctgttctacggcaagaacaaccggcccagcgggatccccgaccgcttctccggcagcgcctccggcaaccgggccagcctgaccatctccggggcccaggccgaggacgacgcggagtactactgcagctcccgcgacaagagcggctcccggctgagcgtgttcgggggcgggaccaagctcaccgtcctg

SEQ ID NO: 9090 - RNA, 327 nt, synthetic construct
  misc_feature 1..327: note = derived and/or modified sequence opt1 from anti-HIV_10E8
  source 1..327: mol_type = other RNA
agctccgagctgacccaggagaccggcgtgagcgtcgccctcgggcgcacggtgaccatcacgtgccggggcgactccctgcgcagccactacgcctcctggtaccagaagaagcccgggcaggcgccgatcctcctgttctacggcaagaacaaccggcccagcgggatccacgaccgcttctccggcagcgcctccggcaaccgggccagcctgaccatctccggggcccaggccgaggacgacgcggagtactactgcagctcccgcgacaagagcggctcccggctgagcgtgttcgggggcgggaccaagctcaccgtcctg

SEQ ID NO: 9091 - RNA, 393 nt, synthetic construct
  misc_feature 1..393: note = derived and/or modified sequence opt1 from anti-HIV_10E8
  source 1..393: mol_type = other RNA
gaggtgcagctggtcgagagcggcggggacctcgtgaagcccggcgggtccctgcgcctgagctgctccgccagcggcttctccttcaagaacacctggatgacctgggtgcggcaggcccccgggaagggcctcgagtgggtcggccgcatcacggggcccggcgaggggtggaccagcgactacgcggccaccgtgcagggccggttcaccatctcccgcaacaacatgatcgacatgctgtacctggagatgaaccggctccgcacggacgacaccgggctgtactactgcgtgcacaccgagaagtactacaacttctggggcggctacccgcccggggaggagtacttccagcactggggccgggggaccctggtcatcgtgagctcc

SEQ ID NO: 9092 - RNA, 393 nt, synthetic construct
  misc_feature 1..393: note = derived and/or modified sequence opt1 from anti-HIV_10E8
  source 1..393: mol_type = other RNA
gagatccgcctggtggagagcggcgggggcctcgtcaagcccgggggctccctgcggctgagctgctccgccagcgggttcaacttcgactccgcctggatgacctgggtgcgccagccgcccggcaagggcctcgagtgggtggggcggatcaccggccccggggagggctggagcgtcgggtacgcggagtccgtgaagggccgcttcatcatcagccggatcaactccatcaacttcctgtacctggagatgaacaacctccgccccgaggacacgggcagctacttctgcgcccacaccgggaagcactacgacttctggcggggctacccgcccggggaggagtacttccaggactggggccagggcacccaggtgatcgtctccagc

SEQ ID NO: 9093 - RNA, 393 nt, synthetic construct
  misc_feature 1..393: note = derived and/or modified sequence opt1 from anti-HIV_10E8
  source 1..393: mol_type = other RNA
gagatccgcctggtggagagcggcgggggcctcgtcaagcccgggggctccctgcggctgagctgctccgccagcgggttcaacttcgactccgcctggatgacctgggtgcgccagccgcccggcaagggcctcgagtgggtggggcggatcaccggccccggggagggctggagcgtcgactacgcggagtccgtgaaggggcgcttcatcatcagccggatcaactccatcaacttcctgtacctggagatgaacaacctccgccccgaggacacgggcagctacttctgcgcccacaccggcaagcactacgacttctggcgggggtacccgcccggcgaggagtacttccaggactgggggcagggcacccaggtgatcgtctccagc

SEQ ID NO: 9094 - RNA, 393 nt, synthetic construct
  misc_feature 1..393: note = derived and/or modified sequence opt1 from anti-HIV_10E8
  source 1..393: mol_type = other RNA
gaggtgcgcctggtcgagagcggcgggcggctcgtgcgccccggcgggtccctgcggctgagctgctccgccagcggcttcaacttcgacaacgcctggatgacctgggtgcgccagccgcccgggaagggcctcgagtgggtcggccggatcaccgggcccggcgaggggtggtccgtggactacgcggccagcgtgaagggccgcttcacgatctcccggatgaacagcatcaacttcttctacctggagatgaacaacctgaagatcgaggacaccgggctctacttctgcgcccgcaccggcaagcactacgccttctggggcgggtacccgcccggcgaggagtacctggaggactgggggcagggcaccctggtcatcgtgtccagc

SEQ ID NO: 9095 - RNA, 393 nt, synthetic construct
  misc_feature 1..393: note = derived and/or modified sequence opt1 from anti-HIV_10E8
  source 1..393: mol_type = other RNA
gaggtgcgcctggtcgagagcggcgggggcctcgtgaagcccgggggctccctgcggctgagctgctccgccagcgggttcaacttcgacgacgcctggatgacctgggtgcgccagccgcccggcaagggcctcgagtgggtcgggcggatctccggccccggggagggctggagcgtggactacgcggagtccgtgaaggggcgcttcaccatcagccggctgaactccatcaacttcctgtacctcgagatgaacaacgtccgcacggaggacaccggctactacttctgcgcccggaccggcaagcactacgacttctggagcgggtacccgcccggcgaggagtacttccaggactgggggcagggcaccctggtgatcgtgtccagc

SEQ ID NO: 9096 - RNA, 393 nt, synthetic construct
  misc_feature 1..393: note = derived and/or modified sequence opt1 from anti-HIV_10E8
  source 1..393: mol_type = other RNA
gaggtgcgcctggccgagagcggcgggggcctcgtcaagcccgggggctccctgcggctgagctgctccgccagcgggttcgacttcgacaacgcgtggatgacctgggtgcgccagccgcccggcaagggcctcgagtgggtggggcggatcaccggccccggggagggctggtccgtcgactacgccgcccccgtggaggggcgcttcacgatcagccggctgaactccatcaacttcctgtacctcgagatgaacaacctgcgcatggaggacagcggcctgtacttctgcgcccggaccggcaagtactacgacttctggtccgggtacccgcccggcgaggagtacttccaggactgggggcagggcaccctcgtgatcgtccccagc

SEQ ID NO: 9097 - RNA, 393 nt, synthetic construct
  misc_feature 1..393: note = derived and/or modified sequence opt1 from anti-HIV_10E8
  source 1..393: mol_type = other RNA
gaggtgcgcctggtcgagagcggcgggggcctcgtgaagcccgggggctccctgcggctgagctgctccgccagcgggttcgacttcgacaacgcctggatgacctgggtgcgccagccgcccggcaagggcctcgagtgggtcgggcggatcaccggccccggggagggctggtccgtggactacgcggcccccgtggaggggcgcttcacgatcagccggctgaactccatcaacttcctgtacctcgagatgaacaacctgcgcatggaggacagcggcctgtacttctgcgcccggaccggcaagtactacgacttctggtccgggtacccgcccggcgaggagtacttccaggactgggggcagggcaccctcgtcatcgtgcccagc

SEQ ID NO: 9098 - RNA, 393 nt, synthetic construct
  misc_feature 1..393: note = derived and/or modified sequence opt1 from anti-HIV_10E8
  source 1..393: mol_type = other RNA
gaggtgcgcctggtcgagagcggcgggggcctcgtgaagcccgggggctccctgcggctgagctgctccgccagcgggttcgacttcgacaacgcctggatgacctgggtgcgccagccgcccggcaagggcctcgagtgggtcgggcggatcaccggccccggggagggctggtccgtggactacgcggcccccgtggaggggcgcttcacgatcagccggctgaactccatcaacttcctgtacctcgagatgaacaacctgcgcatggaggacagcggcctgtacttctgcgcccggaccggcaagtactacgacttctggtccgggtacccgcccggcgaggagtacttccaggactgggggcagggcaccctcgtcatcgtgagctcc

SEQ ID NO: 9099 - RNA, 393 nt, synthetic construct
  misc_feature 1..393: note = derived and/or modified sequence opt1 from anti-HIV_10E8
  source 1..393: mol_type = other RNA
gaggtgcgcctggccgagagcggcgggggcctcgtcaagcccgggggctccctgcggctgagctgctccgccagcgggttcgacttcgacaacgcgtggatgacctgggtgcgccagccgcccggcaagggcctcgagtgggtggggcggatcaccggccccggggagggctggtccgtcgactacgccgcccccgtggaggggcgcttcacgatcagccggctgaactccatcaacttcctgtacctcgagatgaacaacctgcgcatggaggacagcggcctgtacttctgcgcccggaccggcaagtactacgacttctggtccgggtacccgcccggcgaggagtacttccaggactgggggcgcggcaccctcgtgatcgtcagctcc

SEQ ID NO: 9100 - RNA, 393 nt, synthetic construct
  misc_feature 1..393: note = derived and/or modified sequence opt1 from anti-HIV_10E8
  source 1..393: mol_type = other RNA
gaggtgcgcctggtcgagagcggcgggggcctcgtgaagcccgggggctccctgcggctgagctgctccgccagcgggttcgacttcgacaacgcctggatgacctgggtgcgccagccgcccggcaagggcctcgagtgggtcgggcggatcaccggccccggggagggctggtccgtggactacgcggcccccgtggaggggcgcttcacgatcagccggctgaactccatcaacttcctgtacctcgagatgaacaacctgcgcatggaggacagcggcctgtacttctgcgcccggaccggcaagtactacgacttctggtccgggtacccgcccggcgaggagtacttccaggactgggggcgcggcaccctcgtcatcgtgagctcc

SEQ ID NO: 9101 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggcgctccagcaacatcggcaacaacaacgtgttctggtaccagcagctccccgggacggcgcccaagctgctgatctacgacaacgacaagcggccgtccggcatccccgaccgcttcagcgggtccaagagcggcacctccgccaccctcggcatcaccgggctgcagacgggcgacgaggccgactactactgcgggacctgggacagctccctgagcgccggcggggtcttcggcaccggcaccaaggtgacggtgctc

SEQ ID NO: 9102 - RNA, 336 nt, synthetic construct
  misc_feature 1..336: note = derived and/or modified sequence opt1 from anti-HIV-1_LightChain
  source 1..336: mol_type = other RNA
cagagcgtgctgacccagcccgcctccgtcagcggctccccggggcagagcatcaccatctcctgcacgggcaccaagagcgacatcgggggctacaagtacgtgtcctggtaccagcagcaccccgggaaggcccccaagatcctcatctacgacgtgaacaagcgccccagcggcatcccggaccggttctccggcagcaagtccgggaccagcgcgaccctgggcatcacggggctgcagaccggcgacgaggccgactactactgcgggacctgggacaactccctcagcaccggcggcgtcttcgggacgggcaccaaggtgaccgtgctg

SEQ ID NO: 9103 - RNA, 321 nt, synthetic construct
  misc_feature 1..321: note = derived and/or modified sequence opt1 from anti-HIV-1_LightChain
  source 1..321: mol_type = other RNA
cagagcgtgctgacccagcccccgtccgtcagcgccgcccccggccagcgcgtgaccatctcctgcttcgggagccggttctccagcgtgtcctggtaccagcagctccccggcacggcgcccaagctgctgatctacgagaacaccaagcgcccgagcgggatccccgaccggttctccggcagcaagtccgggaccagcgccaccctcggcatcacgggcctgcagaccggggacgaggccgactactactgcggcacctgggaccgctccctgagcgccgggggcgtcttcgggaccggcacgaaggtgaccgtgctc

SEQ ID NO: 9104 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgccagcggcacccccgggcagacgatcaccatctcctgcagcggctccagctccaacatcgggagcaacgacgtctactggtaccagcacctccccggcaccacccccaaggtggtgatctacaagaacaaccgccggccgtccgggatccccgaccgcttcagcggctccaagagcggcacgtccgccaccctggggatcaccggcctgcagaccggggacgaggcggactactactgcggcacgtgggaccggagcctctccgccgggggcgtcttcggcaccgggaccaaggtgaccgtgctg

SEQ ID NO: 9105 - RNA, 327 nt, synthetic construct
  misc_feature 1..327: note = derived and/or modified sequence opt1 from anti-HIV-1_LightChain
  source 1..327: mol_type = other RNA
cagagcgtgctgacccagcccccgtccatgagcgccgcccccggccagaaggtcaccatctcctgcagcgggtccacgagcatcatcggcaacaactacatctcctggtaccagcagctccccgggaccgcgcccaagctgctgatctacgaggacaacaagcgcccgagcggcatccccgaccggttctccgggagcaagtccggcaccagcgccaccctcggcatcacggggctgcagaccggcgacgaggccgactactactgcgggacctggcactccagcctgtccgccggcggggtgttcggcaccggcacgaaggtgacc

SEQ ID NO: 9106 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggcctcaaggtgaccatctcctgcagcgggaacacgtccaacgtgggcgacaacttcgtcagctggtaccgctacctgcccgggaccgcgcccaagctgctctcctacgaggacgacaagcggccgagcggcatccccgaccgcttctccgggagcaagtccggcaccagcgccaccctgggcatcacggggctgcagaccggcgacgaggccgactactactgcgggacctgggactccagcctctccgccggcggggtgttcggcaccggcacgaaggtgaccgtcctg

SEQ ID NO: 9107 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgcgagcggcacccccgggcagcgcgtcacgatctcctgcagcggctccagctccaacatcgggagcaacaccgtgaactggtaccagcagttccccggcaccgcccccaagctcctgatctacgagaacaaccggcgcccgtccggggtgcccgcgcggttcagcggctccaagagcggcacctccgccacgctggccatcaccgggctccagaccggcgacgaggccgactactactgcgccacctgggacagctccctgagcgccgggggcgtcttcgggacgggcaccaaggtgaccgtgctg

SEQ ID NO: 9108 - RNA, 318 nt, synthetic construct
  misc_feature 1..318: note = derived and/or modified sequence opt1 from anti-HIV-1_LightChain
  source 1..318: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgatctacgagaacaacaagcgcccgtccggcatccccgaccggttcagcgggtccaagagcggcacctccgccaccctcggcatcaccgggctgcagacgggcgacgaggccgactactactgcgggacctgggacaacagcctgtccaccggcggggtcttcggcaccggcacg

SEQ ID NO: 9109 - RNA, 288 nt, synthetic construct
  misc_feature 1..288: note = derived and/or modified sequence opt1 from anti-HIV-1_LightChain
  source 1..288: mol_type = other RNA
ggcctgagcccctccctctgcagcgggtccagctccaacatcggcaacaactacgtgagctggtaccagcagctgccggggaccgcgcccaagctgctcatctacgagaacaccaagcgcccctccggcatccccgaccggttcagcgggtccaagagcggcacgtccgccaccctgggcatcaccgggctgcagaccggcgacgagggggactactactgcggcacgtgggaccgcagcctctccgccgggggcgtcttcggcaccgggaccaaggtgaccgtgctg

SEQ ID NO: 9110 - RNA, 333 nt, synthetic construct
  misc_feature 1..333: note = derived and/or modified sequence opt1 from anti-HIV-1_LightChain
  source 1..333: mol_type = other RNA
cagttcgtgctgacccagcccccgagcgtctccgccgcccccggccagcgcgtgaccgtgagctgctccgggacgaccagcgacatcggcgagaactacgtctcctggtaccagaagttcagcgaggcggcccccaagctcctgctgtacgacaacgacaagcggccctccgggatcccggaccgcttcagcggctccaagagcgggacctccgccaccctcggcatcacgggcctgcagaccggggacgaggccgactactactgcggcacctgggacagctccctgagcgccgggggcgtgttcgggaccggcacgaaggtgaccgtcctc

SEQ ID NO: 9111 - RNA, 327 nt, synthetic construct
  misc_feature 1..327: note = derived and/or modified sequence opt1 from anti-HIV-1_LightChain
  source 1..327: mol_type = other RNA
cagagcgtgctgacccagcccccgtccgtcagcgccgcccccggccagaaggtgaccatctcctgcagcgggggctccagcaacatcgggaactactacgtgtcctggtacctccagctgcccggcacggcgcccaagctgctcatctacgagaacaacaagcgcccgagcgggatccccgaccggttctccggcagcaagtccggcaccagcgccaccctggggatcaccggcctgcagacgggggacgaggccgactactactgcggcacctggcactccagcctctccgccgggggcgtcttcggcaccgggaccaaggtgacg

SEQ ID NO: 9112 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggaacatgtccaacatcggcgacaacgccgtgagctggtaccgccaggtccccgaggcgcccccgcagctcctgatcttcgggaacgacaagcggccctccggcgtgacggaccgcttcagcgggtccaagagcggcacctccgccaccctgggcatcaccgggctccagacgggcgacgaggccgactactactgcgggacctgggaccggagcctgtccgccggcggggtgttcggcaccggcaccaaggtcacggtgctg

SEQ ID NO: 9113 - RNA, 336 nt, synthetic construct
  misc_feature 1..336: note = derived and/or modified sequence opt1 from anti-HIV-1_LightChain
  source 1..336: mol_type = other RNA
cagagcgtgctgacccagcccccgtccgtcagcggcgcccccgggcagcgcgtgaccatctcctgcacgggcagctccagcaacatcggggccggctacgacgtgcactggtacctccagctgcccgggaccgcgccccggctgctcatctacgacaacgacaagcgcccgtccggcatccccgaccggttcagcggctccaagagcgggacctccgccaccctgggcatcacggggctgcagaccggcgacgaggccgactactactgcgggacctggcacagctccctcagcgccggcggcgtcttcgggaccggcacgaaggtgaccgtgctg

SEQ ID NO: 9114 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccacgagcaacatcggcaacaacttcgtgtcctggtaccagcagctccccgggaccgcgcccaagctgctgttctacgacaactacaagcgcccgagcggcatccccgaccggttctccgggagcaagtccggcaccagcgccaccctcgccatcacgggcctgcagaccggggacgaggccgactactactgcgccacctgggactccagcctgtccgcgggcggggtcttcggcaccgggacgaaggtgaccgtgctc

SEQ ID NO: 9115 - RNA, 336 nt, synthetic construct
  misc_feature 1..336: note = derived and/or modified sequence opt1 from anti-HIV-1_LightChain
  source 1..336: mol_type = other RNA
cagagcgtgctgacccagcccccgtccgtcagcggcgcccccgggcagcgcgtgaccatctcctgcacgggcgggagctccaacatcggcgccgggtacgacgtgcactggtaccagcacctccccggcaccgcgccccagctgctgatctacgagaacaccaagcggccgagcggcatccccgaccgcttctccgggagcaagtccggcaccagcgccacgctcgggatcaccggcctgcagaccggggacgaggccgactactactgcggcacctgggaccggtccctgagcgccggcggggtcttcggcacggggaccaaggtgaccgtgctc

SEQ ID NO: 9116 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccctcagcgccgcccccggccagcgcgtcaccgtgtcctgcagcgggtccagctccaacatcggcgacaactacgtgagctggtaccagcagctgcccggggccgcgccccggctgctcatctacgagaacaacaagcgcccgtccggcatccccgaccggttcagcgggtccaagagcggcacgtccgccaccctgggcatcaccgggctgcagaccggcgacgaggccgactactactgcgggacgtgggacaacagcctctccaccggcggggtcttcggcaccggcaccaaggtgacggtgctg

SEQ ID NO: 9117 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggcgctccagcaacatcggcaactacttcgtgtcctggtaccagcagttccccgggacggcgcccaagctcctgatctacgacaacaacaagcggccgagcggcatccccgaccgcttctccgggagcaagtccggcaccagcgccaccctgggcatcaccgggctccagacgggcgacgaggccgactactactgcgggacctgggaccggtccctgagcgccggcggggtcttcggcaccggcaccaaggtgacggtgctg

SEQ ID NO: 9118 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgccagcggcacccccgggcagcgcgtcacgatctcctgcagcggctccagctccaacatcgggagcaacgccgtgcactggttccggcagctccccggcaccgcgcccaagctgctgatctacgagaacaacaagcgcccgtccgggatccccgaccggttcagcggctccaagagcggcacctccgccaccctcgggatcacgggcctgcagaccggggacgaggccgactactactgcgccacctgggacagctccctgagcgccggcggggtgttcggcaccggcacgaaggtcaccgtgctc

SEQ ID NO: 9119 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcctccggccagaaggtgaccatcagctgctccgggagctccagcaacatcggcaacaactacgtgtcctggtaccaccagctccccgggacggcgcccaagctgctgatctacgacaccaacaagcgccccagcggcatcccggaccggttctccgggagcacctccggcaccagcgccacgctcggcatcaccgggctgcagaccggcgacgaggccgactactactgcgggacctgggacaactccctgagcacgggcggggtcttcggcaccggcaccaaggtgaccgtgctc

SEQ ID NO: 9120 - RNA, 333 nt, synthetic construct
  misc_feature 1..333: note = derived and/or modified sequence opt1 from anti-HIV-1_LightChain
  source 1..333: mol_type = other RNA
cagcccgtgctgacccagccgcccagcgtctccgccgcccccggccagaccgtgacgatcagctgctccgggagcttctccaacatcgagaccaactacgtgagctggtaccagcagctccccggcaccgcgccgaagctgctgatctacgacaacaacatgcgcccctccgggatccccgaccggttcagcggctccaagagcgggacctccgccacgctcggcatcaccggcctgcagaccggggacgaggccgactactactgcggcacctgggacacgagcctgtccgccgggggcgtcttcgggaccggcaccaaggtgaccgtgctc

SEQ ID NO: 9121 - RNA, 336 nt, synthetic construct
  misc_feature 1..336: note = derived and/or modified sequence opt1 from anti-HIV-1_LightChain
  source 1..336: mol_type = other RNA
cagcccgtgctgacccagccgcccagcgtctccggcgcccccgggcagcgcgtgaccatcagctgcacgggctccagctccaacatcggggccggctacgacgtgcactggtaccagcagctccccgggaccgcgccgaagctgctgatctacgagaacaacaagcggcccagcggcatccccgaccgcttctccggcagcaagtccgggaccagcgccaccctcggcatcacggggctgcagaccggcgacgaggccgactactactgcgggacctgggacaactccctgagcaccggcggcgtcttcgggacgggcaccaaggtgaccgtgctc

SEQ ID NO: 9122 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccctcagcgccgcccccggccagcgcatcaccatctcctgcagcgggtccagctccaacatcggcaacaactacgtcagctggtaccagcagttccccgggacggcgcccaagctgctgatctacgagaacaacaagcggccgtccggcatccccgaccgcttcagcgcctccaagagcgggacctccgccaccctcggcatcaccggcctgcagacgggggacgaggccaactactactgcggcacctggcacagctccctgagcgccgggggcgtgttcgggaccggcaccaaggtgacggtcctc

SEQ ID NO: 9123 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagcgcgtgaccatctcctgcttcgggagccggttcaacgtgggcacgtccagcgtctcctggtaccagcagctccccgggaccgcgcccaagctgctgatcgacgccaacggcgagcgcccgagcgggatccccgaccggttctccggcagcaagtccggcaccagcgccaccctcgggatcacgggcctgcagaccggggacgaggccgactactactgcggcacctgggactccagcctgtccgccgggggcgtgttcggcaccgggacgaaggtgaccgtcctc

SEQ ID NO: 9124 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccacccccggccagaaggtgacgatctcctgcagcgggtcccgcagcaacatcggctcccactacgtgagctggtaccagcagttccccgggaccgcccccaagctcctgatctacgacaacaacaagcggccgtccggcatccccgaccgcttcagcgggtccaagagcggcacctccgcgaccctgggcatcacggggctccagaccggcgacgaggccgactactactgcgggacctggcacagctccctgagcgccggcggggtcttcggcaccggcacgaaggtgaccgtgctg

SEQ ID NO: 9125 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgccagcggcacccccgggcagcgcgtcacgatctcctgcagcggctccagctccaacatcgggagcaaccacgtgtactggtaccagcagctccccggcaagacccccaagctgctgatctaccggaacaaccagcgcccgtccgggatccccgaccggttcagcggctccaagagcggcacctccgccaccctcgggatcacgggcctgcagaccggggacgaggcggactactactgcggcacctgggacagctccctgagcaccgggggcgtgttcggcacggggaccaaggtcaccgtgctc

SEQ ID NO: 9126 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgcggcccccggccagaaggtgaccatctcctgcagcgggtccagcgcgaacatcggcaacaactacgtgtcctggtaccagcagttccccgggacgggcccccgcctcatcatctacgagagcaacaagcggccgtccgggatcagcgaccgcttctccggcagccagtccgacgccgccgccaccctggacatcaccggcctgcagaccggggacgaggccgactactactgcggcacgtgggacagctccctcagcgccgggggcgtcttcgggaccggcacccgggtgaccgtgctg

SEQ ID NO: 9127 - RNA, 336 nt, synthetic construct
  misc_feature 1..336: note = derived and/or modified sequence opt1 from anti-HIV-1_LightChain
  source 1..336: mol_type = other RNA
cagagcgtgctgacccagcccccgtccgtcagcggcgcccccgggcagaccgtgacgatctcctgcaccggcgacaccagcaacatcggggccgactaccgcgtgcactggtaccagcagctccccggcaccgcgcccaagctgctgatctacgagaacaacaagcggccgtccgggatccccgaccgcttcagcggctccaagagcggcacgtccgccaccctcgggatcaccggcctgcagaccggggacgaggccgactactactgcggcacgtgggacaacagcctgtccaccgggggcgtcttcggcaccgggaccaaggtgacggtgctc

SEQ ID NO: 9128 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccctcagcgccgcccccggccagcgcgtcaccgtgtcctgcagcgggtccagctccaacatcggcaacaactacgtgagctggtaccagcagctgcccggggcggcccccaagctgctcatctacaacaacaacatccggccgtccggcatccccgagcgcttcagcgggtccaagagcggcacgtccgccaccctgggcatcaccgggctgcagaccggcgacgagggggactactactgcggcacgtgggaccggagcctctccgccgggggcgtcttcggcaccgggaccaaggtgaccgtgctg

SEQ ID NO: 9129 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgccagcggcacccccgggcagcgcgtcacgatctcctgcagcggctccagctccaacatcgggggcaactacgtgagctggtaccagcagctccccgggaccgcccccaagctgctgatctccgagaacaacaagcggccgagcggcatccccgaccgcttctccggcagcaagtccgggaccagcgcgaccctcggcatcacggggctgcagaccggcgacgaggccgactactactgcgggacctgggactccagcctgtccgccggcggcgtgttcgggaccggcacgaaggtcaccgtgctc

SEQ ID NO: 9130 - RNA, 333 nt, synthetic construct
  misc_feature 1..333: note = derived and/or modified sequence opt1 from anti-HIV-1_LightChain
  source 1..333: mol_type = other RNA
cagagcctgctcacccagcccccgtccgtgagcgccgcccccggccagaaggtcaccatctcctgcagcgggtccagctccaacatcggcaacaacttcgtgagctggtaccagcagctgcccgggacggcgcccaagctgctcatctacgagaacaacatgcgcccgtccggcatccccgaccggttcagcgggtccaagagcggcacctccgccaccctgggcatcaccgggctgcagacgggcgacgaggccgactactactgcgggacctgggacagctccctcagcgccggcggggtgttcggcaccggcaccaaggtcacggtgctg

SEQ ID NO: 9131 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggacgtccagcaacatcgcgaactactacgtgtcctggtaccgccagctccccggcaccgcccccaagctgctgatctacgagaacaacaagcggccgagcgggatccccgaccgcttctccggcagcaagtccgggaccagcgccaccctcggcatcacgggcctgcagaccggggacgaggccgactactactgcggcacctgggactccagcctgtccgccgggggcgtcttcgggaccggcacgaaggtgaccgtgctc

SEQ ID NO: 9132 - RNA, 333 nt, synthetic construct
  misc_feature 1..333: note = derived and/or modified sequence opt1 from anti-HIV-1_LightChain
  source 1..333: mol_type = other RNA
cagcccgtgctgacccagccgcccagcgtctccggcgcccccgggcagcgcgtgaccatcagctgctccggcagctccagcaacatcgggaacaacgacgtgtcctggtaccagcaggtccccggcacggccccgaagctcctgatctacgagaacaacaagcggcccagcgggatccccgaccgcttctccggcagcaagtccggcaccagcgcgaccctggggatcaccggcctccagacgggggacgaggccgactactactgcggcacctgggacacctccctgagcgccgggggcgtgttcggcaccgggacgaaggtgaccgtcctg

SEQ ID NO: 9133 - RNA, 333 nt, synthetic construct
  misc_feature 1..333: note = derived and/or modified sequence opt1 from anti-HIV-1_LightChain
  source 1..333: mol_type = other RNA
cagctggtgctcacccagcccccgagcgtctccgccgcccccggccagcgcgtgaccatcagctgcttcgggtcccggttcaacgtgggcacgagctccgtcagctggtaccagcagctgcccgggaccgcgcccaagctgctcatcgacgccaacggcgagcgcccgtccgggatccccgaccggttcttcggcagcgagtccggcaccagcgccaccctggggatcacgggcctgcagaccggggacgaggccgactactactgcggcacctggcactccagcctctccgccgggggcgtgttcggcaccgggacgaaggtgaccgtcctg

SEQ ID NO: 9134 - RNA, 333 nt, synthetic construct
  misc_feature 1..333: note = derived and/or modified sequence opt1 from anti-HIV-1_LightChain
  source 1..333: mol_type = other RNA
agctacgagctgacccagcccccgtccgtgagcgccgcccccggccagaaggtcaccatctcctgcagcgggtccagctccaacatcggcaacaactacgtgagctggtaccagcagctccccgggacggcgcccaagctgctgatctacgagaacaacaagcgcccgtccggcatccccgaccggttcagcgggtccaagagcggcacctccgccaccctcggcatcaccgggctgcagacgggcgacgaggccgactactactgcgggacctgggacaccagcctgtccgccggcggggtgttcggcaccggcacgaaggtcaccgtgctc

SEQ ID NO: 9135 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgccagcggcacccccgggcagcgcgtcacgatctcctgcagcggctccaccagcaacatcgggacctactacgtgtcctggtaccagcagctccccggcaccgcccccaagctgctgatctacgagaacacgaagcggccgagcgggatccccgaccgcttctccggcagcaagtccggcaccagcgcgaccctcgggatcaccggcctgcagacgggggacgagggcgactactactgcgggacctgggaccggtccctgagcgccggcggcgtgttcgggaccggcaccaaggtcacggtgctc

SEQ ID NO: 9136 - RNA, 336 nt, synthetic construct
  misc_feature 1..336: note = derived and/or modified sequence opt1 from anti-HIV-1_LightChain
  source 1..336: mol_type = other RNA
cagagcgccctgacccagcccgcctccgtgagcgcgtccccgggccagagcatcgccatctcctgcaccgggacgagctccgacgtcggcagctacaactacgtgtcctggtaccagcagctccccgggaccgcccccaagctgctgatctacgagaacaccaagcgccccagcggcatcccggaccggttctccgggagcaagtccggcaccagcgccacgctcggcatcaccgggctgcagaccggcgacgaggccgactactactgcgggacctgggaccgctccctgagcgcgggcggggtgttcggcacgggcaccaaggtcaccgtgctc

SEQ ID NO: 9137 - RNA, 330 nt, synthetic construct
  misc_feature 1..330: note = derived and/or modified sequence opt1 from anti-HIV-1_LightChain
  source 1..330: mol_type = other RNA
cagagcgtgctgacccagcccccgtccgtcagcgccgcccccggccagcgcgtgaccatctcctgcagcgggggctccagcaacatcgggaacaaccacgtgtcctggtaccagcacctccccggccgggcgccccagctgctgatctacgacacgacccagcgcccgagcgggatccccgaccggttctccggcagcaagtccggcaccagcgccaccctcgggatcacgggcctgcagaccggggacgaggccgactactactgcggcacctgggactccagcctgtccaccgggggcgtcttcggcacggggaccaaggtgaccgtg

SEQ ID NO: 9138 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgccagcggcacccccgggcagcgcgtcacgatctcctgcagcggctccagctccaacatcgggagcaagtacgtgtgctggtaccagcagctccccggcaccgcccccaagctgctgatctaccggaacaaccagcgcccgtccgggatccccgaccggttcagcggctccaagagcggcacctccgcgaccctcgggatcacgggcctgcagaccggggacgaggccgactactactgcggcacctggcacagctccctgagcgccgggggcgtgttcggcaccgggacgaaggtcaccgtgctc

SEQ ID NO: 9139 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcggggactccagcacgttcgagaacgactacgtgtgctggtaccagcagctccccggcaccgcgcccaagctgctgatctacgacaacaacaagcgcccgtccgggatccccgaccggttcagcggctccaagagcgggacctccgccaccctcggcatcacgggcctgcagaccggggacgaggccgactactactgcggcacctggcacagctccctgagcgccgggggcgtcttcgggaccggcacgaaggtgaccgtgctc

SEQ ID NO: 9140 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgcggcccccggccagaaggtgaccatctcctgcagcgggtccagctccaacatcggcaacaactacgtgagctggtaccagcagctccccgggacggcgcccaagctgctgatctacggcaactccaaccgcccgagcggggtccccgaccggttctccggcagcaagtccggcaccagcgcctccctcgccatcaccgggctgcaggccgaggacgaggccgactactactgcggcacctgggacagctccctgagcgccgggggcgtgttcgggacgggcaccaaggtgaccgtcctc

SEQ ID NO: 9141 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaccgtgacgatctcctgcagcgggtccagctccaacatcggcagcaacaccgtgaactggtaccagcagctccccgggaccgcgcccaagctgctgatctacgagaacaacaagcgcccgtccggcatccccgaccggttcagcgggtccaagagcggcacctccgccacgctcggcatcaccgggctgcagaccggcgacgaggccgactactactgcgggacctgggacaacagcctgtccacgggcggggtcttcggcaccggcaccaaggtgaccgtgctc

SEQ ID NO: 9142 - RNA, 336 nt, synthetic construct
  misc_feature 1..336: note = derived and/or modified sequence opt1 from anti-HIV-1_LightChain
  source 1..336: mol_type = other RNA
cagagcgtgctgacccagcccccgtccgtcagcggcgcccccgggcagcgcgtgaccatcttctgcacgggctccagctccaacgtcgggggcgggtacgacgtgcactggtaccagcagctccccggcaccgcccccaagctgctgatctacgagaacaacaagcggccgagcggcatccccgaccgcttctccgggagcaagtccggcaccagcgcgaccctcgggatcacgggcctgcagaccggggacgaggccgactactactgcggcacctgggactccagcctgtccgccggcggggtgttcggcaccgggacgaaggtgaccgtcctc

SEQ ID NO: 9143 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccctctcctgcagcgggtccagctccaacatcggcaacaacagcgtgtcctggtaccagcagttccccgggacggcgcccaagctgctgatctacgacagcgacaagcgcccgtccggcatccccgaccggttcagcgggtccaagagcggcacctccgccaccctcggcatcaccgggctgcagacgggcgacgagggggactactactgcggcacctgggaccgcagcctgtccgccgggggcgtcttcggcaccgggaccaaggtgacggtgctc

SEQ ID NO: 9144 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgccagcggcacccccgggcagaaggtcacgatctcctgcagcggctccagctcccagatcgggagcaactccgtgtactggtaccagcagctccccggcaccacccccaagctgctgatctacgggaacaaccagcgcccgagcggcatccccgaccggttctccggcagcaagtccgggaccagcgccacgctcggcatcaccgggctgcagaccggcgacgaggcggactactactgcgggacctgggactccagcctgtccgccggcggcgtgttcgggacgggcaccaaggtcaccgtgctc

SEQ ID NO: 9145 - RNA, 336 nt, synthetic construct
  misc_feature 1..336: note = derived and/or modified sequence opt1 from anti-HIV-1_LightChain
  source 1..336: mol_type = other RNA
cagagcgccctgacccagcccgcctccgtgagcggctccccggggcagagcatcaccatctcctgcacgggcaccgggagcgacgtcggcgggtacaaccacgtgtcctggtaccagcagcaccccggcaaggcgcccaagctcctgatctacgacaacaacaagcgccccagcggcatcccggaccggttctccgggagcaagtccggcaccagcgccaccctggggatcacgggcctccagaccggggacgaggccgactactactgcggcacctggcactccagcctgtccgccggcggggtgttcggcaccgggacgaaggtcaccgtgctg

SEQ ID NO: 9146 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagcgcgtgaccatctcctgcagcgggtccggcagcaacatcggggaccggttcgtgtcctggtaccagcacctccccggcacggtccccaagctgctgatctacgacaacgagcaccgcccgagcgggatccccgaccggttctccggcagcaagtccggcaccagcgcgaccctcgggatcaccggcctgcagacgggggacgaggccgactactactgcggcacctgggactccagcctgtccgccgggggcgtgttcggcaccgggaccaaggtgacggtcctc

SEQ ID NO: 9147 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaagatcaccatctcctgcagcgggtccagctccaacatcggcaagagcgtggtgtcctggtaccgccagttccccgggacggcgcccaagctcctgatctacgacacctacaagcggccgagcggcatccccgaccgcttctccgggagcaagtccggcaccagcgccaccctgggcatcacggggctccagaccggcgacgaggccgactactactgcgggacctggcactccagcctgtccgccggcggggtcttcggcaccggcacgaaggtgaccgtgctg

SEQ ID NO: 9148 - RNA, 333 nt, synthetic construct
  misc_feature 1..333: note = derived and/or modified sequence opt1 from anti-HIV-1_LightChain
  source 1..333: mol_type = other RNA
cagcccgtgctgacccagccgcccagcgcctccggcacccccgggcagcgcgtcacgatcagctgctccggcagctccagcaacatcgggggcaacaccgtgaactggtaccagcagttccccggggccgcgccgcggctcctgatctacgaggacaacaagcgcccctccggcatccccgaccggttcagcggctccaagagcgggacctccgccaccctgggcatcacggggctccagaccggcgacgaggccgactactactgcgggacctgggacagctccctgagcgccggcggcgtgttcgggaccggcacgaaggtcaccgtgctg

SEQ ID NO: 9149 - RNA, 333 nt, synthetic construct
  misc_feature 1..333: note = derived and/or modified sequence opt1 from anti-HIV-1_LightChain
  source 1..333: mol_type = other RNA
aacttcatgctgacccagccccacagcgtgtccgagagcccgggcaagaccgtcacgatctcctgcacccgcagctccgggagcgtggcctccaactacgtgcagtggtaccagcagctccccggcaccgcccccaagctgctgatctacgagaacaacaagcggcccagcgggatcccggaccgcttctccggcagcaagtccgggaccagcgcgacgctcggcatcaccggcctgcagaccggggacgaggccgactactactgcggcacctggcactccagcctgtccgccgggggcgtcttcgggacgggcaccaaggtgaccgtgctc

SEQ ID NO: 9150 - RNA, 333 nt, synthetic construct
  misc_feature 1..333: note = derived and/or modified sequence opt1 from anti-HIV-1_LightChain
  source 1..333: mol_type = other RNA
cagagcatgctgacccagcccccgtccgtgagcgccgcccccggccagcgcgtcaccgtgtcctgcagcgggtccagctccaacatcggcagccacttcgtgtcctggtaccagcagctccccgggacggcgcccaagctgctgatctacgacaacagcaaccggccgtccgccatccccgaccgcttcagcggctccaagagcgggacctccgccaccctcggcatcagcggcctgcacaccggggacgaggccgactactactgcgccacgtgggacaactccctgagcaccggcggggtcttcggcaccgggaccaaggtgacggtgctc

SEQ ID NO: 9151 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgatcatctcctgcagcgggggctccagcaacatcgggaacaacttcgtgtcctggtaccaccagctccccggcaccgcgcccaagctgctgatctacgagaacacgaagcgcccgagcaagatccccgcccggttctccgggagcaagtccggcaccagcgccaccctcggcatcaccgggctgcagacgggcgacgaggccgactactactgcgggacctgggactccagcctgtccgccggcggggtcttcggcaccggcaccaaggtgacggtgctc

SEQ ID NO: 9152 - RNA, 315 nt, synthetic construct
  misc_feature 1..315: note = derived and/or modified sequence opt1 from anti-HIV-1_LightChain
  source 1..315: mol_type = other RNA
cagagcctgctcacccagcccccgtccgtgagcgccgcccccggccagaaggtcaccatctcctgcagcgggtccagctccaacatcggcaacaactacgtgagctggtaccagcagctgcccgggacggcgcccaagctgctcatctacgagaacaacaagcgcccgtccggcatccccgaccggttcagcgggtccaagagcggcacctccgccaccctgggcatcaccgggctgcagacgggcgacgaggccgactactactgcgggacctgggacagctccctcagcgccggcggggtgttcggcaccggc

SEQ ID NO: 9153 - RNA, 336 nt, synthetic construct
  misc_feature 1..336: note = derived and/or modified sequence opt1 from anti-HIV-1_LightChain
  source 1..336: mol_type = other RNA
cagagcgccctgacccagcccgcctccgtgagcggctccccggggcagagcatcaccatctcctgcacgggcaccagctccgacatcgggagctactccttcgtcagctggtaccagcagcaccccggcaaggcgcccaagctcatcatctacgacgtgaacaagcgcccctccgggatcccggaccggttcagcggctccaagagcggcacctccgccaccctggggatcacgggcctgcagaccggggacgaggccgactactactgcggcacctgggaccgcagcctctccgccgggggcgtgttcggcaccgggacgaaggtcaccgtgctg

SEQ ID NO: 9154 - RNA, 336 nt, synthetic construct
  misc_feature 1..336: note = derived and/or modified sequence opt1 from anti-HIV-1_LightChain
  source 1..336: mol_type = other RNA
cagagcgtgctgacccagcccccgtccgtcagcggcgcccccgggcagcgcgtgaccatctcctgcacgggcaacagctccaacatcggggccggcttcgacgtgcactggtaccggcacctccccgggaccgcgcccaagctgctgatctacgagaacaccaagcgcccgagcggcatccccgaccggttctccggcagcaagtccgggaccagcgccacgctcggcatcaccgggctgcagaccggcgacgaggccgactactactgcgggacctgggaccgctccctgagcgccggcggcgtcttcgggacgggcaccaaggtgaccgtgctc

SEQ ID NO: 9155 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggggctccagcaacatcgggaactactacgtgtcctggtacctccagctgcccggcgcggcccccaagctgctcatctacgacacggacaagcgcccgagcgggatccccgaccggttctccggcagcaagtccggcaccagcgccaccctggggatcaccggcctgcagacgggggacgaggccgactactactgcggcacctgggaccgctccctcagcgccgggggcgtcttcggcaccgggaccaaggtgacggtgctg

SEQ ID NO: 9156 - RNA, 333 nt, synthetic construct
  misc_feature 1..333: note = derived and/or modified sequence opt1 from anti-HIV-1_LightChain
  source 1..333: mol_type = other RNA
cagagcgtgctgacccggcccccgtccgtcagcgccgcccccggccagaaggtgaccatctcctgcagcgggcgctccagcaacatcggcaacaactacgtgtcctggtaccagcagctccccggggcggcccccaagctgctgatctacgagaacaacaagcgcccgagcggcatccccgaccggttctccgggagcaagtccggcacgagcgccaccctcggcatcaccgggctgcagaccggcgacgaggccgactactactgcgggacgtgggactccagcctgtccgccggcggggtcttcggcaccggcaccaaggtgaccgtgctc

SEQ ID NO: 9157 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggacgatctccaacatcggcgcgaacctcgtgagctggtaccgccagctgcccgggaccgtccccaccgtgctgatccacgagaacaacaagcggccgtccggcatccccgaccgcttcagcgggtccaagagcggcacctccgccacgctcggcatcaccgggctgcagaccggcgacgaggccgactactactgcgggacctggcacagctccctgagcgccggcggggtgttcggcacgggcaccaaggtcaccgtgctc

SEQ ID NO: 9158 - RNA, 327 nt, synthetic construct
  misc_feature 1..327: note = derived and/or modified sequence opt1 from anti-HIV-1_LightChain
  source 1..327: mol_type = other RNA
cagagcgtgctgacccagcccccgtccgtcagcgccgcccccggccagaaggtgaccatctcctgcagcgggtccagctccaacatcggcaacaacttcgtgagctggtaccagcagctccccgggacggcgcccaagctgctgatctacgagaacaccaagcgcccgtccggcatccccgaccggttcagcgggtccaagagcggcacctccgccaccctcggcatcacggggctgcagaccggcgacgaggccgactactactgcgggacctgggaccgcagcctgtccgccggcggggtcttcggcaccggcacgaaggtgacc

SEQ ID NO: 9159 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagtcccccagcgtctccgccgccccgggccagcgcgtgaccatcagctgctccgggggcagctccaacatcgggagcaacgcggtgtcctggtaccagcagctccccggcacggcccccaagctgctgatctacggggacaccatgcggcccagcggcatcccggaccgcttctccggcagcaagtccgggaccagcgccaccctcggcatcacggggctgcagaccggcgacgaggccgactactactgcgggacctgggaccggtccctgagcgccggcggcgtcttcgggaccggcacgaaggtgaccgtgctc

SEQ ID NO: 9160 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagcaggtcaccatctcctgcagcgggacgacctccaacatcggcaccaactacgtgagctggtaccagcagatgccgcccgcggcccccaagctcctgatctacgacaacaagaagcgcccctccgacatccccgaccggttcagcgggtccaagagcggcacctccgccacgctggggatcaccggcctccagaccggcgacgaggccgactactactgcgggacctgggaccgcagcctgtccgccggcggggtgttcggcacggggaccaaggtgaccgtgctg

SEQ ID NO: 9161 - RNA, 333 nt, synthetic construct
  misc_feature 1..333: note = derived and/or modified sequence opt1 from anti-HIV-1_LightChain
  source 1..333: mol_type = other RNA
cagagcgtggtcacccagtcccccagcgcctccggcaccccggggcagcgcgtgatcatcagctgctccggcagctccagcaacatcgggaacatctacgtgtcctggtaccagcagctgcccggcacggcccccaagctcctgatctacgagaacaacaagcggcccagcgggatcccggaccgcttctccggcagcaagtccggcaccagcgcgaccctggggatcaccggcctccagacgggggacgaggccgactactactgcggcacctggcactccagcctgtccgccgggggcgtcttcggcaccgggaccaaggtgacggtgctg

SEQ ID NO: 9162 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccatgagcgccgcccccggccagaaggtcaccatctcctgcagcgggtccacgagcatcatcggcaacaactacatctcctggtaccagcagctccccgggaccgcgcccaagctgctgatctacgaggacaacaagcgcccgagcggcatccccgaccggttctccgggagcaagtccggcaccagcgccaccctcggcatcacggggctgcagaccggcgacgaggccgactactactgcgggacctgggaccgctccctgagcgccggcggggtgttcggcaccggcacgaaggtgaccgtcctc

SEQ ID NO: 9163 - RNA, 336 nt, synthetic construct
  misc_feature 1..336: note = derived and/or modified sequence opt1 from anti-HIV-1_LightChain
  source 1..336: mol_type = other RNA
cagagcgccctgacccagcccccgtccgccagcggctcccgcgggcagagcgtgatcatctcctgcaccggcacgagctccgacgtcggggtgtacaacctcgtgagctggtaccagcagctgcccggcaccgcgcccaagctgctcatctacgagaacaacaagcggccctccgggatcccggaccgcttcagcggctccaagagcggcacctccgccaccctggggatcacgggcctgcagaccggggacgaggccgactactactgcggcacctggcacagctccctcagcgccgggggcgtcttcggcaccgggacgaaggtgaccgtgctg

SEQ ID NO: 9164 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccatgagcgccgcccccggccagtccgtcagcatctcctgcagcgggtccagcgacaacatcgagcgcaaccaggtgatctggctccgccaggtgcccggcgcggcccccaccgtcctgatcatcttcaacaaccggcggccgtccggggtgcccgaccgcttcagcggctcccggagcgggacgtccgccaccctgggcatcaccggcctccagaccggggacgaggccgactactactgcggcacgtgggaccgcagcctgtccgccgggggcgtgttcgggaccggcaccaaggtcaccgtgctg

SEQ ID NO: 9165 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaccgtgacgatctcctgcagcgggtccttcagcaacatcgagaccaactacgtgtcctggtaccagcagctccccggcaccgcgcccaagctgctgatctacgagaacaccaagcgcccgagcgggatccccgaccggttctccggcagcaagtccgggacgagcgccaccctcggcatcaccggcctgcagaccggggacgaggccgactactactgcggcacgtgggaccgctccctgagcgccgggggcgtcttcgggaccggcaccaaggtgaccgtgctc

SEQ ID NO: 9166 - RNA, 333 nt, synthetic construct
  misc_feature 1..333: note = derived and/or modified sequence opt1 from anti-HIV-1_LightChain
  source 1..333: mol_type = other RNA
cagagcctgctcacccagcccccgtccgtgagcgccgcccccggccagaaggtcaccatctcctgcagcgggtccagctccaacatcggcagcaagtacgtgtgctggtaccagcagctgcccgggacggcgcccaagctgctcatctacgagaacaccaagcgcccgtccggcatccccgaccggttcagcgggtccaagagcggcacctccgccaccctgggcatcacggggctgcagaccggcgacgaggccgactactactgcgggacctgggaccgcagcctctccgccggcggggtgttcggcaccggcacgaaggtcaccgtgctg

SEQ ID NO: 9167 - RNA, 336 nt, synthetic construct
  misc_feature 1..336: note = derived and/or modified sequence opt1 from anti-HIV-1_LightChain
  source 1..336: mol_type = other RNA
cagagcgccctgacccagccccgctccgtgagcggctccccggggcagagcgtcaccatctcctgcacgggcaccaccagcgacgtcgggggctacaactacgtgtcctggtaccagcagctccccgggaccgcccccaagctgctgatctacgagaacaacaagcggcccagcggcatcccggaccgcttctccggcagcaagtccgggacgagcgcgaccctcggcatcaccgggctgcagaccggcgacgaggccgactactactgcgggacgtgggacaactccctgagcaccggcggcgtgttcgggaccggcaccaaggtgacggtgctc

SEQ ID NO: 9168 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagcgcgtgaccatctcctgcacggggttcaccagcaacatcggcctcaactacgtgtcctggtaccagcaggtccccgggaccacccccaagctggtgatcttcgagaacgaccggcgcttcctgggcatcccggaccggttcagcgggtccaagagcggcgcgtccgccacgctcggcatcaccgggctgcagaccggcgacgaggccgactactactgcgggacctgggacagctccctgagcgccggcggggtgttcggcacgggcaccaaggtcaccgtgctc

SEQ ID NO: 9169 - RNA, 333 nt, synthetic construct
  misc_feature 1..333: note = derived and/or modified sequence opt1 from anti-HIV-1_LightChain
  source 1..333: mol_type = other RNA
cagagcgtgctggcccagcccccgtccgtcagcgccgcgcccggccagaaggtgaccatctcctgcagcgggcgcacctccaacatcggcaacaactacgtgagctggtaccagcagctccccgggacggcccccaagctgctgatctacgagaacaacaagcggccgtccggcatccccgaccgcttcagcgggtccaagagcggcacctccgccaccctcggcatcaccgggctgcagacgggcgacgaggccgactactactgcgggacctgggacaccagcctgtccgccggcggggtcttcggcaccggcacgaaggtgaccgtgctc

SEQ ID NO: 9170 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccacctccgtcagcgccgccccgggccgctgggtgacggtgtcctgcagcgggacccggtccaacatcggcgaccacagcgtctcctggttccagcacctccccggggcggcccccaagctgctgatctacgagaacaacaagcgccccagcggcatcccggaccggttctccgggagcaagtccggcaccagcgccaccctcggcatcacggggctgcagaccggcgacgaggccgactactactgcgggacctgggactccagcctgtccaccggcggggtgttcggcacgggcaccaaggtgaccgtcctc

SEQ ID NO: 9171 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccagctccaacatcggcgacaactacgtgagctggtaccagcagttccccgggacggcgcccaagctcctgatctccgagaacaacaagcgcccgagcggcatccccgaccggttctccgggagcaagtccggcaccagcgccaccctgggcatcaccgggctccagacgggcgacgaggccgactactactgcgggacctgggactccagcctgtccgccggcggggtcttcggcaccggcaccaaggtgacggtgctg

SEQ ID NO: 9172 - RNA, 333 nt, synthetic construct
  misc_feature 1..333: note = derived and/or modified sequence opt1 from anti-HIV-1_LightChain
  source 1..333: mol_type = other RNA
caggccctgctcacccagcccccgagcgtgtccgccgcgcccggccagaaggtcaccatcagctgctccgggagctccagcaacatcggcaacaactacgtgtcctggtaccagcagctgcccgggacggcccccaagctgctcatcagcgagaacaacaagcgcccgtccggcatccccgaccggttcagcgggtccaagagcggcacctccgccaccctgggcatcaccgggctgcagacgggcgacgaggccgactactactgcgggacctgggacaccagcctctccgccggcggggtgttcggcaccggcacgaaggtcaccgtgctg

SEQ ID NO: 9173 - RNA, 333 nt, synthetic construct
  misc_feature 1..333: note = derived and/or modified sequence opt1 from anti-HIV-1_LightChain
  source 1..333: mol_type = other RNA
cagctggtgctcacccagcccccgagcgcctccggcacccccgggcagcgcgtcacgatcagctgctccggcagcacctccaacatcgggacctactacgtgtactggtaccagctgctgcccggcaccacgcccaaggtgctcatctacgccaacgaccagcggccgagcgggatccccgaccgcttctccggcagcaagtccggcaccagcgcgaccctggggatcaccggcctgcagacgggggacgaggccgactactactgcggcacctgggactccagcctctccaccgggggcgtcttcggcaccgggacgaaggtgaccgtgctg

SEQ ID NO: 9174 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggacgtccagcaacatcggcaacaacttcgtgtcctggtaccagcgcctccccgggaccgcgcccaagctgctgatcttcgagaacgacaagcggccgagcggcatccccgaccgcttctccgggagcaagtccggcaccagcgccaccctcggcatcacggggctgcagaccggcgacgaggccgactactactgcgggacctgggaccggtccctgagcgccggcggggtcttcggcaccggcacgaaggtgaccgtgctc

SEQ ID NO: 9175 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagtcccccagcgtctccgccaccccgggccagcgcgtgacgatcagctgctccgggaacaccagcaacatcggcaagaacttcgtgtcctggtaccagcagttccccgggaccgcccccaagctcctgatctacgacaacgacaagcggcccagcggcatcccggaccgcttctccgggagcaagtccggcaccagcgcgacgctgggcatcaccgggctccagaccggcgacgaggccgactactactgcgggacctgggactccagcctgtccgccggcggggtcttcggcacgggcaccaaggtgaccgtgctg

SEQ ID NO: 9176 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgcggcccccggccgcgaggtgatcatctcctgcagcgggtccagctccaacatcggcaacaaccacgtgagctggtaccagcagctccccgggaccgcgcccaaggtcctgatctacgagtccaacaagcggcacagcggcatcccggaccgcttctccgggagcaagtccggcacgagcgccaccctggccatcaccggcctccagaccggggacgaggccgactactactgcggcgcctgggactccagcctgtccgccgggggcgtgttcgggacgggcaccaaggtgaccgtcctg

SEQ ID NO: 9177 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgccagcggcacccccgggcagcgcgtcacgatctcctgcagcggctccagctccaacatcggggacagcaccgtgaactggtaccagcagctccccggcaccgcccccaagctgctgatctacgagaacaccaagcggccgtccgggatccccgaccgcttcagcggctccaagagcggcacgtccgcgaccctcgggatcaccggcctgcagaccggggacgaggccgactactactgcggcacgtgggaccggagcctgtccgccgggggcgtgttcggcaccgggaccaaggtcaccgtgctc

SEQ ID NO: 9178 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccacgagcaacatcggcaacaactacgtgtcctggtaccagcagctccccgggaccgcgcccaagctgctgatctacgagaacaaccgccagccgagcggcatccccgaccggttctccgggagcaagtccggcaccagcgccaccctcggcatcacggggctgcagaccggcgacgagggggactactactgcggcacctgggaccgctccctgagcgccgggggcgtcttcggcaccgggacgaaggtgaccgtgctc

SEQ ID NO: 9179 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccagctccaacatcggcagcaactacgtgtcctggtaccagcagctccccgggacggcgcccaagctgctgatctacgagaacaacaagcgcccgagcggcatccccgaccggttctccgggagcaagtccggcaccagcgccaccctcggcatcaccgggctgcagacgggcgacgaggccgtctactactgcgggacctgggactccagcctgaccgccggcggggtgttcggctccggcaccaaggtgacggtcctc

SEQ ID NO: 9180 - RNA, 336 nt, synthetic construct
  misc_feature 1..336: note = derived and/or modified sequence opt1 from anti-HIV-1_LightChain
  source 1..336: mol_type = other RNA
cagagcgtgctgacccagcccccgtccgtcagcggcgcccccgggcagcgcgtgaccatctcctgcatcggcagctccagcaacatcggggccgactaccgggtgcactggtaccagcagctccccggcacggcgcccaagctgctgatctacgagaacaacaagcgcccgtccgggatccccgaccggttcagcggctccaagagcggcacctccgccaccctcgggatcaccggcctgcagacgggggacgaggccgactactactgcggcacctgggacagctccctgagcaccgggggcgtcttcggcaccgggacgaaggtgaccgtgctc

SEQ ID NO: 9181 - RNA, 336 nt, synthetic construct
  misc_feature 1..336: note = derived and/or modified sequence opt1 from anti-HIV-1_LightChain
  source 1..336: mol_type = other RNA
cagagcgtgctgacccagcccccgtccgtcagcggcgcccccgggcagcgcatcaccgtgtcctgcacgggcaccagctccaacatcggggccccctacgacgtgaactggtaccagcagctccccggcaccgcgccgaagctgctgatctacgagaacaccaagcggcccagcgggatccccgaccgcttctccggcagcaagtccggcacgagcgccaccctcgggatcaccggcctgcagaccggggacgaggccgactactactgcggcacgtgggaccggtccctgagcgccgggggcgtcttcggcaccgggaccaaggtgaccgtgctc

SEQ ID NO: 9182 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccggccatgtccgccgcgcccggccagagcgtcaccatctcctgcagcgggtccgccttcaacatcgagcgccaccaggtgacgtggctccggcacctccccggcaccgcccccaccagcgtgatcatcatgaacaaccagcgcccgtccggggtccccgaccggttcagcggctcccgcagcgggacctccgccacgctgggcatcaccggcctgcagaccggggacgagggcgactactactgcgggacctgggaccggagcctgtccgccggcggggtgttcggcacgggcaccaaggtgaccgtcctg

SEQ ID NO: 9183 - RNA, 333 nt, synthetic construct
  misc_feature 1..333: note = derived and/or modified sequence opt1 from anti-HIV-1_LightChain
  source 1..333: mol_type = other RNA
cagagcgtgctggcccagcccccgtccgccagcggcacccccgggcagcgcgtcaccatctcctgcagcggctccgcgagcaacatcgggttcaactccgtgacgtggtaccagcagctccccggcaccgcccccaccgtgctgatctacgggaacgacctgcggccgagcggcatccccgaccgcttctccggcagcaagtccgggaccagcgccacgctcggcatcaccgggctgcagaccggcgacgagggggactactactgcggcacctgggaccggtccctgagcgccggcggggtcttcggcacggggaccaaggtgaccgtgctc

SEQ ID NO: 9184 - RNA, 336 nt, synthetic construct
  misc_feature 1..336: note = derived and/or modified sequence opt1 from anti-HIV-1_LightChain
  source 1..336: mol_type = other RNA
cagagcgccctgacccagcccgcctccgtgagcggctccccgggggagagcatcaccatctcctgcacgggcacccgcagcgacatcgggaactacgcgtacgtctcctggtaccagcagctccccggcaccgcccccaagctgctgatcagcgagaacaacaagcggccctccgggatcccggaccgcttcagcggctccaagagcggcacctccgccacgctcgggatcaccggcctgcagaccggggacgaggccgactactactgcggcacctgggacagctccctgagcgccgggggcgtgttcggcacggggaccaaggtgaccgtcctc

SEQ ID NO: 9185 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccccgcccggccagaaggtgaccatctcctgcagcgggacgacctccaacatcggcagcaactacgtggcctggtaccagcagctccccgggaccgcgcccaagctgctgatctacgacaacgacaagcgcccctccggcatccccgaccggttcagcgggtccaagagcggcacctccgccacgctcggcatcaccgggctgcagaccggcgacgaggccgactactactgcgggacctgggaccgcagcctgtccgccggcggggtcttcggcacgggcaccaaggtgaccgtgctc

SEQ ID NO: 9186 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagtcccccagcgtctccggcaccccggggcagcgcgtgacgatcttctgcagcggctccgacagcgacatcgggatcaactccgtgagctggtaccagcagctccccggcaccgcccccaagctgctgatctacgacaacaacaagcggccctccgggatcccggaccgcttcagcggctccaagagcggcacctccgccaccctcgggatcacgggcctgcagaccggggacgaggcggactactactgcggcacctgggaccggagcctgtccgccgggggcgtcttcggcaccgggacgaaggtgaccgtgctc

SEQ ID NO: 9187 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggaactccagcaacatcggcaacaactacgtgtcctggtaccagcacctccccgggacggcgcccaagctgctgatctacgagaacaccaagcgcccgagcggcatccccgaccggttctccgggagcaagtccggcaccagcgccaccctcggcatcacggggctgcagaccggcgacgaggccgactactactgcgggacctgggaccgctccctgagcgccggcggggtcttcggcaccggcacgaaggtgaccgtgctc

SEQ ID NO: 9188 - RNA, 333 nt, synthetic construct
  misc_feature 1..333: note = derived and/or modified sequence opt1 from anti-HIV-1_LightChain
  source 1..333: mol_type = other RNA
cagagcctgctcacccagcccccgtccgtgagcgccgcccccggccagaaggtcaccatctcctgcagcgggggcaactccgacatcgggaagaacttcgtgagctggtaccagcagctgcccggcacggcgcccaagctgctcatctacgagaacaacaagcgcccgtccgggatccccgaccggttcagcggctccaagagcggcacctccgccaccctggggatcaccggcctgcagacgggggacgaggccgactactactgcggcacctgggacaacagcctctccaccgggggcgtgttcggcaccgggacgaaggtcaccgtgctg

SEQ ID NO: 9189 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgatcatctcctgcagcgggtccagctccaacatcggcaagaactacgtggcgtggtaccagcagctccccgggaccgcccccaagctgctggtctacgagaacacgaaccgcccgagcggcatccccgaccggttctccgggagcaagtccggcaccagcgccaccctcggcatcaccgggctgcagacgggcgacgaggccgactactactgcgggacctgggactccagcctgtccgccggcggggtgttcggcaccggcaccaaggtgacggtcctc

SEQ ID NO: 9190 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccatgagcgacatcggcctcaaccccgtgtcctggtaccgccagctgcccgaggcgccgccccacctcctgatcttcgacaacgacgagcggcccagcgggacggccggccgcttctccgccagcaagtccgggaccagcgccaccctggacatcaccggcctgcagacgggcgacgaggccgactactactgcgggacctgggactccagcctctccgcgggcggggtcttcggcaccgggaccaaggtgacggtgctg

SEQ ID NO: 9191 - RNA, 336 nt, synthetic construct
  misc_feature 1..336: note = derived and/or modified sequence opt1 from anti-HIV-1_LightChain
  source 1..336: mol_type = other RNA
cagagcgccctgacccagcccgcctccgtgagcggctccccggggcagagcatcaccatctcctgcacgggcaccagctccgacgtcgggagctacaacctcgtgtcctggtaccagcagtaccccggccgcgcgcccaagctgctgatctacgagaacaacaagcggcccagcgggatcccggaccgcttctccggcagcaagtccggcaccagcgccaccctcgggatcacgggcctgcagaccggggacgaggccgactactactgcggcacctgggacaactccctgagcaccgggggcgtgttcggcacggggaccaaggtcaccgtgctc

SEQ ID NO: 9192 - RNA, 333 nt, synthetic construct
  misc_feature 1..333: note = derived and/or modified sequence opt1 from anti-HIV-1_LightChain
  source 1..333: mol_type = other RNA
cagagcctgctcacccagcccccgtccgtgagcgcctcccccggccagaaggtcaccatcagctgctccgggacgagctccaacatcggcaacaactacgtgagctggtaccagcagttccccgggaccgcccccaagctgctgatctacgagaacaacaagcgctccagcggcatcccggaccggttctccgggagcaagtccgacaccagcgcgaccctcggcatcacgggcctgcagaccggggacgaggccgactactactgcggcacctgggaccgctccctgagcgccgggggcgtgttcgggaccggcacgaaggtcaccgtgctc

SEQ ID NO: 9193 - RNA, 336 nt, synthetic construct
  misc_feature 1..336: note = derived and/or modified sequence opt1 from anti-HIV-1_LightChain
  source 1..336: mol_type = other RNA
cagagcgtgctgacccagcccccgtccgtcagcggcgcccccgggcagcgcgtgaccatctcctgcacgggccggcgcagcaacatcggggccggctacgacgtgcactggtaccagcagctccccgggaccgcgcccaagctgctgatctacgagaacaacaagcggccgtccggcatccccgaccgcttcagcggctccaagagcgggacctccgccaccctcggcatcacggggctgcagaccggcgacgaggccgactactactgcgggacctgggacaccagcctgtccgccggcggcgtcttcgggacgggcaccaaggtgaccgtgctc

SEQ ID NO: 9194 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagcgcgtgaccatctcctgcagcgggtccagctccaacatcggcaacaacttcgtgagctggtaccagttcttccccgggacggcgcccaagctcgtcatctacgagaacgacaagcggccgtccggcacccccgaccgcttcagcgggtccaagagcggcacctccgccaccctggccatcatcggcctgcagacgggggacgagggcgactactactgcgggacctgggacaacagcctctccaccggcggggtgttcggcaccggcacgaaggtgaccgtcctg

SEQ ID NO: 9195 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagcgcgtgaccatctcctgcagcgggggctccagcaacatcgggaacaaccacgtgtcctggtaccagcagctccccggcacggcgcccaagctgctgatcagcgagaacaacaagcggccgtccgggatccccgaccgcttcagcggctccaagagcggcacctccgccaccctcgggatcaccggcctgcagacgggggacgaggccgactactactgcggcacctgggacagctccctgagcgccgggggcgtcttcggcaccgggaccaaggtgacggtgctc

SEQ ID NO: 9196 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccagctccaacatcggccgcgacttcgtgagctggtaccagcaggtccccgggacggcgcccaagctcctgatctacgacaacgacaagcggccgtccggcatccccgaccgcttcagcgggtccaagagcggcacctccgccaccctgggcatcaccgggctccagacgggcgacgaggccgactactactgcgggacctgggacagctccctgagcgccggcggggtgttcggcaccggcaccaaggtgacggtcctg

SEQ ID NO: 9197 - RNA, 336 nt, synthetic construct
  misc_feature 1..336: note = derived and/or modified sequence opt1 from anti-HIV-1_LightChain
  source 1..336: mol_type = other RNA
cagaccgtggtcacccagcccccgagcgtgtccggcgcccccgggcagacggccaccatcagctgcaccggctccagctccaacatcggggcggactacgacgtgcactggtaccagcagctgcccggcaccgcccccaagctcctgatctacgacaacaacaagcgcccgagcgggatccccgaccggttctccggcagcaagtccggcacgagcgccaccctggggatcaccggcctccagaccggggacgaggccgactactactgcggcacgtgggaccgctccctgagcgccgggggcgtcttcggcaccgggaccaaggtgaccgtgctg

SEQ ID NO: 9198 - RNA, 333 nt, synthetic construct
  misc_feature 1..333: note = derived and/or modified sequence opt1 from anti-HIV-1_LightChain
  source 1..333: mol_type = other RNA
aacttcatgctgacccagcccccgagcgcctccggcacccccgggcagcgcgtgacgatcagctgctccggcagctccagcaacatcgggtccaactacgtctactggtaccagcagctccccggcaccacccccaagctgctgatctaccggaacaaccagcgcccgagcgggatccccgaccggttctccggcagcaagtccggcaccagcgccacgctcgggatcaccggcctgcagaccggggacgaggcggactactactgcggcacctgggactccagcctgtccgccgggggcgtgttcggcacggggaccaaggtgaccgtcctc

SEQ ID NO: 9199 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccagccccaacatcggcaacaacttcctctcctggtaccagcagctgcccgggacggcgccgaagctgctcatctacgagaacaccaagcgccccagcggcatccccgaccggttctccgggagcaagtccggcaccagcgccaccctgggcatcacggggctgcagaccggcgacgaggccgactactactgcgggacctgggaccgctccctcagcgccggcggggtgttcggcaccggcacgaaggtcaccgtgctg

SEQ ID NO: 9200 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagtcccccagcgtctccgccgccccgggccagaaggtgaccatcagctgctccgggagctccagcgacatcggcaacaacttcgtgtcctggtaccagcagctccccgggacggcgcccaagctgctgatctacgagaacaacaagcgccccagcggcatcccggaccggttctccgggagcaagtccggcaccagcgccaccctcggcatcaccgggctgcagacgggcgacgaggccgactactactgcgggacctgggactccagcctgtccgccggcggggtcttcggcaccggcaccaaggtgacggtgctc

SEQ ID NO: 9201 - RNA, 333 nt, synthetic construct
  misc_feature 1..333: note = derived and/or modified sequence opt1 from anti-HIV-1_LightChain
  source 1..333: mol_type = other RNA
cagttcttcctgacccagcccccgagcctctccgccacccccggccagcgcgtgagcatctcctgcagcgggggcgggtccaacatcgccaacaacgacgtcttctggttccagcagttccccggcgcggggccccggctgctgatctacgacaacctcaagcgccactacggcacgccggaccggttcagcggctccaagagcgggacctccgccaccctgggcatcaccgggctgcagacgggcgacgaggccgactactactgcgggacctgggacaacagcctctccaccggcggcgtgttcgggaccggcacgaaggtgaccgtcctg

SEQ ID NO: 9202 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccggccccaacatcgggagcaactccgtgagctggtaccagcacttccccggcacggcgccgaagctcctgatctacgacaacaacaagcgcccctccgggatccccgaccggttcagcggctccaagagcggcacctccgccaccctggggatcaccggcctccagacgggggacgaggccgactactactgcggcacctgggaccgcagcctgtccgccgggggcgtcttcggcaccgggaccaaggtgacggtgctg

SEQ ID NO: 9203 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagtcccccagcgcctccggcaccccggggcagcgcgtcacgatcagctgctccggcagctccagcaacatcgggtccaacaccgtgagctggttccagcacctccccggcaccgcccccaagctgctgatctacgagaacaacaagcggccctccgggatcccggaccgcttcagcggctccaagagcggcacctccgcgacgctcgggatcaccggcctgcagaccggggacgaggccgactactactgcggcacctggcacagctccctgagcgccgggggcgtgttcggcacggggaccaaggtcaccgtgctc

SEQ ID NO: 9204 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcggcgcgcccgggcagaacgtgatcatctcctgcagcggctccagctccaacatcgggaagaactacgtggcctggtaccagcagctccccggcaccgcgcccaagatcgtcatctacgagacgaccaaccgcccgagcgggatccccgcccggttctccggcagcaagtccggcaccagcgccaccctggggatcacgggcctgcaggccggggacgaggccgactactactgcggcacctgggactccagcctcaacgccgggggcgtgttcggcaccgggaccaaggtgacggtcctg

SEQ ID NO: 9205 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccagctccaacatcggcaacaacttcctcagctggtaccagcacctccccgggacggcgccccgcctgctgatctacgacaacgaccagcggccgtccggcatccccgaccgcttcagcgggtccaagagcggcacctccgccaccctgggcatcaccgggctgcagacgggcgacgaggccgactactactgcgggacctggcacagctccctcagcgccggcggggtgttcggcaccggcaccaaggtcacggtgctg

SEQ ID NO: 9206 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgccagcggcacccccgggcagaaggtcacgatctcctgcagcggctccagctccaacatcgggaacaactacgtgagctggtaccagcagctccccggcaccgcccccaagctgctgatctacgagaacaacaagcgcccgtccgggatccccgaccggttcagcggctccaagagcggcacctccgcgaccctcgggatcacgggcctgcagaccggggacgaggccgactactactgcggcacctgggacagctccctgagcaccgggggcgtgttcggcacggggaccaaggtcaccgtgctc

SEQ ID NO: 9207 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggacgacctccaacatcggcaaccactacgtgagctggtaccagcagttccccgggaccgcgcccaagctcatcatctacgagaccgaccgccggccgtccggcatccccgcccgcttcagcgggtccaagagcggcacgtccgccaccctggccatcgccggcctgcagaccggggacgaggcggactactactgcggcacctgggacagctccctcagcaccgggggcgtcttcgggacgggcaccaaggtgaccgtgctg

SEQ ID NO: 9208 - RNA, 333 nt, synthetic construct
  misc_feature 1..333: note = derived and/or modified sequence opt1 from anti-HIV-1_LightChain
  source 1..333: mol_type = other RNA
cagctggtgctcacccagcccccgagcgtctccgccgcccccggccagaaggtgaccatcagctgctccgggagctccagcaacatcggcaacaactacgtgtcctggtaccagcagctgcccgggacggcgcccaagctgctcatctacgagaacaacaagcgcccgagcggcatccccgaccggttctccgggagcaagtccggcaccagcgccaccctgggcatcaccgggctgcagacgggcgacgaggccgactactactgcgggacctgggactccagcctctccaccggcggggtcttcggcaccggcacgaaggtgaccgtgctg

SEQ ID NO: 9209 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagcgcgtgaccatctcctgcagcgggggctccagcaacatcgggaacaaccacgtgtcctggtaccagcacctccccggccgggcgccccagctgctgatctacgacacgacccagcgcccgagccggatccccgaccgcttctccgggagcaagtccggcaccagcgccaccctcggcatcacggggctgcagaccggcgacgaggccgactactactgcgggacctgggacaactccctgagcaccggcggggtcttcggcacgggcaccaaggtgaccgtgctc

SEQ ID NO: 9210 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaagatcaccatctcctgcagcgggtcccgcagcaacatcggcaacaactacgtgtcctggtaccagcagttccccgggacggcgcccaagctcctgatctacgacaacaaccagcggccgagccgcatccccgaccggttctccggcagcaagtccgggaccagcgccaccctgggcatcaccggcctccagacgggggacgaggccgactactactgcggcacctgggactccagcctgtccgccgggggcgtgttcgggaccggcaccaaggtcacggtgctg

SEQ ID NO: 9211 - RNA, 321 nt, synthetic construct
  misc_feature 1..321: note = derived and/or modified sequence opt1 from anti-HIV-1_LightChain
  source 1..321: mol_type = other RNA
cagagcgtgctgacccagcccccgtccgtcagcgccgcccccggccagcgcgtgaccatctcctgcttcgggagccggttctccagcgtgtcctggtaccagcagctccccggcacggcgcccaagctgctgatctacccgaacggggagcgccccagcggcatccccgaccggttcttcgggtccgagagcggcacctccgccaccctcggcatcaccgggctgcagacgggcgacgaggccgactactactgcgccacctgggacagctccctgagcgccgggggcgtcttcgggaccggcaccaagctcacggtgctg

SEQ ID NO: 9212 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccctcagcgccgcccccggccagaaggtcaccatctcctgcagcgggtccagcctgaacatcggcaaccactacgtgtcctggtaccagcaggtccccgggacggcgcccaagctgctcatctacgaggacaacaagcgcccgagcggcatccccgaccggttctccgggagcaagtccggcaccagcgccaccctgggcatcaccgggctgcagacgggcgacgaggccgactactactgcgggacctggcactccagcctctccgccggcggggtgttcggcaccggcaccaaggtgacggtgctg

SEQ ID NO: 9213 - RNA, 333 nt, synthetic construct
  misc_feature 1..333: note = derived and/or modified sequence opt1 from anti-HIV-1_LightChain
  source 1..333: mol_type = other RNA
cagttcgtgctgacccagcccccgagcgtctccgccgcccccggccagaaggtgaccgtgagctgctccgggacgaccagcgacatcggcgagaactacgtctcctggtaccagaagttccccgaggcggcccccaagctcctgatctacgacaacgacaagcgcccgagcgggatccccgaccggttctccggcagcaagtccgggaccagcgccaccctgggcatcacgggcctccagaccggggacgaggccgactactactgcggcacctgggaccgctccctgagcgccgggggcgtgttcgggaccggcacgaaggtgaccgtcctg

SEQ ID NO: 9214 - RNA, 333 nt, synthetic construct
  misc_feature 1..333: note = derived and/or modified sequence opt1 from anti-HIV-1_LightChain
  source 1..333: mol_type = other RNA
ctgagcgtgctcacccagcccccgtccgtcagcgccgcccccggccagcaggtcaccatctcctgcagcgggacgacctccaacatcggcaccaactacgtgagctggtaccagcagatgccgcccaccgcgcccaagctgctgatctacgagaacaacaagcgcccctccgggatccccgaccggttcagcggctccaagagcgggacgtccgccaccctcggcatcaccggcctgcagaccggggacgaggccgactactactgcggcacgtgggacagctccctgagcgccgggggcgtgttcgggaccggcaccaaggtgaccgtgctc

SEQ ID NO: 9215 - RNA, 336 nt, synthetic construct
  misc_feature 1..336: note = derived and/or modified sequence opt1 from anti-HIV-1_LightChain
  source 1..336: mol_type = other RNA
cagagcatgctgacccagcccccgtccgtgagcggcgcccccgggcagcgcgtcaccatctcctgcacgggcagccggtccaacatcggggccggctacgacgtgcactggtacctccagctgcccgggaccgcgcccaagctgctcatctacgagaacaacaagcgcccgagcggcatccccgaccggttctccggcagcaagtccgggaccagcgccaccctgggcatcacggggctgcagaccggcgacgaggccgactactactgcgggacctgggacaactccctcagcaccggcggcgtgttcgggacgggcaccaaggtcaccgtgctg

SEQ ID NO: 9216 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccacccccggccagaaggtgacgatctcctgcagcgggtcccgcagcaacatcggctcccactacgtgagctggtaccagcagttccccgagtccgcccccaccctcctgatctacgagaacgtcgagcggccgagcgggatccccgaccgcttctccggcagcaagtccgggaccagcgcgaccctgggcatcacgggcctccagaccggggacgaggccgactactactgcggcacctgggactccagcctgtccgccgggggcgtgttcgggaccggcacgaaggtgaccgtcctg

SEQ ID NO: 9217 - RNA, 333 nt, synthetic construct
  misc_feature 1..333: note = derived and/or modified sequence opt1 from anti-HIV-1_LightChain
  source 1..333: mol_type = other RNA
cagttcttcctgacccagcccccgagcctctccgccacccccggccagcgcgtgagcatctcctgcagcgggggcgggtccaacatcgccaacaacgacgtcttctggttccagcagttccccggcgcggggccccggctgctgatctacgacaacctcaagcgccactacggcacgccggaccggttcagcggctccaagagcggggccaccggcaccctggagatcaccgaggtgcagacggccgacgaggccgactactactgcgggacctgggactccagcctgtccgccggcggggtgttcggcaccggcaccaaggtcacggtgctc

SEQ ID NO: 9218 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggggctccagcaacatcggggacaactccgtgagctggtaccagcagctccccggcacggcgcccaagctgctgatctacgagaacaacaagcgcccgtccgggatccccgaccggttcagcggctccaagagcggcacctccgccaccctcgggatcaccggcctgcagacgggggacgaggccgactactactgcggcacctgggacagctccctgagcaccgggggcgtcttcggcaccgggacgaaggtgaccgtgctc

SEQ ID NO: 9219 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaccgtgacgatctcctgcagcgggtccgcgagcaacatcggccgcaactccgtgagctggtaccagtacgtccccggggccgcccccaagcggctcatctacgagaacaacaagcgcccgtccggcatccccgaccggttcagcgggtccaagagcggcacctccgccaccctgggcatcaccgggctgcagacgggcgacgaggccgactactactgcgggacctgggacaccagcctctccgcgggcggggtgttcggcaccggcacgaaggtgaccgtcctg

SEQ ID NO: 9220 - RNA, 333 nt, synthetic construct
  misc_feature 1..333: note = derived and/or modified sequence opt1 from anti-HIV-1_LightChain
  source 1..333: mol_type = other RNA
cagagcgtgctggcccagcccccgtccgtcagcgccgcccccggccagaaggtgaccatctcctgcagcgggcgcacctccaacatcggcaactacttcgtgagctggtaccagcagttccccgggacggcgccccggctcctgatctacgacaacgaccagcgcccgtccggcatccccgaccggttcagcgggtccaagagcggcacctccgccaccctgggcatcaccgggctccagacgggcgacgaggccgactactactgcgggacctgggacagctccctgagcgccggcggggtcttcggcaccggcaccaaggtgacggtgctg

SEQ ID NO: 9221 - RNA, 333 nt, synthetic construct
  misc_feature 1..333: note = derived and/or modified sequence opt1 from anti-HIV-1_LightChain
  source 1..333: mol_type = other RNA
cagagcgccctgacccagcccgcctccgtgagcgcggccccgggccagaaggtcaccatctcctgcagcgggtccagctccaacatcggcaacatctacgtgagctggtaccagcagctccccgggacggcccccaagctgctgatctacgagaacaacaagcgcccctccggcatcccggaccggttcagcgggtccaagagcggcacctccgccaccctcggcatcaccgggctgcagacgggcgacgaggccgactactactgcgggacctggcacagctccctgagcgcgggcggggtgttcggcaccggcaccaaggtcacggtgctc

SEQ ID NO: 9222 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccacccccggccagcgcgtgacggtgtcctgcagcgggtccagctccaacatcggcaaccactacgtcagctggtaccagcaggtccccgggaccgcccccaagctcctgatctacgacaactccaaccggccgagcggcatccccgaccgcttctccgggagcaagtccggcaccagcgcgaccctgggcatcacggggctccagaccggcgacgaggccgactactactgcgggacctgggactccagcctgtccgccggcggggtgttcggcaccggcacgaaggtgaccgtgctg

SEQ ID NO: 9223 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccctcagcgccgcccccggccagcgcgtcaccgtgtcctgcagcgggtccagctccaacatcggcgacaactacgtgagctggtaccagcagctgcccggggcggcgccccggctgctcatctacgacaactccatccgcccgagcgccatccccgcccggttctccggcagcaagtccgggacgagcgccaccctggccatcaccggcctgcagaccggcgacgaggccgactactactgcgggacgtgggactccagcctctccgccggcggggtcttcggcaccgggaccaaggtgaccgtgctg

SEQ ID NO: 9224 - RNA, 336 nt, synthetic construct
  misc_feature 1..336: note = derived and/or modified sequence opt1 from anti-HIV-1_LightChain
  source 1..336: mol_type = other RNA
cagagcgccctgacccagcccgcctccgtgagcggctccccggggcagagcatcaccatctcctgcacgggcaccagctccgacgtcgggggctacgactacgtgagctggtacctccagctgcccgggaccgcgcccaagctgctcatctacgagaacaacaagcgcccctccggcatcccggaccggttcagcggctccaagagcgggacctccgccacgctgggcatcaccgggctgcagaccggcgacgaggccgactactactgcgggacctgggacagctccctcagcgccggcggcgtgttcgggacgggcaccaaggtcaccgtgctg

SEQ ID NO: 9225 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagcgcgtgaccgtgtcctgcagcgggtccagctccaacatcggcaacaactacgtcagctggtaccagcagttccccgggacggcgcccaagctcgtgatctacgacaccgacaagcggccgtccggcatccccgaccgcttcagcgggtccaagagcggcacctccgccaccctgggcatcacggggctgcagaccggcgacgaggccgactactactgcgccacctgggacagctccctcagcgccgggggcgtgttcgggaccggcacgaaggtcaccgtgctg

SEQ ID NO: 9226 - RNA, 336 nt, synthetic construct
  misc_feature 1..336: note = derived and/or modified sequence opt1 from anti-HIV-1_LightChain
  source 1..336: mol_type = other RNA
cagagcgtgctgacccagcccccgtccgtcagcggcgcccccgggcagcgcgtgaccatctcctgcacgggcaacagctccaacatcggggccggctacgacgtgcactggtaccagcagctccccgggaccgcgcccaagctgctgatcagcgagaacaacaagcggccgtccggcatccccgaccgcttcagcggctccaagagcgggacctccgccaccctcggcatcacggggctgcagaccggcgacgaggccgactactactgcgggacctgggacagctccctgagcgccggcggcgtcttcgggaccggcacgaaggtgaccgtgctc

SEQ ID NO: 9227 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgccagcggcacccccgggcagcgcgtcacgatctcctgcagcggctccagctccaacatcgggagcaactacgtggactggtaccagcagctccccggcaccgcccccaagctgctgatctacgagaacaacaagcggccgtccgggatccccgaccgcttcagcggctccaagagcggcacctccgcgaccctcgggatcacgggcctgcagaccggggacgaggccgactactactgcggcacctggcacagctccctgagcgccgggggcgtgttcggcaccgggacgaaggtcaccgtgctc

SEQ ID NO: 9228 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccacccccggccagacggtgaccatctcctgcagcgggtccagctccaacatcggcaacaactacctcagctggtaccgccagctgccccggaccgcccccaagctgctcatctacgagaacaaccgccggccgtccggggtgcccgcgcgcttcagcggctccaagagcgggacctccgccacgctggccatcaccggcctgcagaccggcgacgaggccgactactactgcgggacctgggacagctccctcagcgccggcggggtcttcggcacggggaccaaggtgaccgtgctg

SEQ ID NO: 9229 - RNA, 321 nt, synthetic construct
  misc_feature 1..321: note = derived and/or modified sequence opt1 from anti-HIV-1_LightChain
  source 1..321: mol_type = other RNA
cagagcgtgctgacccagcccccgtccgtcagcgccgcccccggccagcgcgtgaccatctcctgcttcgggagccggttctccagcgtgtcctggtaccagcagctccccggcacggcgcccaagctgctgatctacccgaacggggagcgccccagcggcatccccgaccggttcttcgggtccgagagcggcacctccgccaccctcggcatcaccgccgtccagacgggggacgaggccgactactactgcggcacctgggacgacagcctgtccaccgggggcgtgttcgggaccggcacgaaggtgaccgtcctg

SEQ ID NO: 9230 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccctctcctgcagcgggacgtccagcaacatcggcaacaactacgtgtcctggtaccagcaggtccccggggcggcccccaaggtgctgatctacgagaacgacaagcgcccgagcggcatccccgaccggttctccgggagcaagtccggcaccagcgccaccctgggcatcaccgggctccagacgggcgacgaggccgactactactgcgggacctgggaccgctccctgagcgccggcggggtgttcggcaccggcaccaaggtcacggtgctg

SEQ ID NO: 9231 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccaacagcaacatcggcaacaactacgtgtcctggtaccagcagctccccgggacggcgaccaagctgctgatctacgagaacgacaagcgccccagcggcatcccggaccggttctccgggagcaagtccggcaccagcgccaccctcggcatcacggggctgcagaccggcgacgaggccgactactactgcgggacctggcactccagcctgtccgccggcggggtcttcggcaccggcacgaaggtgaccgtgctc

SEQ ID NO: 9232 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccctcagcgccgcccccggccagcaggtctccatcagctgcctggggcgctccagcaacatcggcaccaactacgtgtcctggtaccagcagttccccgggacggcgcccaagctgctcatctacgagaacaagaagcggccgagcgagatccccgaccgcttctccggcagcaagtccgggaccagcgccaccctgggcatcaccggcctgcagcccggggacgaggccgactactactgcggcacgtgggactccagcctctccgccgggggcgtgttcgggaccggcaccaaggtcaccgtgctg

SEQ ID NO: 9233 - RNA, 336 nt, synthetic construct
  misc_feature 1..336: note = derived and/or modified sequence opt1 from anti-HIV-1_LightChain
  source 1..336: mol_type = other RNA
cagagcgccctgacccagcccccgtccgccagcggctcccccgggcagagcgtgaccatctcctgcacgggcaccagctccgacgtcggggcgtacaacagcgtgtcctggtaccagcagctccccggcaccgcccccaagctgctgatcagcgagaacaacaagcgcccgtccgggatccccgaccggttcagcggctccaagagcggcacctccgccacgctcgggatcaccggcctgcagaccggggacgaggccgactactactgcggcacctgggacagctccctgagcgccgggggcgtgttcggcacggggaccaaggtcaccgtgctc

SEQ ID NO: 9234 - RNA, 333 nt, synthetic construct
  misc_feature 1..333: note = derived and/or modified sequence opt1 from anti-HIV-1_LightChain
  source 1..333: mol_type = other RNA
cagagcgccctgacccagcccccgtccgccagcggctcccccgggcagagcgtgaccatctcctgcagcggcgggtccagcaacatcggcaacaaccacgtctcctggtaccagcacctccccgggcgcgcgccccagctgctgatctacgacacgacccagcggccgagccgcatccccgaccggttctccggcagccgctccggcaccagcgccaccctcgccatcacggggctgcagaccggcgacgaggccgtgtactactgcgggacctgggacaactccctgagcaccggcggggtgttcggcacgggcaccaaggtcaccgtgctc

SEQ ID NO: 9235 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagcgcgtgaccatctcctgcagcgggggcacgtccaacatcgggaacgagtacgtgagctggtaccagcagctccccggcaccgcgcccaagctgctgatctacgagaacaacaagcggccgtccgggatccccgaccgcttcagcggctccaagagcggcacctccgccaccctcgggatcacgggcctgcagaccggggacgaggccgactactactgcggcacctgggacagctccctgagcgccgggggcgtcttcggcaccgggacgaaggtgaccgtgctc

SEQ ID NO: 9236 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagcgcgtgaccgtgtcctgcagcgggtccagctccaacatcggcaacaactacgtcagctggtaccagcagctccccggggcggcccccaagctgctgatctacgacacggacaagcggccgtccggcatccccgaccgcttcagcgggtccaagagcggcacctccgccaccctcggcatcaccgggctgcagacgggcgacgaggccgactactactgcgggacctgggaccggagcctgtccgccggcggggtgttcggcaccggcaccaaggtgacggtcctc

SEQ ID NO: 9237 - RNA, 333 nt, synthetic construct
  misc_feature 1..333: note = derived and/or modified sequence opt1 from anti-HIV-1_LightChain
  source 1..333: mol_type = other RNA
cagagcctgctcacccagcccccgtccgtgagcgccgcccccggccagaaggtcaccatctcctgcagcgggggcaactccgacatcgggaagaacttcgtgagctggtaccagcagtcccccggcgccgcgccccgcctgctgatctacgagaacgaccggcgcccgagcgggatccccgaccggttctccggcagcaagtccggcacgagcgccaccctcgggatcaccggcctgcagaccggggacgaggccgactactactgcggcacgtgggaccgctccctgagcgccgggggcgtgttcggcaccgggaccaaggtcaccgtgctc

SEQ ID NO: 9238 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgcggcccccggccagaaggtgaacatctcctgcagcgggtccagctccaacatcggcaagaactacgtgagctggtaccagcagatccccgggaccgcgcccaaggtcctcatctacgagaacaacaagcgcccgtccggcatccccgaccggttcagcgggtccaagagcggcacgtccgccaccctgggcatcgccgggctgcagaccggcgacgaggccgactactactgcgccacctgggacagctccctcagcgccgggggcgtgttcgggacgggcaccaaggtgaccgtcctg

SEQ ID NO: 9239 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccagctccaacatcggcaaccgccacgtgagctggtaccagcagctccccgggacggtccccaagctgctgatctacgagaccaacaagcggccgtccggcatccccgaccgcttcagcgggtccaagagcggcacctccgcgaccctcggcatcacggggctgcagaccggcgacgaggccgactactactgcgggacctgggacaacagcctgtccaccggcggggtgttcggcacgggcaccaaggtgaccgtcctc

SEQ ID NO: 9240 - RNA, 336 nt, synthetic construct
  misc_feature 1..336: note = derived and/or modified sequence opt1 from anti-HIV-1_LightChain
  source 1..336: mol_type = other RNA
cagagcgtgctgacccagcccccgtccgtcagcggcgcccccgggcagcgcgtgaccatctcctgcacgggcagctccagcaacatcggggccggctacgacgtgcactggtaccagcagctccccgggaccgcgcccaagctgctgatcttcggccacgacaagcggccgtccggcatccccgaccgcttcagcgggtccaagagcggcacctccgccaccctcgggatcacgggcctgcagaccggggacgaggccgactactactgcggcacctgggacagctccctgagcgccggcggggtcttcggcaccgggacgaaggtgaccgtgctc

SEQ ID NO: 9241 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagctcccctccgccagcggcctgccggggcagaccgtcacgatctcctgcagcggctccaccagctccatcgggagcaaccacgtgtactggtaccagcaggtcgccggcaccgcgcccaagctgctcatctacgagaacaacaagcgcccctccgggatccccgaccggttcagcggctccaagagcggcacctccgccacgctggggatcaccggcctgcagaccggggacgaggccgactactactgcgccacctgggacagctccctcagcgccggcggggtgttcggcacgggcaccaaggtgaccgtgctg

SEQ ID NO: 9242 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagaccccctccgccagcggcgccccggggcagggcgtcacgatctcctgcagcgggtccagctccaacgtgggccgcaactacgtgagctggtaccagcagctccccgggaccgcgcccaagctgctgatctacgagaacaccaagcggccctccggcatcccggaccgcttcagcggctccaagagcgggacctccgccacgctcggcatcaccgggctgcagaccggcgacgaggccgactactactgcgggacctgggaccggagcctgtccgccggcggcgtcttcgggacgggcaccaaggtgaccgtgctc

SEQ ID NO: 9243 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagttccccgggacggcgcccaagctcctgatctccgacaacaacaagcgcccgagcggcatccccgaccggttctccgtcagcaagtccgggaccagcgccaccctgggcatcaccggcctccaggccggggacgaggccgactactactgcggcacgtgggactccagcctgtccgccgggggcgtgttcgggaccggcaccaaggtgaccgtcctg

SEQ ID NO: 9244 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccaacagcaacatcggcaacaactacgtgacgtggtaccagcagttccccgggaccgcgcccaaggtcctcatctacgacaactcccgccggccgagcggcatccccgaccgcttctccgggagcaagtccggcaccagcgccaccctgggcatcacggggctgcagaccggcgacgaggccgactactactgcgggacctgggactccagcctctccgccggcggggtgttcggcaccggcacgaaggtgaccgtcctg

SEQ ID NO: 9245 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcggcgcccccgggcagcgcgtgaccatctcctgcagcggctccagctccaacatcgggaacaactacgtgagctggtaccagcagctccccggcacggcccccaagctgctgatctacgagaacaccaagcggccgtccgggatccccgaccgcttcagcggctccaagagcggcacctccgcgaccctcgggatcacgggcctgcagaccggggacgaggccgactactactgcggcacctgggaccggagcctgtccgccgggggcgtcttcggcaccgggacgaaggtgaccgtgctc

SEQ ID NO: 9246 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaccgtgacgatctcctgcagcgggtccaccagcaacatcggccagaacttcctctcctggttccagcacgtgcccgggaccgcgcccaagctgctgatctacgagaacaacaagcgcccgagcggcatccccgaccggttctccgggagcaagtccggcaccagcgccacgctcggcatcaccgggctgcagaccggcgacgaggccgactactactgcgggacctggcactccagcctgtccgccggcggggtcttcggcacgggcaccaaggtgaccgtgctc

SEQ ID NO: 9247 - RNA, 333 nt, synthetic construct
  misc_feature 1..333: note = derived and/or modified sequence opt1 from anti-HIV-1_LightChain
  source 1..333: mol_type = other RNA
aacttcatgctgacccagcccccgagcgcctccggcacccccgggcagcgcgtgacgatcagctgctccggcagctccagcaacatcgggtccaagtacgtcagctggtaccagcagctccccggcaccgcccccaagctgctgatctacgagaacaccaagcggccgtccgggatccccgaccgcttcagcggctccaagagcggcacctccgcgacgctcgggatcaccggcctgcagaccggggacgaggccgactactactgcggcacctgggaccggagcctgtccgccgggggcgtgttcggcacggggaccaaggtgaccgtcctc

SEQ ID NO: 9248 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagctcctgcccgggacggcgcccaagctgctcatctacgagaacaacaagcgcccgtccggcatccccgaccggttcagcgggtccaagagcggcacctccgccaccctgggcatcaccgggctgcagacgggcgacgaggccgactactactgcgggacctgggacaacagcctctccaccggcggggtcttcggcaccggcacgaaggtgaccgtgctg

SEQ ID NO: 9249 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagatcatcatctacgacaacaacaagcgcccgtccggcatccccgaccggttcagcgggtccaagagcggcacctccgccaccctgggcatcaccgggctgcagacgggcgacgaggccgactactactgcgggacctggcacagctccctcagcgccggcggggtcttcggcaccggcaccaaggtgacggtgctg

SEQ ID NO: 9250 - RNA, 333 nt, synthetic construct
  misc_feature 1..333: note = derived and/or modified sequence opt1 from anti-HIV-1_LightChain
  source 1..333: mol_type = other RNA
cagagcgtgctgacccagcccccgtccgccagcgccacccccggccagcgcgtcacgatctcctgcagcgggtccagctccaacatcggcagcaagcacgtgtactggtaccagaagctccccgggaccgcgcccaagctgctgatctacgagaacaccaagcggccgtccggcatccccgaccgcttcagcgggtccaagagcggcacctccgccacgctcggcatcaccgggctgcagaccggcgacgaggccgactactactgcgggacctgggaccggagcctgtccgccggcggggtgttcggcacgggcaccaaggtcaccgtgctc

SEQ ID NO: 9251 - RNA, 432 nt, synthetic construct
  misc_feature 1..432: note = derived and/or modified sequence opt1 from anti-HIV-1_HeavyChain
  source 1..432: mol_type = other RNA
caggcccagctggtggagagcggcgggggcgtcgtgcagcccgggcgctccctccggctgagctgcgccgcgtccggcttcaccttcagctcctacgggatccactgggtgcgccaggccccgggcaagggcctggagtgggtcgccgtgatgagctccgacgggacctacaagtactacggcgacagcatgaaggggcggttcacgatctcccgcgacaacagcaagaactccctctacctgcagatgaacagcctgcgggccgtggacaccgccgtctactactgcgcgaaggacctcggcgagggggagaacgaggagtgggccaccgactactacgacttctccatcggctaccccggccaggacccccgcggggtggtgggcaccttcgacatctgggggcagggcacgatggtcaccgtgagctcc

SEQ ID NO: 9252 - RNA, 426 nt, synthetic construct
  misc_feature 1..426: note = derived and/or modified sequence opt1 from anti-HIV-1_HeavyChain
  source 1..426: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgtgatcagcgacgacgggtccaacaagtactacgccgacagcgtcaagggccggttcaccatctcccgcgacaacagcaagaacacgctctacctgcagatgaactccctgcgggccgaggacaccgccgtgtactactgcgcgaaggacctcggggagagcgagaacgaggagtgggcctccgactactacgacttcggcagcgactaccccgggcaggacccccgcgccgtggtcggcgccttctggggccaggggaccatggtgaccgtgtccagc

SEQ ID NO: 9253 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagtccgggcgcagcctccggctgtcctgcgccgccagcggcttcaccttctccgcgtacgccctgcactgggtccgccaggcccccgggaagggcctcgagtgggtggccgtgatcagctacgacggccgggacaaggactacgccgactccgtcaaggggcgcttcaccatcagccgggacaactccaagaacacgctgtacctgcagatgaacagcctccgcgcggaggacaccgccgtgtactactgcgccaaggacctgggcgagtccgagaacgaggagtgggccagcgactactacgacttcgggtccgactacccgggccaggacccccgggcggtggtcggggccttcgacatctggggccagggcaccatggtgaccgtgagctcc

SEQ ID NO: 9254 - RNA, 432 nt, synthetic construct
  misc_feature 1..432: note = derived and/or modified sequence opt1 from anti-HIV-1_HeavyChain
  source 1..432: mol_type = other RNA
caggtgcagctggtccagagcggcgggggcctcgtgcagcccgggcgctccctgcggctgagctgcgtggcctccggcttccgcttcagcttccacgggatgcactgggtccggcaggccccgggcaagggcctcgagtgggtggcggtggtctccgacgacgggagcgaccagaagtacgtggactccgtgaagggccgcctgaccatcagccgggacaactccaagaacaccgtctacctgcagatgaacagcctccgcgccgaggacacggccgtgtactactgcgccaaggacctgggggagtccgagaacgaggagtgggccagcgactactacgacttcggctccgactaccccgggcaggacccccgggcggtggtcggcgccttcgacatctggggccaggggaccatggtgaccgtgagctcc

SEQ ID NO: 9255 - RNA, 432 nt, synthetic construct
  misc_feature 1..432: note = derived and/or modified sequence opt1 from anti-HIV-1_HeavyChain
  source 1..432: mol_type = other RNA
gaggtgcacctggtcgagagcggcgggggcgtggtgcagcccgggcggtccctccggctgagctgcgccgcctccggcttcaccttcaacagctacgcgatgatctgggtccgccaggccccggggaagggcctggagtgggtggccgtgatctcctacgacggcaacaacaagtactacgccgacagcgtcaaggggcggttcaccatctcccgcgagaacagcaagaacacgctctacctgcagatgaactccctgcgggccgaggacaccgcggtgtaccactgcgccaaggacctcggcgagagcgagaacgaggagtgggcctccgactactacgacttcgggcgcgactaccccggccaggacccccgcggggtggtcggcaccttcgacatctggggccacgggaccatggtgacggtgagctcc

SEQ ID NO: 9256 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcgccccgggggctccctccggctgagctgcaccgcctccgggttccacttcaacaagtacggcatgaactgggtccgccaggccccgggcaaggggctggcgctcgtggccttcatccagagcggcgcctcctacaactactacgccgacagcgtgaaggggcggttcaccatctcccgcgacaacagcaagaacacgctgtacctgcagatgaactccctccgggccgaggacaccgcggtctactactgcgccaaggacctgggcgacagcgagaacgaggagtgggcctccgactactacgacttcgggcgcgactaccccggccaggacccccggggcgtggtgggggccttcgacatctggggccacgggaccatggtcaccgtgagctcc

SEQ ID NO: 9257 - RNA, 432 nt, synthetic construct
  misc_feature 1..432: note = derived and/or modified sequence opt1 from anti-HIV-1_HeavyChain
  source 1..432: mol_type = other RNA
caggtgcacctggtcgagagcggcgggggcgtggtgcagcccgggaagtccctcaccatctactgcgccgtcagcgagttcaccctgtccaactacgccatgcactgggtgcgcctgacgccgggcaaggggctccagtgggtggcggtcatcagctacgacggctccaacaagtactacgccgacagcgtgaagggccggttcaccatctcccgcgacaacagcaagaacaccctgtacctgcagatgaactccctccgggccgaggacaccgccgtgtactactgcgccaaggacctgggggagagcgagaacgaggagtgggcgtccgactactacgacttcggccgcgactaccccgggcaggacccccggggcgtcgtgggggtgttcgacatctggggccagggcacgatggtcaccgtgagctcc

SEQ ID NO: 9258 - RNA, 432 nt, synthetic construct
  misc_feature 1..432: note = derived and/or modified sequence opt1 from anti-HIV-1_HeavyChain
  source 1..432: mol_type = other RNA
gaggtgcagctgctcgagagcggcgggggcgtcgtgcagcccgggcgctccctgcggctgagctgcgccgcctccggcttcaccttcagcacctacgcgctccactgggtgcgccaggccccggggaagggcctggagtgggtcgccgtgatctcctacgacggcagcacgaagttctacgccgactccgtgaaggggcggttcaccatcagccgcgacaactccaagaacaccctgtacctccagatgaacagcctgcgggccgaggacaccgcggtctactactgcgccaaggacctgggcgagtccgagaacgaggagtgggccagcgactactacgacttcgggtccgactaccccggccaggacccccgcgccgtggtgggggcgttcgacatctggggccagggcacgatggtcaccgtgagctcc

SEQ ID NO: 9259 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggggctccctccgcctgagctgcgccgcctccgggttcaccttcagctcctacggcatgcactgggtccggcaggcgccgggcaaggggctggagtgggtggccttcatccgctacgacggcagcaacaagtactacgccgactccgtgaaggggcggttcaccatcagccgcgagaactccaagaacacgctctacctgcagatgaacagcctgcgggccgaggacaccgccgtctaccactgcgcgaaggacctcggcgagtccgagatcgaggagtggaccagcgactactacgacttcgggcgcgactaccccggccaggacccccggggcgtgttcgggaccttcgacatctggggccacgggacgatggtgaccgtctccagc

SEQ ID NO: 9260 - RNA, 432 nt, synthetic construct
  misc_feature 1..432: note = derived and/or modified sequence opt1 from anti-HIV-1_HeavyChain
  source 1..432: mol_type = other RNA
gaggtgcagctggtcgagagcggcgggggcgtggtgaagcccgggggctccctccgcctgagctgcgtcgtgtccgggttcaccttcagcaacgcctggatgtcctgggtgcggcaggccccgggcaagggcctggagtgggtcgcggtgatcagcgacgacgggtccaacaagtactacgccgacagcgtgaagggccgcttcaccatctcccgggacaacagcaagaacacgctctacctgcagatgaactccctgcgcgccgaggacaccgccgtctactactgcgccaaggacctcggggagagcgagaacgaggagtgggcgtccgactactacgacttcggcagcgactaccccgggcaggacccccgggccgtggtgggcgccttcgacatctggggccaggggaccatggtcaccgtgtccagc

SEQ ID NO: 9261 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggggctccctccgcctgagctgcgccgcctccgggttcaccttcagcacctacggcatgcactgggtccggcaggcgccgggcaaggggctggagtgggtggccttcatccgctacgacggccggaacaagaactacgccgactccgtgaaggggcgcttcacgatcagccgggacaactccaagaacaccctctacctgcagatgaacagcctgcgcgccgaggacaccgccgtctactactgcgcgaaggacctcggcgagtccgagaacgaggagtgggccaccgactactacgacttcagcatcgggtaccccggccaggacccccggggcgtggtggggatcttcgacatctggggccaggggacgatggtcaccgtgtccagc

SEQ ID NO: 9262 - RNA, 432 nt, synthetic construct
  misc_feature 1..432: note = derived and/or modified sequence opt1 from anti-HIV-1_HeavyChain
  source 1..432: mol_type = other RNA
caggtgcacctggtcgagagcggcgggggcgtggtgcagcccgggggctccctccgcctgagctgcgccgcctccgggttcagcttctccatctacggcatgcactgggtccggcaggcgccgggcaaggggctggagtgggtgaccttcacccgctacgacggcagcaacaagtactacacggactccgtgaaggggcggttcaccatcagccgcgacaactccaagaacaccctctacctgcagatgaacagcctgcggaccgaggacacggccgtctactactgcgccaaggacctcggcgagtccgagaacgaggagtgggccagcgactactacgacttcgggtccgactaccccggccaggacccccgcgccgtggtgggcgcgttcgacatctgggggcagggcaccatggtcaccgtgagctcc

SEQ ID NO: 9263 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggggctccctccgcctgagctgcgccgcctccgggttcaccttcagctcctacggcatgcactgggtccggcaggcgccgggcaaggggctggagtgggtggccttcatccgctacgacggcagcaacaagtactacgccgaccccgtgaaggggcggttcaccatctcccgcgacaacagcaagaacacgctctacctgcagatgaactccctgcgggccgaggacaccgccgtctactactgcgcgaaggacctcggcgagagcgagaacgaggagtgggcctccgactactacgacttcgggcgcgactaccccggccaggacccccggggcgtggtgggggtcttcgacatctggggccaggggaccatggtgaccgccagctcc

SEQ ID NO: 9264 - RNA, 432 nt, synthetic construct
  misc_feature 1..432: note = derived and/or modified sequence opt1 from anti-HIV-1_HeavyChain
  source 1..432: mol_type = other RNA
gagatgcagctggtggagagcggcgggggcctcgtccagcccgggggctccctgcgcctgagctgcgccgcctccgggttcaccttcagctcctactggatgagctgggtgcggcaggcgccgggcaagggcctcgagtgggtggccgtcatctcctacgacgggaacaacaagtactacgccgacagcgtgaagggccgcttcaccatctcccgggagaacagcaagaacacgctgtacctgcagatgaactccctccgcgccgaggacaccgccgtgtactactgcgcgaaggacctgggggagagcgagaacgaggagtgggcctccgactactacgacttcggcagcgactaccccgggcaggacccccggggcgtcgtgggcaccttcgacatctgggggcacggcaccatggtgacggtctccagc

SEQ ID NO: 9265 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggcgctccctccggctgagctgcgccgcctccggcttcaccttcagctcctgcgcgatgcactgggtccgccaggccccggggaagggcctggagtgggtggccgtgatcagctacgacggcaacaacaagcactacgccgactccgtcaaggggcggttcaccatcagccgcgacaactccaagaacacgctctacctgcagatgaacagcctgcgggccgaggacatggcggtgtactactgcgccaaggacctcggcgagtccgagaacgaggagtgggccagcgactactacgacttctggcgcgactaccccgggcaggacccccggggctgggtggggaccttcgacatctggggccagggcaccatggtcaccgtgtccagc

SEQ ID NO: 9266 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggcgctccctccggctgagctgcgccgcctccggcttcaccttcagcaactacgggatgcactgggtccgccaggcgccgggcaagggcctggagtgggtgaccgtgatctccagcgacgggtccaagaagtactacgccgacagcgtcaagggccggttcacgatctcccgcgacaacagcaagaacaccctctacctgcagatgaacgggctgcgggccgacgacaccgccgtgtactactgcgccaaggacctcggcgactccgagaacgaggagtgggcgagcgactactacgacttcgggcgcgactaccccggccaggacccccggggcgtggtcggggccttcgacatctggggccacgggaccatggtgacggtgtccagc

SEQ ID NO: 9267 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggggctccctccgcctgagctgcgccgcctccgggttcaccttcagctcctacggcatgcactgggtccggcaggcgccgggcaaggggctggagtgggtggccttcatccgctacgacggcagcaacaagtactacgccgactccgtgaaggggcggttcaccatcagccgcgacaactccaagaacacgctctacctgcagatgaacagcctgcgggccgtcgacaccgccgtgtactactgcgcgaaggacctcggcgagggggagaacgaggagtgggccaccgactactacgacttctccatcggctaccccggccaggacccccgcggggtggtcggcgccttcgacatctgggggcagggcaccatggtgacggtgagctcc

SEQ ID NO: 9268 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggcgctccctccggctgagctgcgccgcctccggcttcaccttccgcaactacgggatgcactgggtccggcagagcccgggcaagggcctggagtgggtggcggtgatctcctacgacgggaagatcatcaactacatcgacttcgtcaagggccgcttcaccatcagccgggagaactccaagaacacgctctacctgcagatgaacagcctgcgcgccgaggacaccgccgtgtactactgcgccaaggacctcggggagtccgagaacgaggagtgggccagcgactactacgacttcggctccgactaccccgggcaggacccccggggcgtggtcggcaccttcgacatctgggggcacggcaccatggtgacggtgagctcc

SEQ ID NO: 9269 - RNA, 432 nt, synthetic construct
  misc_feature 1..432: note = derived and/or modified sequence opt1 from anti-HIV-1_HeavyChain
  source 1..432: mol_type = other RNA
gaggtgcagctgctcgagagcggcgggggcctggtccagcccgggcgctccctgcggctcagctgcgccgcctccggcttcaccttcagctcctacgtgatgcactgggtgcgccaggcgccggggaagggcctggagtgggtcgccgtgatcagctacgacggctccaacaagcactacgccgacagcgtgaaggggcggttcaccatctcccgcgacaacagcaagaacacgctgtacctccagatgaactccctgcgggccgaggacaccgccgtctactaccgcgcgaaggacctgggcgagagcgagaacgaggagtgggcctccgactactacgacttcgggcgggactaccccggccaggacccccgcggggtggtgggcgtcctctacatctggggccaggggaccatggtgaccgtgagctcc

SEQ ID NO: 9270 - RNA, 432 nt, synthetic construct
  misc_feature 1..432: note = derived and/or modified sequence opt1 from anti-HIV-1_HeavyChain
  source 1..432: mol_type = other RNA
gaggtgcagctggtcgagagcggcgggggcctcgtgaagcccgggggctccctgcgcctgagctgcgccgcctccgggttcaccttcagcacctactccatgcactgggtgcggcaggcgccgggcaagggcctcgagtgggtcgccgtgatcagctacgacgggaacaacaagtactacgccgactccgtgaagggccgcttcacgatcagccgggagaactccaagaacaccctgtacctgcagatgaacagcctccgcgccgaggacaccgccgtctaccactgcgcgaaggacctgggggagtccgagaacgaggagtgggccagcgactactacgacttcggccgggactaccccgggcaggacccccgcggcgtggtgggcaccttcgacatctgggggcacggcacgatggtcaccgtgtccagc

SEQ ID NO: 9271 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgacagcggcgggggcgtggtgcagcccgggcgctccctccggctgttctgcgccgtcagcggcttcaccttctccacctacacgatgcactgggtgcgccaggccccggggcggggcctggagtgggtggcggtcatcagctacgacggctccaccaagtactacgccgacagcgtgcaggggcgcttcaccatctcccgggacaacagcaagaacaccctctacctgcagatgaactccctgcgcgccgaggacacggccgtgtactactgcgccaaggacctcggcgagagcgagaacgaggagtgggcgtccgactactacgacttcgggagcgactaccccggccaggacccccgggccgtcgtgggggccttcgacatctggggccagggcaccatggtgaccgtctccagc

SEQ ID NO: 9272 - RNA, 426 nt, synthetic construct
  misc_feature 1..426: note = derived and/or modified sequence opt1 from anti-HIV-1_HeavyChain
  source 1..426: mol_type = other RNA
caggtgcagctggtcgagagcggcgggggcgtggtgcagcccgggcgctccctccggctgagctgcgccgcctccggcttcaccttcagctccttcgggatgcactgggtccgccaggcgccgggcaagggcctggagtgggtggccgtgatcagctacgacgggaacaacaagtactacgccgactccgtcaagggccggttcaccatcagccgcgagaactccaagaacacgctctacctgcagatgaacagcctgcggcccgaggacaccgccgtgtactactgcgccaaggacctcggggagtccgagaacgaggagtgggcgagcgactactacgacttcggccgcgactaccccgggcaggacccccggggcgtggtcggcaccttcgacatctgggggcacggcaccatggtgacggtg

SEQ ID NO: 9273 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggcgctccctccggctgagctgcgccgcctccggcttcatgttcagccgctacgggatgcactgggtccggcaggcgccgggcaagggcctggagtgggtggccgtgatctcccacgacgggagcaacaagtactacgccgactccgtcaagggccgcttcatcatcagccgggacaactccaagaacaccctctacctgcagatgaacagcctgcgcgccgacgacaccgccgtgtactactgcgcgaaggacctcggggagtccgagaacgaggagtgggccagcgactactacgacttctggatcggctaccccgggcaggacccccggggcgtggtcggcgccttcgacatctgggggcagggcacgatggtgaccgtgtccagc

SEQ ID NO: 9274 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggggctccctccgcctgagctgcgccgcctccgcgttcaccttcagctcctacgggatgcactgggtccggcaggccccgggcaagggcctggagtgggtggccttcatccgctacgacgggagcaacaagtactacgccgactccgtgaagggccggttcaccatcagccgcgacaactccaagaacaccctcttcctgcagatgaacagcctgcgggccgaggacatggcggtctactactgcgccaaggacctcggggagtccgagaacgaggagtgggccagcgactactacgacttctggcgcgactaccccggccaggacccccgggggtgggtgggcacgttcgacatctggggccaggggaccatggtgaccgtctccagc

SEQ ID NO: 9275 - RNA, 426 nt, synthetic construct
  misc_feature 1..426: note = derived and/or modified sequence opt1 from anti-HIV-1_HeavyChain
  source 1..426: mol_type = other RNA
caggtgcagctggtcgagagcggcgggggcgtggtgcagcccgggcgctccctccggctgagctgcgccgcctccggcttcaccttcagctccttcgggatgcactgggtccgccaggcgccgggcaagggcctggagtgggtggccgtgatcagctacgacgggtccaacaagtactacgtcgacagcgtgaagggccggttcaccatctcccgcgacaacagcaagaacacgctctacctgcagatgaactccctgcgggccgaggacaccgccgtgtacgccaaggacctcggggagagcgagaacgaggagtgggcgtccgactactacgacttcggcagcgactaccccgggcaggacccccgcggcgtcgtgggcaccttcgacatctggtcccaggggaccatggtgacggtcagctcc

SEQ ID NO: 9276 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggggctccctccgcctgagctgcgccgcctccgggttcaccttcagcacctacggcatgcactgggtccggcaggcgccgggcaaggggctggactgggtggccttcatccgctacgacggctcccacaagtactacgccgacagcgtgaaggggcggttcacgatctcccgcgagaacagcaagaacaccctctacctgcagatgaactccctgcggcccgaggacaccgccgtctactactgcgccaaggacctcggcgagagcgagaacgaggagtgggcgtccgactactacgacttcgggcgcgactaccccggccaggacccccggggcgtggtggggaccttcgacatctggggccacgggacgatggtcaccgtgagctcc

SEQ ID NO: 9277 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccgtgatcagctacgacggctccggggactactacgccgacagcgtcaagggccggttcaccatctcccgcgacaacagcaagtccacgctctacctgcagatgaacagcctgcggcccgaggacaccgccgtgtactactgcgcgaaggacctcggggagtccgagaacgaggagtgggccagcgactactacgacttcggccgcgactaccccgggcaggacccccggggcgtggtcggcaccttcgacatctgggggcacggcaccatggtgacggtgtccagc

SEQ ID NO: 9278 - RNA, 432 nt, synthetic construct
  misc_feature 1..432: note = derived and/or modified sequence opt1 from anti-HIV-1_HeavyChain
  source 1..432: mol_type = other RNA
caggtgcacctggtcgagagcggcgggggcgtggtgcagcccgggggctccctccgcctgagctgcgccgcctccgggttcaccttcagcacctacggcatgcagtgggtccggcaggcgccgggcaaggggctggagtgggtggccttcatcaagaacgacggcacgaacgagttctacggggactccgtgaagggccgcttcaccatcagccgggacaactccaagaacaccgtcagcctccacatggactccctgcgccccgaggacaccgccctgtactactgcgccaaggacctcggggagagcgagaacgaggagtgggcctccgactactacgacttcggcagcgactaccccggccaggacccccgggcggtggtgggggccttcgacatctggggccaggggacgatggtcaccgtgtccagc

SEQ ID NO: 9279 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggggctccctccgcctgagctgcgtcgcctccgggttcaccttcagctcctacggcatgcactgggtgcggcaggccccgggcaaggggctggagtgggtggcgttcatccgctacgacggccggaacaagtactacgccgacagcgtcaaggggcgcttcaccatctcccgggacaagagcaagaacacgctctgcctgcagatgaactccctgcgcgtggaggacaccgccgtgtactactgcgccaaggacctcggcgacagcgagaacgaggagtgggcctccgactactacgacttcgggcgggactaccccggccaggacccccgcggcgtcgtgggggcgttcgacatctggggccacgggaccatggtgaccgtcagctcc

SEQ ID NO: 9280 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgtgatcagctacgacgggtccaacaagtactaccgggacagcgtcaagggccgcttcaccatctcccgggacaacagcaagaacacggtgtacctccagatgaactccctgcgcgccgaggacaccgccgtgtactactgcgccaaggacctgggggagagcgagtccgaggagtgggcgagcgactactacgacttcggccgggactaccccgggcaggacccccgcggcgtcgtgggcgccctcgacatctgggggcagggcatcatggtgaccgtctccagc

SEQ ID NO: 9281 - RNA, 432 nt, synthetic construct
  misc_feature 1..432: note = derived and/or modified sequence opt1 from anti-HIV-1_HeavyChain
  source 1..432: mol_type = other RNA
gaggtgcagctggtcgagagcggcgggggcatggtgcagcccgggcgcccgctccggctgtcctgcgccgccagcggcttcatcttctccgggttcggcctgcactgggtgcgccaggcgcccggcaaggggctcgagtgggtcgccagcatctcctacgacggcgggaacaagtactacgccgacagcgtgcggggccgcttcaccatctcccgggacaacagcaagaacaccctgtacctgcagatgaactccctccgcgccgaggacacggccgtgtactactgcgcgaaggacctgggggagagcgagaacgaggagtgggcctccgactactacgacttcggcagcgactaccccggccaggacccccgggccgtcgtgggggccttcgacatctggggccaggggaccatggtgaccgtctccagc

SEQ ID NO: 9282 - RNA, 432 nt, synthetic construct
  misc_feature 1..432: note = derived and/or modified sequence opt1 from anti-HIV-1_HeavyChain
  source 1..432: mol_type = other RNA
gaggtgcagctggtcgagagcggcgggggcgtggtgcgccccgggggctccctccggctgagctgcgccgcctccgggttcaccttcaacgactacggcatggcgtgggtccgccaggccccgggcaaggggctggagtgggtggccgacatcagctacgacggctccaacaagtactacgccgacagcgtgaaggggcggttcaccatctcccgcgacaacagcaagaacacgctctacctgcagatgaactccctgcgggccgaggacaccgcggtctactactgcgccaaggacctcggcgagagcgagaacgaggagtgggcctccgactactacgacttcgggcgcgactaccccggccaggacccccggggcgtggtgggggccttcgacatctggggccaggggaccatggtcaccgtgagctcc

SEQ ID NO: 9283 - RNA, 429 nt, synthetic construct
  misc_feature 1..429: note = derived and/or modified sequence opt1 from anti-HIV-1_HeavyChain
  source 1..429: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgtggtcagctacgacgagtccaagtactacgccgacagcgtgaaggggcggttcaccatctcccgcgacaacagcaagaacacgctctacctgcagatgaactccctgcgggccgaggacatggccgtgtactactgcgcgaaggacctcggcgagagcgagaacgaggagtgggcctccgactactacgagttctggcgcgactaccccgggcaggacccccggggctgggtcgggaccttcgacatctggggccagggcaccatggtgaccgtgagctcc

SEQ ID NO: 9284 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagcccggccgcggggtggtgcacccgggcgggagcctccggctgtcctgcgtcaccagcggcttcaccttcgagaacttccccatgcactgggtgcgccaggcccccgggaagggcctggagtgggtggccctcatctcctacgacggcagcgacaagtactactccgacagcgtcaaggggcggttcacgatctcccgcgacaacagcaagaacaccctgtacctgcagatgaactccctccgggcggaggacaccgccgtgtactactgcgccaaggacctgggcgagagcgagaacgaggagtgggcctccgactactacgacttcgggagcgactaccccggccaggacccgcgcggggtggtcggcaccttcgacatctggggccacgggacgatggtgaccgtgtccagc

SEQ ID NO: 9285 - RNA, 432 nt, synthetic construct
  misc_feature 1..432: note = derived and/or modified sequence opt1 from anti-HIV-1_HeavyChain
  source 1..432: mol_type = other RNA
caggcccagctggtggagagcggcgggggcgtcgtgcagcccgggcgctccctccggctgagctgcgccgcgtccggcttcagcttcgccacccacgccatgcactgggtgcgccggtccccggggaagggcctggagtgggtcgccaccatcagctacggcgggaagaacgagtactacgccgactccgtgaagggccgcttcacgatcagccgggagaactccaagaacaccctctacctgcagatgaacagcctgcgcgcggaggacaccgccgtgtactactgcgccaaggacctcggggagtccgagaacgaggagtgggccagcgactactacgacttcggctccgactaccccgggcaggacccccggggcgtcgtgggcaccttcgacatctgggggcacggcacgatggtgaccgtcagctcc

SEQ ID NO: 9286 - RNA, 432 nt, synthetic construct
  misc_feature 1..432: note = derived and/or modified sequence opt1 from anti-HIV-1_HeavyChain
  source 1..432: mol_type = other RNA
gccgtgcagctggtcgagagcggcgggggcctcgtgaagcccgggggctccctgcgcctgagctgcgccgcgtccgggttcaccttcttcaacacctggatgagctgggtgcggcagtccccgggcaagggcctcgagtgggtcgccgacatcagctacgacgggtccaacaagtactacgccgacagcgtgaagggccgcttcacgatctcccgggacaacagcaagaacaccctgtacctgcagatgaactccctccgcgccgaggacaccgccgtgtactactgcgcgaaggacctgggggagagcgagaacgaggagtgggcctccgactactacgacttcggccgggactaccccgggcaggacccccgcggcgtcgtgggcgtgttcgacatctgggggcagggcaccatggtcacggtgagctcc

SEQ ID NO: 9287 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgtgatcagctacgacgggtccaacaagtactacgccgacagcgtcaagggccggttcaccatctcccgcgacaacagcaagaacacgctctacctgcagatgaactccctgcgggccgaggacaccgccgtgtactactgcgcgaaggacctcggggagagcgagaacgaggagtgggcctccgactactacgacttcggcagcgactaccccgggcaggacccccgcgccgtggtcggcgccttcgacatctggggccaggggaccatggtgaccgtgtccagc

SEQ ID NO: 9288 - RNA, 432 nt, synthetic construct
  misc_feature 1..432: note = derived and/or modified sequence opt1 from anti-HIV-1_HeavyChain
  source 1..432: mol_type = other RNA
caggtgcgcctggtcgagagcggcgggcgggtggtgcagcccggcgggtccctccgcctgagctgcgtcgcctccggcttcaccttcagctcctacgggatccactgggtgcggcaggccccgggcaagggcctggagtgggtgaccttcatctggcacgacgggcgcgacacgtactacgcggacgccgtcaagggccggttcaccatcagccgcgacaactccaagaacaccctctacctgcagatgaacagcctgcgggccgaggacaccgccgtgtactactgcgccaaggacctcggggagtccgagaacgaggagtgggcgacggactactacgacttctggaccggctaccccgggcaggacccccgcgccgtggtcggcgccttcgacatctggggccaggggaccatggtgaccgtgagctcc

SEQ ID NO: 9289 - RNA, 432 nt, synthetic construct
  misc_feature 1..432: note = derived and/or modified sequence opt1 from anti-HIV-1_HeavyChain
  source 1..432: mol_type = other RNA
caggtgcacctggtcgagagcggcgggggcgtggtgcagcccgggcgctccctccggatctactgcgccgtcagcgagttcaccttccgcaactacgccatgcactgggtgcggctggcgccgggcaaggggctgcagtgggtggccgtcatctcctacgacggcagcaacaagtactacggcgactccgtgaaggggcgcttcaccatcagccgggacaactccaagaacacgctctacctgcagatggacagcctgcgcgccgaggacaccgccgtgtactactgcgccaaggacctcggcgagtccgagaacgaggagtgggcgagcgactactacgacttcgggcgggactaccccggccaggacccccgcggggtcgtgggcaccttcgacatctggggccacgggaccatggtgacggtctccagc

SEQ ID NO: 9290 - RNA, 432 nt, synthetic construct
  misc_feature 1..432: note = derived and/or modified sequence opt1 from anti-HIV-1_HeavyChain
  source 1..432: mol_type = other RNA
gaggtgcagctggtcgagagcggcgggggcctcgtgaagcccgggggctccctgcgcctgagctgcgccgcctccgggttcaccttcagcgacgcgtggatgtcctgggtgcggcaggccccgggcaagggcatggagtgggtcgccgtgatcagctacgacgggtccaacaagtactacgccgacagcgtgaagggccgcttcaccatctcccgggacaacagcaagaacacgctctacctgcagatgaactccctgcgcgccgtcgacaccgcggtgtactactgcgccaaggacctcggggagggcgagaacgaggagtgggccaccgactactacgacttcagcatcgggtaccccggccaggacccccggggcgtggtcggggccttcgacatctggggccaggggaccatggtgacggtgtccagc

SEQ ID NO: 9291 - RNA, 432 nt, synthetic construct
  misc_feature 1..432: note = derived and/or modified sequence opt1 from anti-HIV-1_HeavyChain
  source 1..432: mol_type = other RNA
gaggtgcaggtcgtggagagcggcgggggcctggtgaagcccgggggctccctccgcctgagctgcgaggcctccgggttcaccttcagcaacgcctggatgtcctgggtccggcaggcgccgggcaagggcctggagtgggtggccgtgatcagctacgacgggaacaacaagtactacgccgactccgtcaagggccgcttcaccatcagccgggagaactccaagaacacgctctacctgcagatgaacagcctgcgcgccgaggacaccgccgtgtaccactgcgcgaaggacctcggggagtccgagaacgaggagtgggccagcgactactacgacttcggccgggactaccccgggcaggacccccgcggcgtggtcggcaccttcgacatctgggggcacggcaccatggtgacggtgtccagc

SEQ ID NO: 9292 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggggctccctccgcctgagctgcgccgcctccgggttcaccttcagctcctacggcatccactgggtccggcaggcgccgggcaaggggctggagtgggtggccttcatccgcagcgacgccaccaacaagtactacgccgactccgtgaagggccggttcacgatcagccgcgagaactccaagaacaccctctacctgcagatgaacagcctgcgggccgaggacaccgcggtctactactgcgccaaggacctcggggagtccgagaacgaggagtgggccagcgactactacgacttcggctccgactaccccgggcaggacccccgcggcgtggtgggcaccttcgacatctgggggcacggcacgatggtcaccgtgagctcc

SEQ ID NO: 9293 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggcgctccctccggctgagctgcgccgcctccggcttcaccttcagctccttcgggatgcactgggtccgccaggcgccgggcaagggcctggagtgggtggccgtgatcagctacgacgggaacaacaagtactacgccgactccgtcaagggccggttcaccatcagccgcgagaactccaagaacacgctctacctgcagatgaacagcctgcgggccgaggacaccgccgtgtactactgcgcgaaggacctcggggagtccgagaacgaggagtgggccagcgactactacgacttcggctccgactaccccgggcaggacccccgcggcgtggtcggcaccttcgacatctgggggcacggcaccatggtgacggtgagctcc

SEQ ID NO: 9294 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggcgctccctccggctgagctgcgccgcctccggcttcaccttcagcaactacgcgatggactgggtccgccaggccccggggaagggcctggagtgggtggccgtgatctcctacgacggcagcaacaagtactacgccgactccgtcaaggggcggttcaccatcagccgcgacaactccaagaacacgctctacctgcagatgaacagcctgcgggccgaggacaccgcggtgtactactgcgccaaggacctcggcgagtccgagaacgaggagtgggccaccgactactacgacttctggaccgggtaccccggccaggacccccgcgccgtggtcggggcgttcgacatctggggccagggcacgatggtgaccgtgagctcc

SEQ ID NO: 9295 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgtggtcagctacgacgagtccaacaagtactacgccgggagcgtgaagggccggttcaccatctcccgcgacaacagcaagaacacgctctacctgcagatgaactccctgcggaccgaggacatggccgtgtactactgcgccaaggacctcggggagagcgagaacgaggagtgggcgtccgactactacgacttcggccgcgagtaccccgggcaggacccccggggctgggtcggcaccttcgacatctgggggcagggcaccatggtgacggtgagctcc

SEQ ID NO: 9296 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgtgatcagctacgacgggtccaacaagtactacgtcgacagcgtgaagggccggttcaccatctcccgcgacaacagcaagaacacgctctacctgcagatgaactccctgcgggccgaggacaccgccgtgtactactgcgccaaggacctcggggagagcgagaacgaggagtgggcgaccgactactacgacttctccatcggctaccccgggcaggacccccgcggcgtcgtgggcatcttcgacatctgggggcagggcaccatggtgacggtcagctcc

SEQ ID NO: 9297 - RNA, 432 nt, synthetic construct
  misc_feature 1..432: note = derived and/or modified sequence opt1 from anti-HIV-1_HeavyChain
  source 1..432: mol_type = other RNA
caggtgcagctggtcgagagcggcgggggcgtggtgcagcccgggcgctccctccggctgagctgcgccgcctccggcttcaccttcagcacctccgggatgcactgggtccgccaggcgccgggcaagggcatggagtgggtggccgtgatcagctacgacgggtccaacaagtactacgccgacagcgtcaagggccggttcacgatctcccgcgacaacagcaagaacaccctgtacctccagatgaactccctgcgggccgtggacaccgccgtgtactactgcgcgaaggacctgggggagggcgagaacgaggagtgggccaccgactactacgacttcagcatcgggtaccccggccaggacccccgcggcgtcgtgggggccttcgacatctggggccaggggacgatggtgaccgtctccagc

SEQ ID NO: 9298 - RNA, 363 nt, synthetic construct
  misc_feature 1..363: note = derived and/or modified sequence opt1 from anti-HIV_C38-VRC18.02_HeavyChain
  source 1..363: mol_type = other RNA
caggtgcgcctggtccagagcggcaaccaggtgcggaagcccggggcctccgtgcgcatcagctgcgaggcctccggctacaagttcatcgaccacttcatccactgggtccgccaggtgccggggcacggcctcgagtggctggggtggatcaacccccggggcggcggggtgaactacagccggtccttccagggcaagctgagcatgaccatgacccgcgacaacttcgaggagacggcgtacctcgacctgtccaagctgaaccccggggacaccgccgtctacttctgcgcccggggcttcgccgggtacgagtggagcttcatctggggccagggcaccctcgtgatcgtgtccagc

SEQ ID NO: 9299 - RNA, 396 nt, synthetic construct
  misc_feature 1..396: note = derived and/or modified sequence opt1 from anti-HIV_44-VRC13.02_HeavyChain
  source 1..396: mol_type = other RNA
caggtgcagctggtccagagcggcaccgccctcaagtcccccgggagctccgccaagctgagctgcaccgtgctgggcgacgagttcgggacgtacttcatctcctggatccgccaggcgccgggccaggggctcgagtgggtgggcggcatcgtcccccacagccagctgcagtccagcgcccagaagttccacgggcggatcatcatctccgccggcgccggggtgaccccgcccgtggtcagcctgcagctcaccaacctgaccttcgaggacacgggcacctacttctgcgcccgcgagcgggggcgccaccgggaccccaagaccggcgacgcgctgcgcggccggtacttcgacttctgggggcgcggcaccgggctccgggtgtccacg

SEQ ID NO: 9300 - RNA, 321 nt, synthetic construct
  misc_feature 1..321: note = derived and/or modified sequence opt1 from anti-HIV-1_LightChain
  source 1..321: mol_type = other RNA
gacatcaagctgacccagagccccgccttcctctccgccagcgtgggcgagcgcgtcaccttcacgtgccgggcgtcccaggacatcagccacgacctggtgtggttccagcagaaggccgggcgcgccccgtccctgctcatgttctacggcagcaccctggagcgcggggtgccgccccggttctccggccggcgcagcgggaccgagttcaccgtcacgatcgactccctgcagcccgaggacgtgggcacctactactgccagcagctcagcgccttccccctgaccttcggcgggggcaccacggtggacatcaag

SEQ ID NO: 9301 - RNA, 321 nt, synthetic construct
  misc_feature 1..321: note = derived and/or modified sequence opt1 from anti-HIV-1_LightChain
  source 1..321: mol_type = other RNA
gacatcaagatgacccagagccccgccttcctgtccgccagcgtgggcgagcgcgtcaccttcacgtgccgggcgtcccaggacatcagccacgacgtggtgtggttccagcagaagtccgggagcgccccgaagctcctgatgttctacggctccaccctggagcgcggggtcccgccccggttcagcggccgccggtccgggaccgagttcaccgtgacgatcgacggcctccagcccgaggacgtgggcacctactactgccagcagctgagcgccttccccctgaccttcgggggcgggaccacggtcgacatcaag

SEQ ID NO: 9302 - RNA, 321 nt, synthetic construct
  misc_feature 1..321: note = derived and/or modified sequence opt1 from anti-HIV-1_LightChain
  source 1..321: mol_type = other RNA
gacatcaagctgacccagagccccgccttcctctccgccagcgtgggcgagcgcgtcaccttcacgtgccgggcgtcccaggacatccgccacgagctggtgtggtaccagcagaagccggggcggggccccaagctgctcatctactacgggagcaccctggagggcggggtgccctcccgcttcagcggccggcgctccggcaccgagttcaccgtcacgatcagctccctgcagcccgaggacgtggggacctactactgccagcagctcaacagcttcccgctgaccttcggcgggggcaccacggtggacatccgg

SEQ ID NO: 9303 - RNA, 321 nt, synthetic construct
  misc_feature 1..321: note = derived and/or modified sequence opt1 from anti-HIV-1_LightChain
  source 1..321: mol_type = other RNA
gacatccagctgacccagagcccctccttcctcagcgcctccgtgggcgaccgcgtcagcatcacgtgccgggcctcccaggggatcaagcacgagctggcgtggtaccagcagaagccgggccgcgcccccagcctgctcatctactacgcctccaccctggcccgcggggtgcccagccggttctccgccagctggtccggcaccctgttcaccctcaccatcaacgggctgcagcccgaggacttcgcgacgtacttctgccagcagatgaacagcctgccgctcaccttcggcggcgggaccaagatggacgtgcgg

SEQ ID NO: 9304 - RNA, 321 nt, synthetic construct
  misc_feature 1..321: note = derived and/or modified sequence opt1 from anti-HIV-1_LightChain
  source 1..321: mol_type = other RNA
gacatccagctgacccagagcccctccttcctcagcgcctccgtgggcgacaaggtcaccatcacgtgccgcgccagccacggggtgcggaacgagctggcgtggtaccagcagaagccgggcaaggcccccaacctgctcatctactacgcctccaccctgcagagcggggtgccctcccgcttcagcgccaccggctccgggacccacttcacgctgaccgtcagctccctccagcccgaggacttcgccacctacttctgccagcacatgagctcctacccgctgaccttcggcggcgggacgaaggtggagatcaag

SEQ ID NO: 9305 - RNA, 321 nt, synthetic construct
  misc_feature 1..321: note = derived and/or modified sequence opt1 from anti-HIV-1_LightChain
  source 1..321: mol_type = other RNA
gacatccagctgacccagagcccctccttcctcagcgcctccgtgggcgacaaggtcaccttcacgtgccgcgccagccagggggtgcggaacgagctggcgtggtaccagcagaagccgggcaaggcccccaacctgctcatctactacgcctccaccctgcagagcggggtgccctcccgcttcagcgccaccggctccgggacccacttcagcctgacggtctccagcctccagcccgaggacttcgccacctacttctgccagcacatgtccagctacccgctgaccttcggcggcgggaccaaggtggagatcaag

SEQ ID NO: 9306 - RNA, 321 nt, synthetic construct
  misc_feature 1..321: note = derived and/or modified sequence opt1 from anti-HIV-1_LightChain
  source 1..321: mol_type = other RNA
gacatccagctgacccagagcccctccttcctcagcgcctccgtgggcgacaaggtcaccatcacgtgccgcgccagccagggggtgcggaacgagctggcgtggtaccagcagaagccgggcaaggcccccaacctgctcatctactacgcctccaccctgcagagcggggtgccctcccgcttcagcgccaccggctccgggacccacttcacgctgaccgtcagctccctccagcccgaggacttcgccacctacttctgccagcacatgagctcctacccgctgaccttcggcggcgggacgaaggtggagatcaag

SEQ ID NO: 9307 - RNA, 366 nt, synthetic construct
  misc_feature 1..366: note = derived and/or modified sequence opt1 from anti-HIV-1_HeavyChain
  source 1..366: mol_type = other RNA
agccagtacctggcccagcccggcgccgaggtggcgaagccgggggcctccgtcaaggtgagctgcaaggtgcacggcgacaacttccgcgggcactacctccactgggtccggcaggcccccggccaggggctgcagtggatcggcggcatcaaccccttctccggggaggccgcctacggcaagcgcttcgaggggcggctgcgcctcacccgggacaccagcgtgaacacggcgtacatggagctggccaagctgacccccgacgacaccgccgtgtacttctgcgcccgcgacaagacctacaacgacgagttcacggcgatggacatctggggccacgggaccaccgtcatcgtgtccagc

SEQ ID NO: 9308 - RNA, 366 nt, synthetic construct
  misc_feature 1..366: note = derived and/or modified sequence opt1 from anti-HIV-1_HeavyChain
  source 1..366: mol_type = other RNA
agccagtacctggcccagcccggcgccgaggtggcgaagccgtgggcctccgtcaaggtgagctgccgcgtgcacggggacaacttccggggcttctacctccactgggtccgccaggcccccgggcagggcctggagtggatcgggggcatcaaccccttctccggcgaggccgcctacgggcggcgcttcgagggccggctgcgcctcacccgggacaccagcatcaacacggcgtacatggaggtgaccaagctgacctccgacgacaccgccgtgtacttctgcgcccgcgacaagacgtacaacgacgagttcaccgccatggacatctgggggcagggcaccaccgtcatcgtgagctcc

SEQ ID NO: 9309 - RNA, 366 nt, synthetic construct
  misc_feature 1..366: note = derived and/or modified sequence opt1 from anti-HIV-1_HeavyChain
  source 1..366: mol_type = other RNA
agccagtacctggcccagtccggcagcgaggtgaagaagcccggggcctccgtcaaggtgagctgccgcctccacggcgacaagttcggggcgcactacatccactgggtgcggcaggccccgggccaggggctggagtggctgggcttcttccaccccggcaccggggacgccgtctccgcccagaagttccagggccgcatcagcctcacccgggacacgtccatcagcaccgggtacctggaggtgcgccggctgtccagcgacgacaccgccgtgtactactgcgcgcgcgacaagacctactccgacgaggccacgggcatggacatctgggggcagggcaccaccgtcatcgtgagctcc

SEQ ID NO: 9310 - RNA, 366 nt, synthetic construct
  misc_feature 1..366: note = derived and/or modified sequence opt1 from anti-HIV-1_HeavyChain
  source 1..366: mol_type = other RNA
agcctggagctcgtgcagtccggcaccgaggtcaagaagcccggggccagcgtgaaggtgtcctgcaagctgttcggcgacaccatcacgagcgggccgatccactgggtccgccaggcccccggccaggggctggagtggatgggctggaccaacccccactccggcgacaccgcgaccgcccccaagttccaggggcgggtgtacatgacgaacgacaagaagatcaacaccgccttcctcgacgtgacccgcctggccagcgacgacaccgccatctacttctgcgcgcgggacatgtactactccaacgaggccgtcggcatggacgtgtgggggcagggcacgaccgtgagcgtctccagc

SEQ ID NO: 9311 - RNA, 366 nt, synthetic construct
  misc_feature 1..366: note = derived and/or modified sequence opt1 from anti-HIV-1_HeavyChain
  source 1..366: mol_type = other RNA
caggaggtgctggtccagagcggcgccgaggtgaagaagcccggggcctccgtgaaggtcagctgccgcgcgttcggctacaccttcaccgcccacgccctccactgggtgcggcaggccccggggcagggcctggagtggctggggtggatcaacccccactccggcgacacgaccaccagccagaagttccagggccgcgtgtacatgacccgggacaagtccatcaacacggcctacctcgaggtcacccgcctgaccagcgacgacaccgcgatcttctactgcgcccgggacaagtactacggggacgaggccgtgggcatggacgtgtgggggcagggcacgtccgtcaccgtgagctcc

SEQ ID NO: 9312 - RNA, 366 nt, synthetic construct
  misc_feature 1..366: note = derived and/or modified sequence opt1 from anti-HIV-1_HeavyChain
  source 1..366: mol_type = other RNA
caggaggtgctggtccagagcggcgccgaggtgaagaagcccggggcctccgtgaaggtcagctgccgcgcgttcggctacaccttcaccgggaacgccctccactgggtgcggcaggccccgggccaggggctggagtggctgggctggatcaacccccactccggcgacacgaccaccagccagaagttccaggggcgcgtgtacatgacccgggacaaggccatcaacacggcctacctcgacgtcacccgcctgacctccgacgacaccgcgatctactactgcgcccgggacaagtactacggcaacgaggccgtggggatggacgtgtggggccaggggacgagcgtcaccgtgtccagc

SEQ ID NO: 9313 - RNA, 366 nt, synthetic construct
  misc_feature 1..366: note = derived and/or modified sequence opt1 from anti-HIV-1_HeavyChain
  source 1..366: mol_type = other RNA
caggaggtgctggtccagagcggcgccgaggtgaagaagcccggggcctccgtgaaggtcagctgccgcgcgttcggctacaccttcaccgggaacgccctccactgggtgcggcaggccccgggccaggggctggagtggctgggctggatcaacccccactccggcgacacgaccaccagccagaagttccaggggcgcgtgtacatgacccgggacaagtccatcaacacggccttcctcgacgtcacccgcctgaccagcgacgacaccggcatctactactgcgcccgggacaagtactacgggaacgaggcggtgggcatggacgtgtgggggcagggcacgtccgtcaccgtgagctcc

SEQ ID NO: 9314 - RNA, 303 nt, synthetic construct
  misc_feature 1..303: note = derived and/or modified sequence opt1 from anti-HIV_45_LightChain
  source 1..303: mol_type = other RNA
agcctgacccagtcccccggcaccctcagcctgtccccgggggagacggccatcatcagctgccgcacctcccagtacggcagcctggcctggtaccagcagcggcccgggcaggcgccccgcctcgtgatctactccggcagcacccgggccgccgggatccccgaccgcttctccggcagccggtggggcccggactacaacctgaccatctccaacctggagagcggggacttcggcgtgtactactgccagcagtacgagttcttcgggcagggcacgaaggtccaggtggacatcaag

SEQ ID NO: 9315 - RNA, 303 nt, synthetic construct
  misc_feature 1..303: note = derived and/or modified sequence opt1 from anti-HIV_45_LightChain
  source 1..303: mol_type = other RNA
gtgctgacccagagccccggcaccctctccctgagcccgggggagacggccaccatctcctgccgcaccagccagtacggctccctggcctggtaccagcagcggcccgggcaggcgccccgcctcgtcatctacagcggctccacccgggccgccgggatccccgaccgcttcagcggctcccggagcggcccggactacacgctgaccatctccaacctggagagcggggacttcggcgtgtactactgccagcagtacgagttcttcgggcagggcaccaaggtgcagcaggacaacaag

SEQ ID NO: 9316 - RNA, 303 nt, synthetic construct
  misc_feature 1..303: note = derived and/or modified sequence opt1 from anti-HIV_45_LightChain
  source 1..303: mol_type = other RNA
gtgctgacccagagccccggcaccctctccctgagcccgggggagacggccatcatctcctgccgcaccagccagtacggctccctggcctggtaccagcagcggcccgggcaggcgccccgcctcgtcatctacagcggctccacccgggccgccgggatccccgaccgcttcagcggctcccggtggggcccggactacaacctgaccatcagcaacctggagtccggggacttcggcgtgtactactgccagcagtacgagttcttcgggcagggcacgaaggtgcaggtcgacatcaag

SEQ ID NO: 9317 - RNA, 363 nt, synthetic construct
  misc_feature 1..363: note = derived and/or modified sequence opt1 from anti-HIV_45_HeavyChain
  source 1..363: mol_type = other RNA
caggtgcgcctgagccagtccggcgggcagatgaagaagcccggcgagagcatgcggatctcctgccgcgccagcgggtacgagttcatcgactgcaccctcaactggatccggctggccccgggccgccggcccgagtggatggggtggctgaagccccgcggcggcgcggtcaactacgcccgggtgttccaggggcgcgtgaccatgacgcgggacgtctactccgacaccgccttcctcgagctgcgcagcctgaccgccgacgacaccgccgtgtacttctgcacgcggggcaagaccgtggactacaactgggacttcgagcacgtcgggcccggcaccccggtgaccgtgtccagc

SEQ ID NO: 9318 - RNA, 363 nt, synthetic construct
  misc_feature 1..363: note = derived and/or modified sequence opt1 from anti-HIV_45_HeavyChain
  source 1..363: mol_type = other RNA
caggtgcgcctgagccagtccggcgggcagatgaagaagcccggcgagagcatgcggatctcctgccaggccagcgggtacgagttcatcgactgcaccctcaactgggtccgcctggccccgggccggcgccccgagtggatggggtggctgaagccccggggcggcgcggtgaactacgcccgcatcttccaggggcgggtgaccatgacgcgcgacgtctactccgacaccgccttcctcgagctgcggagcctgaccgccgacgacaccgccgtgtacttctgcacgcgcggcaagaactgcgactacaactgggacttcgagcacgtggggcccggctacccggtcaccgtgtccccc

SEQ ID NO: 9319 - RNA, 375 nt, synthetic construct
  misc_feature 1..375: note = derived and/or modified sequence opt1 from anti-HIV_45_HeavyChain
  source 1..375: mol_type = other RNA
caggtgcgcctgagccagtccggcgggcagatgaagaagcccggcgacagcatgcggatctcctgccgcgccagcgggtacgagttcatcaactgcccgatcaactggatccggctcgcccccggcaagcgccccgagtggatggggtggatgaagccccggggcggcgcggtctcctacgcccgccagctgcaggggcgggtgaccatgacccgcgacatgtacagcgagacggccttcctggagctccggtccctgaccagcgacgacaccgccgtgtacttctgcacccgcggcaagtactgcacggcccgggactactacaactgggacttcgagcactgggggcagggcaccccggtcaccgtgtccagc

SEQ ID NO: 9320 - RNA, 435 nt, synthetic construct
  misc_feature 1..435: note = derived and/or modified sequence opt1 from anti-HIV_cap256-206-252885_VR-Chain
  source 1..435: mol_type = other RNA
caggagcagctggtggagagcggcgggggcgtcgtgcccccggggtccagcctcaccctgtcctgcgtggccagccgcttcaccttctccgccttcggcatgcactgggtccggcaggcgcccgggaagggcctggagtgggtggccggcgtgagcttcgtcgggatcaagaagtactacgccgactccgtgaagggccgcttcacgatcagccgggacaactccaagaacaccctcttcctgcagatgaacgggctgcgcggcgaggacaccgggctctactactgcgtgaaggacatgcggtacctggagtgcgaggagtgggccagcgactactacgacttcggcaagcccaaccagccctgcctggaccgccggggcgtctccgggatcagcgccttctggggccaggggaccacggtgaccgtgtccagc

SEQ ID NO: 9321 - RNA, 438 nt, synthetic construct
  misc_feature 1..438: note = derived and/or modified sequence opt1 from anti-HIV_cap256-206-249183_VR-Chain
  source 1..438: mol_type = other RNA
caggtgctgctcgtcgagagcggcgggggcgtggtggagcccgggacctccctgaccctgagctgcgccgcctcccgcttcacgttcagcaacttcggcatgcactgggtccggcagacccccgggggcggcctcgagtgggtggcgtccatcagcaacgaggggaacaagaagtaccacgccgagtccgtgtggggccgcttcatcatcagccgggacaactccaagaacaccgtcttcctgcacatgagctccctgcgcccggacgacagcgccctctacttctgcgtgcgggaccgccaggaggacgactgcgaggtgtggtggtccgactacgaggccttcgggcgggagatcccctgccgccagtaccggggccaggggctggccggcatcttcgacatctggggccgcgggaccatggtcacggtgagctcc

SEQ ID NO: 9322 - RNA, 438 nt, synthetic construct
  misc_feature 1..438: note = derived and/or modified sequence opt1 from anti-HIV_cap256-206-220956_VR-Chain
  source 1..438: mol_type = other RNA
cagatgatgctggtggagagcggcggggacgtcgtggagcccggccgctccctcaccctgagctgcgccacctcccagttcacgttcagcaactacgggatgcactgggtgcggcaggccccgggccgcgggctggagtgggtcgcgtccatcagcaacgagggcaacaagaagtaccacgccgagtccgtgtggggccggctcatcatcagccgcgacaactccaagaacaccctgttcctgcacatgagctccctccgggccgacgacagcgccctgtacttctgcgtgcgcgaccggcaggaggacgagtgcgaggagtggtggtccaactactacgccttcgggcgcggcgggccctgccggaagtaccgcggccaggggctggcgggcatcttcgacgtctggggccgggggaccatggtgaccgtgagctcc

SEQ ID NO: 9323 - RNA, 432 nt, synthetic construct
  misc_feature 1..432: note = derived and/or modified sequence opt1 from anti-HIV_cap256-206-220629_VR-Chain
  source 1..432: mol_type = other RNA
caggagcagctggtggagagcggcgggggcgtcgtgcccccggggaagtccctcaagctgagctgcgtggcctcccggttcagcttcggcgccttcgggatgcactgggtccggcaggcgcccggcaagggcctggagtgggtggccgggatctccttcgccggcatcaagaagtactacggggacagcgtgaagggccgcttctacatctcccgggacaacagccagaacaccctcttcctggagatgaacgggctgcgcggcgacgacaccgcccggtactactgcgtcaaggacctccgcgagctggagtgcgaggagtgggcctccgactactacgacttcggcaagccccagccctgcctggacagccgcggggtgtccggcatcagcgcgatgtgggggccgggcacgatggtgaccgtctccagc

SEQ ID NO: 9324 - RNA, 381 nt, synthetic construct
  misc_feature 1..381: note = derived and/or modified sequence opt1 from anti-HIV_cap256-206-200599_VR-Chain
  source 1..381: mol_type = other RNA
caggagaagctggtggagagcggcgggggcgccgtccagcccgggggctccctccgcctgagctgcgtggcctccgggttcaccttcaacggcttcggcatgcactgggtgcggcaggcgccggggaagggcctggagtgggtcgccaccatcagcttctccggggtgtacatcagccgcgagaactccaagaacacgctctacctgcagatgaacggcctgcgcggggaggacaccgccctctactactgcgccaaggacctgcggtacctggagtgcggcgagtggagcacctactacccccagccctgcctcgacacccggggcgtgtccgggatcagcaacgtctggggccccgggacgcgcgtgaccgtgtccagc

SEQ ID NO: 9325 - RNA, 432 nt, synthetic construct
  misc_feature 1..432: note = derived and/or modified sequence opt1 from anti-HIV_cap256-206-186347_VR-Chain
  source 1..432: mol_type = other RNA
caggagctgctcgtggagagcggcgggggcgtcgtgcccccggggaagtccctgaccatcagctgcgtggcctcccgcttcaccttcagcgccttcggcatgcactgggtccggcaggcgcccgggaagggcctgcagtgggtggcctccatcagcttcgccggcacgaagaagtactacgccgacttcgtgaaggggcgcttcaccatctcccgggacaacagcaagaacaccatcttcctccagatgaacggcctgcgcggggaggacaccgccctgtaccactgcgtcaaggacatgcggcagctcgagtgcgaggagtggacgtccgactactacgacttcggccgcccccagccctgcatcgaccggcgcggggtgagcggcatctccgcgatgtggggcccggggaccatggtgaccgtcagctcc

SEQ ID NO: 9326 - RNA, 438 nt, synthetic construct
  misc_feature 1..438: note = derived and/or modified sequence opt1 from anti-HIV_cap256-206-186226_VR-Chain
  source 1..438: mol_type = other RNA
cagatgctgctcgtggagagcggcgggggcgtcgtggagcccgggcgctccctgaccctgagctgcgccacctcccagttcacgttcagcaactacggcatgcactgggtgcggcagaccccggggaccggcctcgagtgggtcgcctccatcagcaacgagggcaacaagaagtaccacggggaggcggtgtggggccgcttcatcatctcccgggacaacagcaagaagaccctgttcctgcacatgtccaacctccgcgccgacgacagcgggctgtacttctgcgtgcgggaccgccaggaggacgagtgcgaggagtggtggtccgactactacagcttcggccgcgggggcccctgccggaagtaccacggccaggggctggccggcatcttcgacatctgggggcggggcacgctcgtcaccgtgtccagc

SEQ ID NO: 9327 - RNA, 435 nt, synthetic construct
  misc_feature 1..435: note = derived and/or modified sequence opt1 from anti-HIV_cap256-206-179686_VR-Chain
  source 1..435: mol_type = other RNA
caggagcagctggtggagagcggcgggggcgtcgtgcccccgtggaagtccctcaccctgagctgcgaggcctcccgcttcaccttcagcgccttcgggatgcactgggtgcggcaggcgcccggcaaggggctggagtgggtcgccggcatctccttcgccggcatcaagaagtactacgccgacagcgtgaaggggcgcttcttcatctcccgggacaacagcaagaaccgcgtgctcctggagatgaacggcctgcggcgcgaggacacggcccggtacttctgcgtcaaggacctccgcgagctggagtgcgaggagtgggcgtccgactactacgacttcgggaagcccaaccagccctgcctggaccggcgcggcgtgagcgggatctccgccatgtggggccagggcaccatggtgaccgtcagctcc

SEQ ID NO: 9328 - RNA, 417 nt, synthetic construct
  misc_feature 1..417: note = derived and/or modified sequence opt1 from anti-HIV_cap256-206-173707_VR-Chain
  source 1..417: mol_type = other RNA
caggagaagctggtggagagcggcgggggcgccgtccagcccgggggctccctccgcctgagctgcgtggcctccgggttcaccttcaagggcttcggcatgcactgggtgcggcaggcgccggggaagggcctggagtgggtcgccaccatcagcttctccggggtgaagaagtactacggcaacagcgccaaggggcgcttcttcatctcccgggacaacctcaagaacacggtgtacctggagatgaacggcctgcgcggcgaggacaccgccctctactactgcgccaaggacctgcggtacctggagtgcggggagtggagcacctactacccccagccctgcctcgacacccgcggcgtctccgggatcagcaacgtgtggggccccggcacgaaggtgaccgtctccagc

SEQ ID NO: 9329 - RNA, 432 nt, synthetic construct
  misc_feature 1..432: note = derived and/or modified sequence opt1 from anti-HIV_cap256-206-173339_VR-Chain
  source 1..432: mol_type = other RNA
caggagctgctcgtggagagcggcgggggcgtcgtgcccccggggaagtccctgaagctgagctgcgtggcctcccggttcaccttcggcgccttcgggatgcactgggtccggcaggcgcccggcaagggcctcgagtgggtggccgggatcagcttcgccggcaccaagaactactacgccgactccgtgaaggggcgcttcacgatcagccgggacaaccccaagaacaccctgttcctgcagatgaacggcctccgcggggacgacaccggcctgtactactgcgtcaaggacatgcgggagctggagtgcgagctctggacctccgactactacgacttcggccgcccccagccgtgcatcgaccagcgcggggtgagcggcatctccgccatgtgggggcagggcacgatggtgaccatcagctcc

SEQ ID NO: 9330 - RNA, 438 nt, synthetic construct
  misc_feature 1..438: note = derived and/or modified sequence opt1 from anti-HIV_cap256-206-172689_VR-Chain
  source 1..438: mol_type = other RNA
cagatgatgctggtggagagcggcgggggcgtcgtggagcccgggcgctccctcaccctgagctgcgccacctcccacttcacgttcagcaactacggcatgcactgggtgcggcaggcccccgggggccgcctggagtgggtcgcgtccatcagcaacgccggcaacaagaagtaccacggggactccgtgtggggccggctcatcatcagccgcgacaactccaagaacaccctgttcctgcacatgagctccctccgggtggacgacagcgccctgtacttctgcgtccgcgaccggcaggaggacgagtgcgaggagtggtggtccgactactacgccttcgggcgcggcgggccgtgccggaagtaccgcggccagggcctggccgggatcttcgacatctggggccgggggaccatggtgaccgtgagctcc

SEQ ID NO: 9331 - RNA, 432 nt, synthetic construct
  misc_feature 1..432: note = derived and/or modified sequence opt1 from anti-HIV_cap256-206-162744_VR-Chain
  source 1..432: mol_type = other RNA
caggagaagctggtggagagcggcgggggcgtcgtgcccccggggaagtccctccgcctgagctgcgtggcctccggcttcaccttcagcgccttcgggatgcactgggtccggcaggcgcccggcaagggcctggagtgggtggccgggatctccttcgccggcatcaagaactactacgccgacagcgtgaaggggcgcttcaccatctcccgggacaacagcaagaactccctcttcctgcagatgaacggcctgcgcggggacgacacggcccggtactactgcgtcaaggacatgcgcgagctcgagtgcgaggagtggaccagcgactactacgacttcggcaagccccagccctgcatcgaccggcgcggcgtgtccgggatcagcgcgatgtggggccaggggaccatggtgaccatctccagc

SEQ ID NO: 9332 - RNA, 438 nt, synthetic construct
  misc_feature 1..438: note = derived and/or modified sequence opt1 from anti-HIV_cap256-206-146057_VR-Chain
  source 1..438: mol_type = other RNA
cagatgcagctggtggagagcggcgggggcgtcgtgcagcccgggacctccctcaccctgagctgcgtggcctcccagttcacgttcagcaactacggcatgcactggatccgccaggccccggggcagggcctggagtgggtcgcgtccatcagcaacgacggcgggaagcggtaccacggcgacgccgtgtgggcccgcttcatcatctcccgggacaacagcaagaacaccgtgttcctccagatgacctccctgcgcgccgaggacaccgcccggtacttctgcgtccgcgaccggcaggaggacgagtgcctggagtggtggagcgactactacaacttcgggcgccagctcccctgcgcgaagttccggggcctggggctggccggcgtgttcgacatctggggccacgggacgatggtgaccgtctccagc

SEQ ID NO: 9333 - RNA, 435 nt, synthetic construct
  misc_feature 1..435: note = derived and/or modified sequence opt1 from anti-HIV_cap256-206-139519_VR-Chain
  source 1..435: mol_type = other RNA
caggagcagctggtggagagcggcgggggcgtcgtgcccccggggacctccctccggctgagctgcgtggcctcccggttcagcttcggctccttcgggatgcactgggtccgccaggcccccggcaagggcctggagtgggtggcggggatcagcttcgtgggcatcaagaagtactacggggactccgtcaagggccggttcttcatcagccgcgacaactccaagaacaccctcttcctggagatgaacgggctgcggggcgaggacacggcccgctactactgcgtgaaggacatgcgggagctcgagtgcgaggagtgggccagcgactactacgacttcggcaagcccaaccagccctgcctggaccgccgcggggtgtccggcatcagcgccatgtgggggccgggcaccatgctgaccgtctccagc

SEQ ID NO: 9334 - RNA, 432 nt, synthetic construct
  misc_feature 1..432: note = derived and/or modified sequence opt1 from anti-HIV_cap256-206-136316_VR-Chain
  source 1..432: mol_type = other RNA
caggagcagctggtggagagcggcgggggcgtcgtgcccccggggaagtccctcaccctgagctgcgtggcctccggcttcaccttcagcgccttcgggatgcactgggtccggcaggcgcccggcaagggcctggagtgggtggccgggatctccttcgtgggcatcaagaagtactacggggacagcgtcaagggccggttcacgatctcccgcgacaacagcaagaacaccctcttcctgcagatgaacgggctgcggggcgacgacaccgccctctaccactgcgtgaaggacatgcgccagctggagtgcgaggagtggacctccgactactacgacttcggcaagccccagccctgcatcgacccgcgcggggtgagcggcatctccgccatgtgggggcagggcacgatggtcaccgtgagctcc

SEQ ID NO: 9335 - RNA, 438 nt, synthetic construct
  misc_feature 1..438: note = derived and/or modified sequence opt1 from anti-HIV_cap256-206-116098_VR-Chain
  source 1..438: mol_type = other RNA
cagatgatgctggtggagagcggcgggggcgtcgtggagcccgggcgctccctcaccctgagctgcgccgcctcccagttcaccttcagcaactacggcatgcactgggtgcggcaggcgccggggcgcgagctggagtgggtcgcctccatcagcaacgccggcaacaagaagtaccacggcgaggccgtgtgggggcggctcatcatctcccgcgacaacagcaagaacacgctgttcctgcacatgtccaacctccggcccgacgacagcgccctgtacttctgcgtgcgcgaccggcaggaggacgagtgcgaggagtggtggtccgactactacgcgttcggccgcgggggcccctgccggaagtaccacgggcagggcctggccggcatcttcgacatctgggggcgcggcaccatggtcaccgtgagctcc

SEQ ID NO: 9336 - RNA, 432 nt, synthetic construct
  misc_feature 1..432: note = derived and/or modified sequence opt1 from anti-HIV_cap256-206-115862_VR-Chain
  source 1..432: mol_type = other RNA
caggagcagctggtggagagcggcgggggcgtcgtgcccccggggaagtccctccgcctgagctgcgtgggctcccggttcaccttcagcgccttcgggatgcactgggtccgccaggcccccggcaagggcctggagtgggtggcgtccatcagcttcgccgggaccaagaagtactacgtggactccgtcaagggccggttcttcatcagccgcgacaactccaagaacacggtgttcctcgagatgaacgggctgcggggcgaggacaccgggctgtactactgcgtgaaggacatgcgcgagctcgagtgcgaggagtgggccagcgactactacgacttcggcaagccccagccctgcctggaccggcgcggcgtctccgggatcagcgccatgtggggccaggggaccctggtgatcatctccagc

SEQ ID NO: 9337 - RNA, 435 nt, synthetic construct
  misc_feature 1..435: note = derived and/or modified sequence opt1 from anti-HIV_cap256-206-107018_VR-Chain
  source 1..435: mol_type = other RNA
caggagcagctggtggagagcggcgggggcgtcgtgcccccggggaagtccctcaccctgagctgcgtggcctcccgcttcagcttctccgccttcggcatgcactgggtccggcaggcgcccgggaagggcctggagtgggtggccagcatctccttcgtgggcatcaagaagtactacggggacagcgtcaagggccgcttcttcatctcccgggacaacagcaagaacaccgtgttcctcgagatgaacgggctgcgcggcgaggacacggggctgtactactgcgtgaaggacatgcgggagctcgagtgcgaggagtgggcctccgactactacgacttcggcaagcccaaccagccctgcctggaccgccggggcgtcagcgggatctccgccatgtggggccaggggaccctggtgatcgtgagctcc

SEQ ID NO: 9338 - RNA, 438 nt, synthetic construct
  misc_feature 1..438: note = derived and/or modified sequence opt1 from anti-HIV_cap256-206-098644_VR-Chain
  source 1..438: mol_type = other RNA
cagatgctgctcgtggagagcggcgggggcgtcgtggagcccgggcgctccctgaccctgagctgcgccgcctcccagttcaccttcagcaactacggcatgcactgggtgcggcaggcgcccgggggcggcctcgagtgggtcgcctccatcagcaacgaggggaacaagcgctaccacggcgagtccgtgtgggggcggttcgtgatcagccgcgacaactccaagaacacgctgttcctgcacatgagcaccctccggccggacgactccgccctgtacttctgcgtccgcgaccggcaggaggacgagtgcgaggagtggtggagcgactactacgccttcggccgcgggggcccctgccggaagtaccacggccaggggctggccggcatcttcgacgtgtgggggcgcggcaccatggtgaccggcctcttc

SEQ ID NO: 9339 - RNA, 417 nt, synthetic construct
  misc_feature 1..417: note = derived and/or modified sequence opt1 from anti-HIV_cap256-206-098135_VR-Chain
  source 1..417: mol_type = other RNA
caggagaagctggtggagagcggcgggggcgccgtccagcccgggggctccctccggctgagctgcgtggcctccgggttcaccttcagcggcttcggcatgcactgggtgcggcaggcgccggggaagggcctggagtgggtcgccaccatctccttcagcgggatgaagaagtactacggcacgtccgccaaggggcgcttcagcatctaccgggacaactccaagaacaccctctacctgcagatggacggcctgcgcgagaaggacaccgccctctactactgcgccaaggacctgcggtacctggagtgcggcgagtggagcacctactacccccagccctgcctcgaccgccgcggggtgtccggcatcagcaacgtgtgggggcccggcacgatggtcaccgtgtccagc

SEQ ID NO: 9340 - RNA, 435 nt, synthetic construct
  misc_feature 1..435: note = derived and/or modified sequence opt1 from anti-HIV_cap256-206-096276_VR-Chain
  source 1..435: mol_type = other RNA
caggagcagctggtggagagcggcgggggcgtcgtgcccccggggtccagcctccgcctgtcctgcgtggccagccggttcaccttctccgccttcggcatgcactgggtccgccaggcgcccgggaagggcctggagtgggtggccggcatcagcttcgtggggatcaagaagtactacgccgactccgtcaagggccggttcaccatcagccgcgacaactccaagaacaccctcttcctgcagatgaacgggctgcggggcgaggacacggggctctactactgcgtgaaggacatgcgcgagctggagtgcgaggagtggcggagcgactactacgacttcggcaagcccaaccagccctacctggaccgccggggcgtgtccgggatcagcgccttctggggccaggggaccatggtcaccgtgtccagc

SEQ ID NO: 9341 - RNA, 438 nt, synthetic construct
  misc_feature 1..438: note = derived and/or modified sequence opt1 from anti-HIV_cap256-206-092794_VR-Chain
  source 1..438: mol_type = other RNA
cagatgatgctggtggagagcggcgggggcgtcgtggagcccgggcgctccctcaccctgagctgcgccacctcccagttcacgttcagcaactacggcatgcactgggtgcggcaggccccggggcgcggcctggagtgggtcgcgtccatcagcaacgagggcaacaagcggtaccacggggagtccgtgtggggccgcttcatcatcagccgggacaactccaagaacaccctcttcctgcacatgagcaccctgcgcgccgacgactccgccctctacttctgcgtgcgggaccgccaggaggacgagtgcgaggagtggtggagcgactactacgccttcgggcggggcgggccctgccgcaagtaccacggccagggcctggccgggatcttcgacatcgtcggccgggggaccctggtgacggtgtccagc

SEQ ID NO: 9342 - RNA, 432 nt, synthetic construct
  misc_feature 1..432: note = derived and/or modified sequence opt1 from anti-HIV_cap256-206-086817_VR-Chain
  source 1..432: mol_type = other RNA
caggagcagctggtggagagcggcgggggcgtcgtgcccccggggaagtccctccgcctgagctgcgccgcctccggcttcagcttcggggcgttcggcatgcactgggtgcggcaggcccccggcaaggggctggagtgggtcgccggcatctccttcgtggggatcaagtactactacgccgacagcgtgaagggccgcttcaccatctcccgggacaacagcaagaacaccgtcttcctccagatgaacgggctgcgcggcgacgacacgggccggtactactgcgtgaaggacatgcgcgagctggagtgcgaggagtggacctccgactactacgacttcgggaagccccagccctgcatcgaccggcgcggcgtgagcgggatctccgccatgtggggccagggcaccatggtcaccatcagctcc

SEQ ID NO: 9343 - RNA, 432 nt, synthetic construct
  misc_feature 1..432: note = derived and/or modified sequence opt1 from anti-HIV_cap256-206-086446_VR-Chain
  source 1..432: mol_type = other RNA
caggagcagctggtggagagcggcgggggcgtcgtgcccccggggaagtccctccgcctgagctgcgtggcctcccggttcaccttcagcgccttcggcatgcactgggtccgccaggcgcccgggaagggcctggagtgggtggccggcatctccttcgtggggatcaagaagtactacagcgacgccgtcaagggccggttctacatctcccgcgacaacagcaagaacaccctcttcctggagatgaacgggctgcggggcgacgacacggcccgctactactgcgtgaaggacctccgggagctggagtgcgaggagtgggcctccgactactacgacttcgggaagccccagccctgcctggacagccgcggcgtgtccggcatcagcgcgatgtgggggcagggcaccatggtcaccgtgtccagc

SEQ ID NO: 9344 - RNA, 432 nt, synthetic construct
  misc_feature 1..432: note = derived and/or modified sequence opt1 from anti-HIV_cap256-206-086180_VR-Chain
  source 1..432: mol_type = other RNA
caggagcagctggaggagagcggcgggggcgtggtgcccccggggaagtccctccgcctgagctgcgtcgcctcccggttcaccttcagcgccttcggcatgcactgggtgcgccaggcgcccgggaagggcctggagtgggtcgccggcatctccttcgtggggatcaagaagtactacgccgacagcgtgaagggccggttcaccatctcccgcgacaacagcaagaacaccctcttcctgcagatgaacgggctgcggggcgacgacacggggctctacttctgcgtcaaggacatgcgcgagctggagtgcgagcagtggacctccgactactacgacttcggcaagccccagccctgcatcgacccgcggggcgtgagcgggatctccgccatgtggggccaggggaccatggtgacggtcagctcc

SEQ ID NO: 9345 - RNA, 435 nt, synthetic construct
  misc_feature 1..435: note = derived and/or modified sequence opt1 from anti-HIV_cap256-206-083708_VR-Chain
  source 1..435: mol_type = other RNA
caggagcagctggtggagagcggcgggggcgtcatcccgcccgggcagtccctccgcctgagctgcgtggcctcccggttcaccttcagcgccttcggcatgcactgggtgcgccaggcgcccgggaagggcctggagtgggtctccagcgtgtccttcgccggcatcaagaagtactacgccgacagcgtgaaggggcggttcttcatctcccgcgacaacagcaagaacaccgtcttcctcgagatgaacggcctgcgcggggaggacacgggcctgtactactgcgtgaaggacatgcgggagctcgagtgcgaggagtgggcctccgactactacgacttcgggaagcccgaccagccctgcctggaccggcgcggcgtgagcggcatctccgccatgtgggggcagggcaccctggtcatcgtgagctcc

SEQ ID NO: 9346 - RNA, 432 nt, synthetic construct
  misc_feature 1..432: note = derived and/or modified sequence opt1 from anti-HIV_cap256-206-079556_VR-Chain
  source 1..432: mol_type = other RNA
caggagcagctggtggagagcggcgggggcgtcgtgcccccggggaagtccctccggctgagctgcgtggcctccggcttcaccttcagcgggttcggcatgcactgggtccggcaggcccccggcaaggggctggagtgggtggcgggcatctccttcgtggggatcaagtactactacgccgacagcgtcaagggccgcttctccatcagccgggacaactccaagaacaccctcttcctgcagatgaacgggctgcgcggcgacgacacggccctctactactgcgtgaaggacatgcgggagctggagtgcgaggagtggaccagcgactactacgacttcggcaagccccagccctgcatcgaccgccgcggggtgtccggcatcagcgccatgtgggggcagggcaccatggtcaccgtgtccagc

SEQ ID NO: 9347 - RNA, 438 nt, synthetic construct
  misc_feature 1..438: note = derived and/or modified sequence opt1 from anti-HIV_cap256-206-078657_VR-Chain
  source 1..438: mol_type = other RNA
cagatgctgctcgtggagagcggcgggggcgtcgtggagcccgggcgctccctgaccctgagctgcgccacctcccagttcacgttcagcaactacggcatgcactgggtgcggcaggccccggggcgcggcctcgagtgggtcgcgtccatcagcaacgagggctccaagaagtaccacggggagcccgtgtggggccggttcatcatcagccgcgacaactccaagaagaccctgttcctgcacatgagcaacctccgggtggacgactccgccctgtacttctgcgtccgcgaccggcaggaggacgagtgcgaggagtggtggagcgactactacgccttcgggcgcggcgggccctgccggaagtaccacggccagggcctggccgggatcttcgacatctggggccgcgggaccatggtgaccgtgtccagc

SEQ ID NO: 9348 - RNA, 438 nt, synthetic construct
  misc_feature 1..438: note = derived and/or modified sequence opt1 from anti-HIV_cap256-206-075802_VR-Chain
  source 1..438: mol_type = other RNA
cagatgctgctcgtggagagcggcggggacgtcgtggagcccggcaagtccctgaccctgagctgcgccacctcccgcttcacgttcagcaactacgggatgcactgggtgcggcaggccccgggcgggggcctcgagtgggtcgcgtccatcagcaacgagggcaacaagaagtaccacggggagtccgtgtggggccgcttcatcatcagccgggacaactccaagaacaccctgttcctgcacatgagcgccctccgcaccgacgactccgccctgtacttctgcgtgcgggaccgccaggaggacgagtgcgaggagtggtggagcgactactacgccttcgggcggggcgggccctgccgcaagtaccacggccagggcctggccgggatcttcgacatctggggccgggggaccatggtcacggtgtccagc

SEQ ID NO: 9349 - RNA, 438 nt, synthetic construct
  misc_feature 1..438: note = derived and/or modified sequence opt1 from anti-HIV_cap256-206-069097_VR-Chain
  source 1..438: mol_type = other RNA
cagatgctgctcgtggagagcggcgggggcgtcgtggagcccgggcgctccctgaccctgagctgcgccacctcccggttcacgttcagcaactacggcatgcactgggtgcgccaggccccggggcgggagctcgagtgggtcgcgtccatcagcaacgagggcaacaagaagtaccacgccgagtccgtgtggggccgcttcatcatcagccgggacaactccaagaacaccctgttcctgcacatgagcaacgtgcgcggggacgactccgccctctacttctgcgtccgggaccgccaggaggacgagtgcgaggagtggtggagcgactactacgccttcggccgcgggggcccctgccggaagtaccacgggcagggcctggccggcatcttcgacgtgtgggggcggggcaccgtggtcaccgtgtccagc

SEQ ID NO: 9350 - RNA, 438 nt, synthetic construct
  misc_feature 1..438: note = derived and/or modified sequence opt1 from anti-HIV_cap256-206-067758_VR-Chain
  source 1..438: mol_type = other RNA
cagatgctgctcgtggagagcggcgggggcgtcgtggagcccgggcgctccctgaccctgagctgcgccgcctcccagttcaccttcagccactacggcatgcactgggtgcggcaggcgccggggcgcggcctcgagtgggtcgcctccatcagcaacgagggcaacaagcggtaccacggggagtccgtgtggggccgcttcatcatcagccgggacaactccaagaacacgctgttcctgcacatgagcgccctccgcaccgacgactccgccctgtacttctgcgtgcgggaccgccaggaggacgagtgcgaggagtggtggagcgactactacgccttcgggcggggcgggccctgccgcaagtggcacggccagggcctggcggggatcttcgacatctggggccgggggaccgtcgtgaccgtgtccagc

SEQ ID NO: 9351 - RNA, 417 nt, synthetic construct
  misc_feature 1..417: note = derived and/or modified sequence opt1 from anti-HIV_cap256-206-057019_VR-Chain
  source 1..417: mol_type = other RNA
caggagaagctggtggagagcggcgggggcgccgtccagcccgggggctccctccgcctgagctgcgtggcctccgggttcagcttctccggctacggcatgcactgggtgcggcaggcgccggggaagggcctggagtggctcgccaccatcagcttctccggggtcaagaagtactacggcaccagcgccaaggggcgcttctacatctaccgggacaacacgaagaacaccatgtacctggagatgaacggcctgcgcggcgaggacaccgccctctactactgcgccaaggacctgcggtacctggagtgcggggagtggtccacctactacccccagccctgcctcgacacgcgcggcgtgagcgggatctccaacgtgtggggccccggcaccatggtcaccgtgagctcc

SEQ ID NO: 9352 - RNA, 438 nt, synthetic construct
  misc_feature 1..438: note = derived and/or modified sequence opt1 from anti-HIV_cap256-206-055385_VR-Chain
  source 1..438: mol_type = other RNA
cagatgatgctggtggagagcggcgggggcgtcgtggagcccgggcgctccctcaccctgagctgcgccgcctccaagttcaccttcagcaactacggcatgcactgggtgcggcaggcgccggggcgcggcctggagtgggtcgcctccatcagcaacgagggcaacaagaagtaccacggggagcccgtgtggggccggctcatcatctcccgcgacaacagcaagaacacgctgttcctgcacatgtccgacctccgggccgacgacagcgccctgtacttctgcgtgcgcgaccggcaggaggacgagtgcgaggagtggtggtccaactactacgccttcgggcgcggcgggccctgccggaagtggcgcggccagggcctggcggggatcttcgacgtctggggccgggggaccatggtgaccgtgagctcc

SEQ ID NO: 9353 - RNA, 435 nt, synthetic construct
  misc_feature 1..435: note = derived and/or modified sequence opt1 from anti-HIV_cap256-206-053187_VR-Chain
  source 1..435: mol_type = other RNA
caggagcagctggtggagagcggcgggggcgtcgtgcccccggggtccagcctccgcctgtcctgcgtggccagccggttcaccttctccgccttcggcatgcactgggtccgccaggcgcccgggaagggcctggagtgggtggccggcatcagcttcgtggggatcaagtactactacgccgactccgtcaagggccggttcaccatcagccgcgacaactccaagaacaccctcttcctgcagatgaacgggctgcggggcgaggacacggggctctactactgcgtgaaggacatgcgcgagctggagtgcgaggagtgggccagcgactactacgacttcggcaagcccaaccagccctgcctggaccggcgcggcgtgtccgggatcagcgccttctggggccaggggaccatggtcaccgtgtccagc

SEQ ID NO: 9354 - RNA, 438 nt, synthetic construct
  misc_feature 1..438: note = derived and/or modified sequence opt1 from anti-HIV_cap256-206-053139_VR-Chain
  source 1..438: mol_type = other RNA
cagatgctgctcgtggagagcggcggggacgtcgtggagcccggccgctccctgaccctgagctgcgccacctcccagttcacgttcagcaactacgggatgcactgggtgcggcaggccccgggccgcgggctcgagtgggtcgcgtccatcagcaacgagggctccaagaagtaccacggcgagagcgtgtgggggcggttcatcatctcccgcgacaacagcaagaacaccctgttcctgcacatgaccaccctccggcccgacgactccgccctgtacttctgcgtgcgcgaccggcaggaggacgagtgcgaggagtggtggagcgactactacgccttcggccgcgggggcccctgccggaagtaccacgggcagggcctggccggcatcttcgacatctgggggcgcggcacgatggtcaccgtgtccagc

SEQ ID NO: 9355 - RNA, 432 nt, synthetic construct
  misc_feature 1..432: note = derived and/or modified sequence opt1 from anti-HIV_cap256-206-050350_VR-Chain
  source 1..432: mol_type = other RNA
caggagcagctggtggagagcggcgggggcgtcgtgcccccggggaagtccctcaagctgagctgcgtggcctcccgcttcagcttcggcgccttcgggatgcactgggtccggcaggcgcccggcaagggcctggagtgggtggccgggatctccttcgtgggcatcaagaagtactacgccgacagcgtcaaggggcgcttctacatctcccgggacaacagcaagaacaccgtgttcctcgagatgaacgccctgcgcggcgaggacaccgccctgtaccactgcgtgaaggacatgcgggagctcgagtgcgaggagtgggcgtccgactactacgacttcgggaagccccagccctgcctggaccgccggggcgtcagcggcatctccgccatgtgggggccgggcacgatggtgatcgtgagctcc

SEQ ID NO: 9356 - RNA, 432 nt, synthetic construct
  misc_feature 1..432: note = derived and/or modified sequence opt1 from anti-HIV_cap256-206-046207_VR-Chain
  source 1..432: mol_type = other RNA
caggagcagctggtggagagcggcgggggcgtcgtgcccccggggacctccctccgcctgagctgcgtggcctcccggttcaccttcagcgccttcggcatgcactgggtccgccaggcgcccgggaagggcctggagtgggtggccggcatctccttcgccgggatcaagaagtactacgccgacagcgtgaagggccggttcacgatctcccgcgacaacagcaagaactccctcttcctggagatgaacgggctgcggggcgacgacaccgccctctactactgcgtcaaggacctgcgctacctggagtgcgagctctggaccagcgactactacgacttcgggcggccccagccctgcatcgactcccgcggcgtgagcggcatctccgcgatgtgggggccgggcaccatggtgacggtcagcgcc

SEQ ID NO: 9357 - RNA, 417 nt, synthetic construct
  misc_feature 1..417: note = derived and/or modified sequence opt1 from anti-HIV_cap256-206-043389_VR-Chain
  source 1..417: mol_type = other RNA
caggagaagctggtggagagcggcgggggcgccgtccagcccgggggctccctccgcctgagctgcgtggcctccgggttcaccttcagcggcttcggcatgcactggttccggcaggcgccggggaagggcctggagtgggtggccaccatctccttcagcgggatcaagaagtactacaacacgtccgccaagggccgcttcttcatcagccgggacaacaccaaggacaccctctacctgcagatggacgggctgcaggagaaggacaccgccctctacctgtgcgccaaggacctgcgctacctcgagtgcggctactggtccacgtactacccccagccctgcctggacacccggggcgtcagcgggatctccaacgtgtggggccccgggaccatggtgaccgtcagctcc

SEQ ID NO: 9358 - RNA, 432 nt, synthetic construct
  misc_feature 1..432: note = derived and/or modified sequence opt1 from anti-HIV_cap256-206-042555_VR-Chain
  source 1..432: mol_type = other RNA
caggagcagctggtggagagcggcgggggcgtcgtgcccccggggaagtccctccgcctgagctgcgtggtctccggcttcaccttcagcgccttcgggatgcactgggtgcggcaggcccccggcaagggcctggagtgggtggcggggatctccttcgccggcaccaagagctactacgccgagtccgtcaaggggcgcttcacgatcagccgggacaactccaagaacagcctcttcctgcagatgaacggcctgcgcggggacgacaccgccctctactactgcgtgaaggacatgcgggagctggagtgcgagctgtggacctccgactactacgacttcggccgcccccagccctgcatcgaccggcgcggcgtgagcgggatctccgccatgtggggccaggggaccatggtcacgatcagctcc

SEQ ID NO: 9359 - RNA, 432 nt, synthetic construct
  misc_feature 1..432: note = derived and/or modified sequence opt1 from anti-HIV_cap256-206-029720_VR-Chain
  source 1..432: mol_type = other RNA
caggagaagctggtggagagcggcgggggcgtcgtgcagcccgggcgctccctcaccctgagctgcgtggcctcccacttcaccttcagcggcgtcgggatgcactgggtgcggcaggccccgggcaagggcctggagtgggtggcggggatctccttcgccggcacgcgcaagtactacgccgacagcgtcaaggggcggttcaccatctcccgcgacaacagcaagaacaccgtgtacctccagatgaacggcctgcgcggggaggacaccgccctgtaccactgcgccaaggacctccgggagctggagtgcgagctgtggacgtccgactactacgacttcggccggccccagccctgcatcgaccgccggggcgtgagcgggatctgcgacatgtggggccaggggaccatggtcatcgtgtccagc

SEQ ID NO: 9360 - RNA, 432 nt, synthetic construct
  misc_feature 1..432: note = derived and/or modified sequence opt1 from anti-HIV_cap256-206-028848_VR-Chain
  source 1..432: mol_type = other RNA
caggagcagctggtggagagcggcgggggcgtcgtgcccccggggaagtccctccggctgagctgcgtggcctccggcttcaccttcagcgggttcggcatgcactgggtccggcaggcccccggcaaggggctgcagtgggtggcgggcatctccttcgccgggaccaagtactactacgaggacagcgtgaagggccgcttcacgatctcccgggacaacagcaagaacaccgtcttcctccagatgaacgggctgcgcggcgacgacaccgccctgtactactgcgtgaaggacatgcgggagctcgagtgcgaggagtggacctccgactactacgacttcggcaagccccagccctgcatcgaccgccgcggggtgagcggcatctccgccatgtgggggcagggcacgatggtcaccatcagctcc

SEQ ID NO: 9361 - RNA, 432 nt, synthetic construct
  misc_feature 1..432: note = derived and/or modified sequence opt1 from anti-HIV_cap256-206-027652_VR-Chain
  source 1..432: mol_type = other RNA
caggagcagctggtggtcagcggcggggacgtggtgcccccgggcaagtccctccggctgagctgcgtcgcctccgggttcaccttcagcgccttcggcatgcactgggtgcggcaggcgcccgggaagggcctggagtgggtggcctccatcagcttcgccggcaccaagtactactacgccgactccgtcaaggggcgcttcgccatcagccgggacaactccaagaacaccctcttcctgcagatgaacggcctgcgccgggaggacacggggctctactactgcgtgaaggacatgcgccagctggagtgcgaggagtggaccagcgactactacgacttcggccggccccagccctgcatcgaccgccgcggggtgtccggcatcagcgcgatgtggggccaggggaccatggtcacgatctccagc

SEQ ID NO: 9362 - RNA, 417 nt, synthetic construct
  misc_feature 1..417: note = derived and/or modified sequence opt1 from anti-HIV_cap256-206-024075_VR-Chain
  source 1..417: mol_type = other RNA
caggagaagctggtggagagcggcgggggcgccgtccagcccgggggctccctccgcctgagctgcgtggcctccgggttcaccttcagcggcttcggcatgcactgggtgcggcaggcgccggggaagggcctggagtggctcgccaccatctccttcagcggggtcaagaagtactacggcacgtccgccaaggggcgcttctacatcagccgggacaacaccaagaacaccgtgtacctgcagatggacggcctgcgcggcgacgacaccgccatctactactgcgccaaggacctccggttcctggagtgcgggctgtggtccacgtactacccccagccctgcctcgacacccgcggcgtgagcgggatctccaacgtctggggccccggcaccatggtgaccgtgagctcc

SEQ ID NO: 9363 - RNA, 417 nt, synthetic construct
  misc_feature 1..417: note = derived and/or modified sequence opt1 from anti-HIV_cap256-206-008748_VR-Chain
  source 1..417: mol_type = other RNA
caggagaagctggtggagagcggcgggggcgccgtccagcccgggggctccctccgcctgagctgcgtggcctccgggttcaccttcaacggcttcggcatgcactgggtgcggcaggcgccggggaagggcctggagtgggtcgccaccatcagcttctccggggtgaagaagtactacggcacgagcgccaaggggcgcttcttcatctcccgggagaacagcaagaacaccctctacctgcagatgaacggcctgcgcggcgaggacaccgccctctactactgcgccaaggacctgcggtacctggagtgcggggagtggtccacctactacccccagccctgcctcgacacgcgcggcgtgagcgggatctccaacgtctggggccccggcacccgggtgaccgtgagctcc

SEQ ID NO: 9364 - RNA, 432 nt, synthetic construct
  misc_feature 1..432: note = derived and/or modified sequence opt1 from anti-HIV_cap256-206-008530_VR-Chain
  source 1..432: mol_type = other RNA
caggagcagctggtggagagcggcgggggcgtcgtgcccccggggaagtccctccggctgagctgcgtggcctccggcttcagcttcggggccttcggcatgcactgggtccggcaggcgcccggcaaggggctggagtgggtggccggcatctccttcgtggggatcaagtactactacgccgacagcgtcaagggccgcttcaccatctcccgggacaacagcaagaagaccctcttcctgcagatgaacgggctgcgcggcgacgacacggccctctactactgcgtgaaggacatgcgggagctggagtgcgaggagtggacctccgactactacgacttcggcaagccccagccctgcatcgaccgccgcggggtgagcggcatctccgccttctgggggcagggcaccatggtcaccatcagctcc

SEQ ID NO: 9365 - RNA, 432 nt, synthetic construct
  misc_feature 1..432: note = derived and/or modified sequence opt1 from anti-HIV_cap256-176-723043_VR-Chain
  source 1..432: mol_type = other RNA
caggagcagctggtggagagcggcgggggcgtcgtgcccccggggaagtccctccgcctgagctgcgtggcctccggcttcaccttcagcgccttcgggatgcactgggtccggcaggcgcccggcaagggcctggagtgggtggccggggtgtccttcgccggcatcaagtactactacgccgacagcgtcaaggggcgcttcaccatctcccgggacaacagcaagaacaccctcttcctgcagatgaacggcctgcgcggggacgacacggccctctactactgcgtgaaggacctgcgggagctggagtgcgaggagtggacctccgactactacgacttcggccgcccccagccctgcatcgacccgcggggcgtgagcgggatctccgcgatgtggggccaggggaccgtcgtgacgatcagctcc

SEQ ID NO: 9366 - RNA, 432 nt, synthetic construct
  misc_feature 1..432: note = derived and/or modified sequence opt1 from anti-HIV_cap256-176-600049_VR-Chain
  source 1..432: mol_type = other RNA
gaggtgcagctggtccagagcggcgggggcgtggtgcagcccgggcgctccctccggctgagctgcgccgccccgtacttcgagttcggccgctacgggttccactgggtccggcaggcgcccggcaagggcctggagtgggtggcctccatcagcttcgccgggcgcggctactaccactcccccagcgtgtgggggcggttcaccatctcccgcgacaacagcaagaacaccctctacctgcagatgaactccctgcggatcgaggacacggccctctacttctgcgcccgcgacctgcgggagagcgagtgcgaggagtgggagtccgactactacgacttcggcaagaaggggccctgcgtcaagccgcgcggcgtggcgggcgggctggacctctggggccaggggaccatggtgatcgtcagctcc

SEQ ID NO: 9367 - RNA, 432 nt, synthetic construct
  misc_feature 1..432: note = derived and/or modified sequence opt1 from anti-HIV_cap256-176-531926_VR-Chain
  source 1..432: mol_type = other RNA
caggtgcagctggtcgagagcggcgggggcgtggtgcccccggggaagtccctcaccctgagctgcgtcgcctcccgcttcaccttcagcgccttcggcatgcactgggtgcggcaggcgcccgggaagggcctggagtgggtggccggcatctccttcgtcgggatccgcaagtactacgccgacagcgtgaagggccggttctccatcagccgcgacaactccaagaacacggtgttcctcgagatgaacgggctgcggggcgaggacaccgggctgtactactgcgtcaaggacatgcgcgagctcgagtgcgaggagtgggccagcgactactacgacttcggcaagccccagccctgcctggaccggcgcggcgtgtccgggatcagcgccatgtggggccaggggaccctggtgatcatctccagc

SEQ ID NO: 9368 - RNA, 432 nt, synthetic construct
  misc_feature 1..432: note = derived and/or modified sequence opt1 from anti-HIV_cap256-176-504134_VR-Chain
  source 1..432: mol_type = other RNA
gaggtgcagctggtcgagagcggcgggggcgtggtgcccccggggaagtccctccgcctgagctgcgtcacctcccggctggccttcggcgccttcgggatgcactgggtgcgccaggcgcccggcaagggcctcgagtgggtggccagcatctccttcgccgggatcaagaagtactacgccgacagcgtcaagggccggttcaccatctcccgcgacaacagcaaggacacggtgttcctggagatgaacgggctgcggggcgacgacaccgggctctactactgcgtgaaggacatgcgctacctggagtgcgaggagtgggcctccgactactacgacttcggccggccccagccctgcctggacccgcgcggcgtcagcgggatctccgcgatgtggggccaggggaccctcgtgatcatcagctcc

SEQ ID NO: 9369 - RNA, 432 nt, synthetic construct
  misc_feature 1..432: note = derived and/or modified sequence opt1 from anti-HIV_cap256-119-186229_VR-Chain
  source 1..432: mol_type = other RNA
cagatgcagctggtggagagcggcgggggcgtcgtgcagcccgggggctccctccgcctgctgtgcagcgcctccgggttcaccttcagcacctacggcatgcactgggtgcggcaggccccgggcaaggggctcgagtgggtcgcgtccatcagctacgacggctccgacaagtaccacgccgggctggtgtggggccgcttcatcatcagccgggacaactccaagaacacgctgtacctccagatgaacagcctgcgcgccgaggacaccgccctgtactactgcgtgcgggacgagcgcgagtccgagtgcgagctctgggagagcgactactacaacttcgggaagaagctgccctgcgtcaagccccggggcgtggccggcaccctggacatctgggggcagggcaccacggtgatcgtctccagc

SEQ ID NO: 9370 - RNA, 432 nt, synthetic construct
  misc_feature 1..432: note = derived and/or modified sequence opt1 from anti-HIV_cap256-119-183891_VR-Chain
  source 1..432: mol_type = other RNA
caggtgcagctggtcgagagcggcgggggcgtggtgcagcccgggggctccctccgcctgagctgcgccgcctccgggttcaccttcagctcctacggcatgcactgggtccggcaggcgccgggcaaggggctggagtgggtggccttcacccgctacgacggcagcgacaagtactacctcgactccgtgaaggggcggttcacgatcagccgcgacaactccaagtacaccctgttcctgcagatggtcagcctccggaccgaggacaccgccctgtacttctgcgcccgcgacctgcgggagtccgagtgcgaggagtgggagagctactactacgacttcggcaagaaggggccctgcgtgaagccccgcggcgtggtcggcgtgctcgacatctgggggcagggcacgctggtgaccgtctccagc

SEQ ID NO: 9371 - RNA, 435 nt, synthetic construct
  misc_feature 1..435: note = derived and/or modified sequence opt1 from anti-HIV_cap256-119-183631_VR-Chain
  source 1..435: mol_type = other RNA
caggtgcagctggtccagagcggcgggggcgtggtgcagcccgggcgctccctccggctgagctgcgccgcctccaagttcaccttcagcacctacacgctgcactgggtccgccaggcgccgggcaaggggctcgagtgggtggccgtgatctcccacgacggcggcaaccggttctacgccgacagcgtcaaggggcgcttcaccatctcccgggacaacagcaagaacaacctgttcctgcagatgaactccctccgcgtggaggacaccgccctgtactactgcgcccgggacctgcgcgagatggagtgcgaggagtggaccctctacaactactacgacttcggcagccgggggccctgcgtggacccccgcggcgtcgtggggtccttcgacgtgtggggccagggcacgatggtcaccgtgagctcc

SEQ ID NO: 9372 - RNA, 432 nt, synthetic construct
  misc_feature 1..432: note = derived and/or modified sequence opt1 from anti-HIV_cap256-119-182676_VR-Chain
  source 1..432: mol_type = other RNA
caggtgcagctggtcgagagcggcgggggcgtggtgcagcccgggaagtccctccgcctgagctgcgtcgtgtccggcttcaccttcagcaactacccgatgcactgggtgcggcaggcccccgggaagggcctggagtgggtcgcctccatcagcttcgcgggcatcaagaagtactacggggactccgtgaagggccgcttcaccatcagccgggacaactccaagaacacgctctacctgcagatggacgggctgcgcggcgaggacaccgccctctactactgcgccaaggacctgcgggagctggagtgcgaggagtgggccagcgactactacgacttcgggcgcccccagccctgcctcgacccgcggggcgtgtccggcatcagcaacgtctgggggcagggcaccatggtgaccgtgtccagc

SEQ ID NO: 9373 - RNA, 432 nt, synthetic construct
  misc_feature 1..432: note = derived and/or modified sequence opt1 from anti-HIV_cap256-119-180772_VR-Chain
  source 1..432: mol_type = other RNA
caggtgcagctggtcgagagcggcgggggcgtggtgcagcccgggcgctccctccggctgagctgcgccgcctccgagttcaccttcagcaactacgcgatgcactgggtccgccaggccccgggcaaggggctggagtgggtggcctccatcagcttcgacggccgggacaagtaccactccagcctcgtgtggggccgcctgaccatctcccgggacaacagcaagtccacgctgttcctccagatgaacagcctgcgccccgaggacaccgccctgtactactgcgcccgggacgtccgcgagtccgagtgcgaggagtggcagagcgactactacgcgttctaccggaagctcccctgcgtgaagccccgcggggtggccggcaccctggacatctgggggcagggcaccatggtcacggtgtccagc

SEQ ID NO: 9374 - RNA, 435 nt, synthetic construct
  misc_feature 1..435: note = derived and/or modified sequence opt1 from anti-HIV_cap256-119-180508_VR-Chain
  source 1..435: mol_type = other RNA
caggtgcacctggtcgagagcggcgggggcgtggtgcagcccgggcgctccctccggctgagctgcgccgcctcccacttcagcctgtccagctacggcatgcactgggtccgccagaccccggggaagggcctcgagtgggtggcgggcatctccttcgccggggtgaagacctactacggcacgagcgtcaaggggcggttcaccatctcccgcgacaacagcaagaacaacctgtacctgcagatgaactccctccggcccgaggacaccgccctgtactactgcgcccgcgacctgcgggagatggagtgcgaggagtggaagctctacaactactacgacttccgcacccggggcccctgcgtggacccccgcggggtggtcggcagcttcgacgtgtggggccaggggacggtggtcaccgtgtccagc

SEQ ID NO: 9375 - RNA, 432 nt, synthetic construct
  misc_feature 1..432: note = derived and/or modified sequence opt1 from anti-HIV_cap256-119-180260_VR-Chain
  source 1..432: mol_type = other RNA
gaggtgcagctggtcgagagcggcgggggcgtggtgcgccccgggggctccctccggctgagctgcgccgcctcccagttcaccttcagcaacttcgggatgcactgggtccgccaggcgccgggcaagggcctggagtgggtggcctccatcagcttcgtggggatcaagacccactacgccaactccgtccggggccgcttcacgatcagccgggaccagtccaagaacaccctctacctgcagatgaacagcgtgcgcgtggaggacaccgggcggtactactgcgcccgcgacatgcgggagtacgagtgcgagctgtgggcctccgactactacgacttcggcaagccccagccctgcgaggacccccgcggggtcgtgggcaccttcgacatgtggggcctcgggacgctggtgaccgtcagctcc

SEQ ID NO: 9376 - RNA, 432 nt, synthetic construct
  misc_feature 1..432: note = derived and/or modified sequence opt1 from anti-HIV_cap256-119-180173_VR-Chain
  source 1..432: mol_type = other RNA
gaggtgcagctggtcgagagcggcgggggcctcgtgcagcccgggggctccctgcgcctgagctgcgccgcctccgggttcaccgtgagctccaactacatgagctgggtccggcaggcgccgggcaagggcctcgagtgggtggcctccatcagcttcgccgggaccaagaagcactacggcaactccgtgaaggggcgcttcacgatcagccgggacaactccaagaacaccctgtacctgcagatgaacagcctccgcggcgaggacaccgccctgtactactgcgccaaggacctgcgggagtacgagtgcgaggagtggacctccgactactacgacttcgggcgcccccagccctgcatcgacagccggggcgtcgtgggcatcctcgacatctggtcccaggggacgatggtgaccgtcagctcc

SEQ ID NO: 9377 - RNA, 432 nt, synthetic construct
  misc_feature 1..432: note = derived and/or modified sequence opt1 from anti-HIV_cap256-119-179839_VR-Chain
  source 1..432: mol_type = other RNA
caggtgcagctggtcgagagcggcgggggcgtggtgcagcccgggcgctccctccggctgagctgcgccgcctccggcttcagcttcgggacctccgacgtccactgggtgcgccaggcgccgggcgagggcctggagtgggtggccctcatcagcttcgacgggcggcagaaggacctggccgactccgtccgcggccggttcaccatcagccgcgactccagcaagaacacgctgtacctcgagatgaactccctgcggcccgaggacaccgccctgtactactgcgccaaggacatgcgcgggtacgagtgcgaggagtggaccagcgactactacgacttcggccggccccagccctgcatcgactcccgcggggtggtgggcaccttcgacgtctggggccaggggacgatggtgaccgtgagctcc

SEQ ID NO: 9378 - RNA, 423 nt, synthetic construct
  misc_feature 1..423: note = derived and/or modified sequence opt1 from anti-HIV_cap256-119-179262_VR-Chain
  source 1..423: mol_type = other RNA
caggtgcagctggtcgagagcggcgggcgcgtggtgcagtccggcgggagcctccggctgtcctgcggcgccagcgggttctccttcaccaccagcgccatgcactgggtccgccaggcgcccggcaagggcctggagtgggtggccatcaacggggccaacaagcactacgccgagtccgtgaagggccggttcacgatcagccgcgacaactccaagaacaccctcttcctggagatgaacagcctgcggccggacgacaccgccctctacttctgcgtcaaggaccagcgcgaggacgagtgcgaggagtggtggtccgactactacgacttcgggcgggagcagccctgcctggacccccgcggcgtggtggggatcttcgacctgtggggccagggcaccatggtcacggtgagctcc

SEQ ID NO: 9379 - RNA, 432 nt, synthetic construct
  misc_feature 1..432: note = derived and/or modified sequence opt1 from anti-HIV_cap256-119-178995_VR-Chain
  source 1..432: mol_type = other RNA
caggtgcagctggtcgagagcggcgggggcgtggtgcagcccgggaagtccctccggctgagctgcgccgcctccggcttcaccctgacccggttcgcgatgcactgggtccgccaggccccggggaagggcctcgagtgggtggccgtgatctggtacgacggcagcaacaagtactacgccgactccgtcaaggggcggttcacggtgagccgcgacaactccaagaacaccctgtacctgcagatgaacagcctccggaccgaggacaccgccctgtactactgcgtgcgcgaccggcgcgagtccgagtgcgagctgtgggagagcgactactacaacttcggccggcgcctcccctgcgtcaagccccgcggggtggcgggcatcctggacatctgggggcagggcacgaccgtgaccgtctccccc

SEQ ID NO: 9380 - RNA, 432 nt, synthetic construct
  misc_feature 1..432: note = derived and/or modified sequence opt1 from anti-HIV_cap256-119-178455_VR-Chain
  source 1..432: mol_type = other RNA
gaggtgcagctggtcgagagcggcgggggcctcgtgcagcccgggggctccctgcgcctgagctgcgtggtctccgggttcaccttcagcaacttctggatgtcctgggtgcggcaggccccgggcaagggcctcgagtgggtggccagcatctcctacgacgggcgcgacaagtaccacagctccctggtctggggccggctgaccatcagccgcgacaactccaagagcaccctcttcctgcagatgaactccctgcgggcggaggacacggccctctactactgcgcccgcgacctgcgggagagcgagtgcgaggagtggcagtccgactactacgccttctacaagaagctgccctgcgtgaagccccgcggggtggccggcaccctcgacatctgggggcagggcaccatggtcacggtgagctcc

SEQ ID NO: 9381 - RNA, 438 nt, synthetic construct
  misc_feature 1..438: note = derived and/or modified sequence opt1 from anti-HIV_cap256-119-177993_VR-Chain
  source 1..438: mol_type = other RNA
caggtgcacctggtcgagagcggcgggggcgtggtgcagcccgggaagtccctccgcatctactgcgccgtcagcgagttcaccttctccaactacgccatgcactgggtgcggctggccccgggccgcgggctgcagtggctcgccgtgatcagctacgacggctccaagaagtactacgccgacagcctggagggccggttcaccatctccaaggacaacagcaagaacacgctgttcctccagatgaactccctgcgcgtcgaggacaccgccctgtacttctgcgtgaaggaccagcgggaggacgagtgcgaggagtggtggagcgactactacgacttcggggagcgcgcgcccctccccaaggtgcccggcccggggcccggctggaacctggacatgtgggggcacggcaccatggtcaccgtgtccagc

SEQ ID NO: 9382 - RNA, 438 nt, synthetic construct
  misc_feature 1..438: note = derived and/or modified sequence opt1 from anti-HIV_cap256-119-177727_VR-Chain
  source 1..438: mol_type = other RNA
caggtgcagctggtcgagagcggcgggggcgtggtgcagcccgggcgctccctccggctgagctgcgccgcctccggcttcaccctgagccgctacgacatgcactgggtccggcaggcgccggggaagggcctcgagtgggtggcctccatcagcaaggacggcaccaagaagtaccacggggactccgtgtggggccgcttcatcatcagccgggacaactccaagaacacgctgttcctgcagatgagctccctccgcgccgaggacaccgccctgtacttctgcgtccgggaccagcgcgaggccgagtgcgaggagtggtggagcgactactacgacttcgggcgggagctgccctgccgcaagttccggggcctcgggctggcgggcatcttcgacatctggggccacgggaccatggtgaccgtgtccagc

SEQ ID NO: 9383 - RNA, 432 nt, synthetic construct
  misc_feature 1..432: note = derived and/or modified sequence opt1 from anti-HIV_cap256-119-176746_VR-Chain
  source 1..432: mol_type = other RNA
gaggtgcagctggtcgagagcggcgggggcctcgtgcagcccgggggctccctgcggctgagctgcgccgcctccgacttcaccttcgacgactacgcgatgcactgggtgcggcaggccccggggaagggcctcgagtgggtcggcgggatcagctacgacggctccgacaagtaccacaccaacagcgtgtgggggcgcttcatcgtgtcccgggacaacagcaagaacacgctgtacctgcagatgaactccctccgccccgaggacaccgccctgtactactgcgtccgggaccgccgggagagcgagtgcgaggagcgctggtccgactactacgacttcggcaagcagctgccctgcgtgaagccccgcggggtggccggcatcttcgacatctggggccaggggaccatggtcaccgtgagctcc

SEQ ID NO: 9384 - RNA, 432 nt, synthetic construct
  misc_feature 1..432: note = derived and/or modified sequence opt1 from anti-HIV_cap256-119-176241_VR-Chain
  source 1..432: mol_type = other RNA
caggtgcagctggtcgagagcggcgggggcgtggtgcagcccgggcgctccctccggctgagctgcgccgcctccggcttcaccttcagcaactacgcgatgcactgggtccgccaggccccggggaagggcctggagtgggtggccgtgatctcctacgacggcagcaacaagtactacgccgactccgtcaaggggcggttcaccatcagccgcgacaactccaagaacacgctctacctgcagatggacggcctgcgcggggaggacaccgccctctactactgcgcgaaggacctgcgggagctggagtgcgaggagtgggccagcgactactacgacttcggccggccccagccctgcctcgacccccgcggggtgtccggcatcagcaacgtgtggggccaggggaccatggtcaccgtgtccagc

SEQ ID NO: 9385 - RNA, 432 nt, synthetic construct
  misc_feature 1..432: note = derived and/or modified sequence opt1 from anti-HIV_cap256-119-175215_VR-Chain
  source 1..432: mol_type = other RNA
caggtgcagctggtcgagagcggcgggggcgtggtgcagcccgggcggtccctccggctgagctgcgccgtctcccagttcaccttcggccgctacgggatgtactgggtgcggcaggccccgggcaagggcctggagtgggtggcggggatcagctacgacggctccgacaagtaccacaccaacagcgtctgggggcgcttcatcgtgtcccgggacaacagcaagaacatgctctacctgcagatgaacaacctgcgccccgaggacacggccctctactactgcgtgcgggaccgccgggagtccgagtgcgaggagcgctggagcgactactacgacttcggcaagcagctgccctgcgtcaagccccgcggggtggccggcatcttcgacatctggggccaggggaccatggtgaccgtctccagc

SEQ ID NO: 9386 - RNA, 432 nt, synthetic construct
  misc_feature 1..432: note = derived and/or modified sequence opt1 from anti-HIV_cap256-119-173928_VR-Chain
  source 1..432: mol_type = other RNA
ggcgtggagctgctcgagagcgggggcgggctggtcgagcccggcgggtccctgcgcctcagctgcgtgggctcccagttcagcttcgaccggtacggcatgcactgggtgcgccaggccccggggaagggcctggagtgggtcgccgcggtgtccttcgacgggaccgacaagtaccacgccgacgacgtgtggggccggttcaccatcagccgcgacaactccaagaacacgctgtacctccagatgaacagcctgcgggccgaggacaccgccctgtactactgcgccaaggacctccgcgaggacgagtgcgaggagtggtggtccgactactacgacctggggaagcagctgccctgccgcaagagccggggcgtcgcgggcgtgctcgacaagtgggggctgggcaccatggtgaccgtctccagc

SEQ ID NO: 9387 - RNA, 432 nt, synthetic construct
  misc_feature 1..432: note = derived and/or modified sequence opt1 from anti-HIV_cap256-119-173495_VR-Chain
  source 1..432: mol_type = other RNA
caggtgcagctggtcgagagcggcgggggcgtggtgcagcccgggaagtccctccgcctgagctgcgccgcctcccggttcaccttcaaccgctacggcatgcactgggtccggcaggcgccggggaagggcctggagtgggtggccgccatcagcttcgacggcaccgacaagtaccactccgacgacgtgtgggggcgcttcacgatcagccgggacaactccaagaacaccctctacctgcagatgaacagcctgcgcgccgaggacaccgccgtctactactgcgcgaaggacctccgggaggacgagtgcgaggagcgctggtccgactactacgacttcggcaagcagctgccctgccggaagtcccgcggggtggccggcatcttcgacaactgggggcagggcaccatggtgacggtcagcagc

SEQ ID NO: 9388 - RNA, 432 nt, synthetic construct
  misc_feature 1..432: note = derived and/or modified sequence opt1 from anti-HIV_cap256-119-172882_VR-Chain
  source 1..432: mol_type = other RNA
caggtgcagctggtcgagagcggcgggggcgtggtgcagcccgggcgctccctcaccctgagctgcgaggtctccggcttcaccttcaagacgtacgggatgcactgggtgcggcaggccccgggcaagggcctggagtgggtggccagcatctcctacgacgggagcgacaagtaccacgcggaccgcgtctggggccggttcaccatctcccgcgacaacagcaagaacaccctctacctgcagatgaactccctgcgggccgaggacaccgccctctactactgcgtgcgcgacgcccgggagagcgagtgcgagctgtgggagtccgactactacaacttcgggcgcaagctgccctgcgtgaagccccggggcgtcgccgggacgctcgacatctggggccagggcaccatggtgaccgtgagctcc

SEQ ID NO: 9389 - RNA, 432 nt, synthetic construct
  misc_feature 1..432: note = derived and/or modified sequence opt1 from anti-HIV_cap256-119-172429_VR-Chain
  source 1..432: mol_type = other RNA
gaggtgcagctggtcgagaccggcgggggcctcatccagcccgggggcagcctgcgcctgtcctgcgtggccagccagttcaccttctccgggtgcggcctccactgggtgcggcaggccccgggcaaggggctggagtgggtcgcgagcatctccttcgccggcacgaagaagcactacgggaacagcgtgaagggccgcttcaccatctcccgggacaacagcaagaacaccctgtacctcgagatgaacaccctgcgcgccgaggacacggccctgtactactgcgccaaggacctccgggagtacgagtgcgaggagtggacctccgactactacgacttcgggcgcccccagccctgcatcgacagccggggcgtggtcggcatcctggacatctgggggcagggcaccatggtgtccgtgagctcc

SEQ ID NO: 9390 - RNA, 432 nt, synthetic construct
  misc_feature 1..432: note = derived and/or modified sequence opt1 from anti-HIV_cap256-119-172223_VR-Chain
  source 1..432: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccgtgatcagctacgacggccgggacttctaccacgcccgctccgtctgggggcggttcaccatcagccgcgacaactccaagaacacgctccacctccagatgaacagcctgcggcccgaggacaccgccctgtacttctgcgcgcgcgacctgcgggagtccgagtgcgaggagtgggagagctactactacgacttcggcaagaaggacccctgcgtgaagccccgcggggtggtcggcgtgctggacatctgggggcagggcaccctcgtgaccgtctccagc

SEQ ID NO: 9391 - RNA, 432 nt, synthetic construct
  misc_feature 1..432: note = derived and/or modified sequence opt1 from anti-HIV_cap256-119-171838_VR-Chain
  source 1..432: mol_type = other RNA
caggtgcagctgggcgagagcgggggcggggtcgtgcagcccggccgctccctccggctgagctgcgccgcctccgggttcaccttcagcaccttcgcgatgcactgggtgcgccaggccccgggcaagggcctggagtgggtcgccgtgatctcctacgacgggagcaacaagtactacgccgactccgtgaagggccggttcgccatcagccgcgacaacgcgaagaacctcctgcacctccagatgaactccctgcggcccgaggacacggccctgtactactgcgccaaggacctgcaggaggacgagtgcgaggagtggtggagcgactactacgacttcgggaagcagctcccctgccgcaagtcccggggcgtcgccgggatcttcgacgactggggccagggcaccatggtgaccgtgagctcc

SEQ ID NO: 9392 - RNA, 432 nt, synthetic construct
  misc_feature 1..432: note = derived and/or modified sequence opt1 from anti-HIV_cap256-119-171587_VR-Chain
  source 1..432: mol_type = other RNA
gaggtgcagctggtcgagagcggcgggggcctcgtgcagcccgggggctccctgcggctgagctgcgccgcctccgggttcaccttcagcgactactacatgtcctggatccggcaggcgccgggcaagggcctcgagtgggtggccagcatctccttcgccgggaccaagcagcactacggcaacagcgtcaaggggcgcttcacgatctcccgggacaacagcaagaacaccgtgtacctgcagatgaactccctgcgcctcgaggacaccgccctgtactactgcgccaaggacctgcgggagtacgagtgcgaggagtggaccagcgactactacgacttcggccgcccccagccctgcatcgactcccgcggggtggtcggcatcctcgacatctggggccaggggacgatggtgaccgtgagctcc

SEQ ID NO: 9393 - RNA, 432 nt, synthetic construct
  misc_feature 1..432: note = derived and/or modified sequence opt1 from anti-HIV_cap256-119-169596_VR-Chain
  source 1..432: mol_type = other RNA
ctggtgcagctcgtcgagagcggcgggggcgtggtgcagcccgggcggtccctgcggctgagctgcaccgcctccggcttcaccttcagctccttcgccatgcaccgcgtccggcagacgccggggaagggcctcgagtgggtggcgagcatctcctacgacggcagcgacaagtaccacgccgaccgcgtgtgggggcggttcaccatctcccgcgacaacagcaagaacaccctgtacctgcagatgaactccctccgggccgaggacaccgccctgtactactgcgtccgcgacgcccgggagagcgagtgcgagctgtgggagtccgactactacaacttcggccgcaagctcccctgcgtgaagccccgcggggtggcgggcacgctggacatctgggggcagggcaccatggtcaccgtgagctcc

SEQ ID NO: 9394 - RNA, 432 nt, synthetic construct
  misc_feature 1..432: note = derived and/or modified sequence opt1 from anti-HIV_cap256-119-169523_VR-Chain
  source 1..432: mol_type = other RNA
caggtgcagctggtcgagagcggcgggggcgtggtgcagcccggggagtccctccgcctgagctgcgccgcctccggcttcagcttcgggacctccgacgtccactgggtgcggcaggcgccgggcgagggcctggagtgggtggccagcatctccttcgccgggatcaagaagtactacggcgacagcgtcaaggggcgcttcaccatctcccgggacaacagcaagaacacgctctacctgcagatggacggcctgcgcggggaggacaccgccctctactactgcgccaaggacctgcgggagctggagtgcgaggagtgggcgtccgactactacgacttcggccgcccccagccctgcctcgacccccggggcgtgagcgggatctccaacgtgtggggccaggggaccatggtcaccgtgagctcc

SEQ ID NO: 9395 - RNA, 432 nt, synthetic construct
  misc_feature 1..432: note = derived and/or modified sequence opt1 from anti-HIV_cap256-119-169462_VR-Chain
  source 1..432: mol_type = other RNA
gaggtgcagctggtcgagagcggcgggggcctcgtgcagcccgggggctccctgcgcctgagctgcgccgcctccgggttcaccttcaccacgtacagcctccactgggtgcggcagtccccgggcaagggcctggagtgggtcgcggccatcagcttcgccgggaccaaggagaactacgccaactccgtgcgcggccggttcaccatcagccgcgacaactccaagaacaccctgtacctccagatgaacagcctgcgggccgaggacacggcgctgtactactgcaccaaggacatgcgcgagtacgagtgcgaggagtggacctccgactactacgacttcgggcggccccagccctgcatcgacagccgcggcgtggtcgggaccttcgacgtgtggggccagggcacgatggtgaccgtctccagc

SEQ ID NO: 9396 - RNA, 432 nt, synthetic construct
  misc_feature 1..432: note = derived and/or modified sequence opt1 from anti-HIV_cap256-119-169092_VR-Chain
  source 1..432: mol_type = other RNA
gaggtgcagctggtcgagagcggcgggggcctcgtgcagcccgggggctccctgcgcctgagctgcgtgatctccgggttcaccttcagctcctacgagatgaactgggtccggcaggccccgggcaagggcctcgagtgggtggccgggatcagctacgacggccgcgacaagtaccacgcgcacttcgtgtgggggcggatcaccatctcccgcgacaacagcaagaacacgctgtacctgcagatgaactccctccgggccgaggacaccgccctgtaccactgcgtccgcgacctgcgggagagcgagtgcgagctctgggagtccgactactacgacttcggcaagaagctgccctgcgtgaagccccgcggggtggccggcatcttcgacctgtggggccaggggaccatggtcaccgtgagctcc

SEQ ID NO: 9397 - RNA, 432 nt, synthetic construct
  misc_feature 1..432: note = derived and/or modified sequence opt1 from anti-HIV_cap256-119-168680_VR-Chain
  source 1..432: mol_type = other RNA
caggtgcagctggtcgagagcggcgggggcgtggtgcagcccgggcggtccctccgggtcagctgcgccgcctcccacttcaccttcagccgctacggcatgcactgggtgcggcaggcgccggggaagggcctggagtgggtggcctccatcagctacgacggccgcgacttctaccacgcccggtccgtctgggggcgcttcgccatcagccgggacaactccaagaacaccctgcacctccagatgaacagcctgcgcacggaggacaccgccctgtaccactgcgtgcgggacctccgcgagtccgagtgcgagctgtgggagagcgactactacgacttcggcaagaagctgccctgcgtgaagccccgcggggtcgcgggcaccttcgacctctgggggcagggcaccatggtgacggtgtccagc

SEQ ID NO: 9398 - RNA, 438 nt, synthetic construct
  misc_feature 1..438: note = derived and/or modified sequence opt1 from anti-HIV_cap256-119-166385_VR-Chain
  source 1..438: mol_type = other RNA
caggtgcagctggtcgagagcggcgggggcgtggtgcaccccgggcgctccctccggctgagctgcgccgcctccggcttcagcttcgggaacttcggcatgcactgggtccgccaggcgccgggcaaggggctggagtgggtggcctccatcagcaacgacggcaccaagaagtaccacgccgagtccgtgtgggaccggttcagcatctccaaggacaacagcaagaacaccctcttcctgcagatgaactccctgcgcgtcgaggacacggccctctacttctgcgtgaaggaccagcgggaggacgagtgcgaggagtggtggagcgactactacgacttcgggcgcgagctgccctgccggaagtcccgcggcctggggctcgccggcatcttcgacatgtggggccacgggaccatggtgaccgtcagctcc

SEQ ID NO: 9399 - RNA, 432 nt, synthetic construct
  misc_feature 1..432: note = derived and/or modified sequence opt1 from anti-HIV_cap256-119-165943_VR-Chain
  source 1..432: mol_type = other RNA
gaggtgcagctggtcgagagcggcgggggcctcgtgcagcccgggcgctccctgcggctgagctgcgccgtgtccggcttcaccgtcagctccaactacatgagctgggtgcgccaggccccggggaagggcctcgagtgggtggcgtccatcagcttcgccggcatcaagaagtactacggggactccgtcaagggccggttcaccatcagccgcgacaactccaagaacacgctgtacctgcagatggacgggctccggggcgaggacaccgccctgtactactgcgccaaggacctgcgcgagctcgagtgcgaggagtgggccagcgactactacgacttcgggcggccccagccctgcctggacccccgcggcgtgtccggcatcagcaacgtgtgggggcagggcaccatggtcaccgtgtccagc

SEQ ID NO: 9400 - RNA, 432 nt, synthetic construct
  misc_feature 1..432: note = derived and/or modified sequence opt1 from anti-HIV_cap256-119-165738_VR-Chain
  source 1..432: mol_type = other RNA
gaggtgcagctggtcgagagcggcgggggcctcgtgcagcccgggcgctccctgcggctgagctgcgccgcctccggcttcaccttcgacgactacgcgatgaactgggtgcgccaggccccggggaagggcctcgagtgggtcgccaccatcagcttcgacggcacggacaagtaccacgccgacgacgtgtgggggcggttcaccatctcccgcgacaacagcaagaagaccctgtacctgcagatgaactccctccgggccgaggacaccgcgctgtactactgcgccaaggacctgcgcgaggacgagtgcgaggagtggtggagcgactactacgacctcggcaagcagctgccctgccggaagtcccgcggggtggccggcgtcctggacaagtgggggctcggcacgatggtgaccgtgagctcc

SEQ ID NO: 9401 - RNA, 432 nt, synthetic construct
  misc_feature 1..432: note = derived and/or modified sequence opt1 from anti-HIV_cap256-119-164913_VR-Chain
  source 1..432: mol_type = other RNA
caggaccacctggtggagagcggcgggggcggggtccagcccggcaagtccctccgcctgagctgcgccgcctccgggttcaccttcagcgcgcacgccatgcactgggtgcggcaggccccgggcaagggccccgagtgggtggccgtcatctcccacgacgggggccagcagttctaccgcgagagcgtgaaggggcggttcaccatctcccgcgacaacagcaagaacacgctgtacctccagatggacggcctgcgcggggaggacaccgccctgtactactgcgcgaaggacctccgggagctggagtgcgaggagtgggcctccgactactacgacttcggccggccccagccctgcctggacccgcgcggcgtgagcgggatctccaacgtctggggccaggggaccatggtgaccgtgagctcc

SEQ ID NO: 9402 - RNA, 432 nt, synthetic construct
  misc_feature 1..432: note = derived and/or modified sequence opt1 from anti-HIV_cap256-119-164167_VR-Chain
  source 1..432: mol_type = other RNA
gaggtgcgcctggtcgagagcggcgggggcctcatccagcccgggggctccctgcggctgagctgcgccgcctccgggctcaccgtgagctccaaccacatgagctgggtgcgccaggcgccgggcaagggcctggagtgggtcgcctccatcagctacgacgggcgggacttctaccacgcccgctccgtgtggggccggttcaccatcagccgcgacaactccaagaacacgctgcacctccagatgaacagcctgcggcccgaggacaccgccctgtacttctgcgcccgcgacctccgggagtccgagtgcgaggagtgggagagctactactacgacttcgggaagaagggcccctgcgtgaagccccgcggggtcgtgggcgtgctggacatctggggccaggggaccctggtcaccgtgtccagc

SEQ ID NO: 9403 - RNA, 432 nt, synthetic construct
  misc_feature 1..432: note = derived and/or modified sequence opt1 from anti-HIV_cap256-119-163558_VR-Chain
  source 1..432: mol_type = other RNA
cagatgcagctggtggagagcggcgggggcgtcgtgcagcccgggcggtccctcaccctgagctgcgccgcctcccagttcaacttcgcgaactacggcatgcactgggtgcggcaggccccggggaagggcctggagtgggtcgccagcatctcctacgacggcagcgacaagtaccacgccgaccgcgtgtgggggcggttcaccatctcccgcgacaacagcaagaacacgctctacctgcagatgaactccctgcgggccgaggacaccgcgctctactactgcgtgcgcgacgcccgggagagcgagtgcgagctgtgggagtccgactactacaacttcggccgcaagctgccctgcgtcaagccccgcggggtggccggcaccctcgacatctgggggcagggcaccatggtgacggtcagctcc

SEQ ID NO: 9404 - RNA, 432 nt, synthetic construct
  misc_feature 1..432: note = derived and/or modified sequence opt1 from anti-HIV_cap256-119-162043_VR-Chain
  source 1..432: mol_type = other RNA
caggtgcagctggtcgagagcggcgggggcgtggtgcagcccgggcgctccctccgggtcagctgcgccgcctcccacttcaccttcagccgctacggcatgcactgggtgcggcaggcgccggggaagggcctggagtgggtgaccggcatctccttcgccgccacgaagacctactacggggacagcgtccgcggccggttcaccgtgtcccgcgacatcagcaagaacaccctgtacctccagatgaactccctgcggcccgaggacacggccatgtactactgcgcccgcgaccagcggtactacgagtgcgaggagtgggcgagcgactactacgacttcgggcgcgagcagccctgccaggacccccggggcgtggtcgggatcctggacctctggggccagggcaccatggtgaccgtgtccagc

SEQ ID NO: 9405 - RNA, 432 nt, synthetic construct
  misc_feature 1..432: note = derived and/or modified sequence opt1 from anti-HIV_cap256-119-161718_VR-Chain
  source 1..432: mol_type = other RNA
caggtgcagctggtcgagagcggcgggggcgtggtgcagcccgggaagtccctccgcctgagctgcgccgcctcccacttcagcttcaaccggtacggcatgcactgggtccgccaggcgccggggaagggcctggagtgggtggccgccatctcctacgacggcaccgacaagtaccacgccgaccaggtgtgggggcggttcaccatcagccgcgacaactccaagaacacgctctacctgcagatgaacagcctgcggcccgaggacaccgccctctactactgcgcgaaggacctgcgcgaggacgagtgcgaggagtggtggtccgactactacgacctgggcaagcagctcccctgccggaagtcccgcggggtcgccggcatcttcgacaagtgggggcagggcaccatggtgaccgtgagcagc

SEQ ID NO: 9406 - RNA, 432 nt, synthetic construct
  misc_feature 1..432: note = derived and/or modified sequence opt1 from anti-HIV_cap256-119-161675_VR-Chain
  source 1..432: mol_type = other RNA
caggtgcagctggtcgagagcggcgggggcgtggtgcagcccgggcggtccctccggctgagctgcaccgcctccggcttcaccttcagcatctactccatgaactgggtccgccaggccccggggaagggcctggactgggtggcgggcatcagcttcgccgccacgaagacctactacgggggctccgtgaaggggcggttcaccgtcagccgcgacatctccaagaacaccctctacctgcagatgaacagcctgcggcccgaggacacggccatgtactactgcgcccgcgaccagcggtactacgagtgcgaggagtgggcgtccgactactacgacttcggccgcgagcagccctgccaggacccccgcggggtggtgggcgtcttcgacatgtggggccaggggaccatggtgaccgtgagctcc

SEQ ID NO: 9407 - RNA, 432 nt, synthetic construct
  misc_feature 1..432: note = derived and/or modified sequence opt1 from anti-HIV_cap256-119-161053_VR-Chain
  source 1..432: mol_type = other RNA
caggtgcacctggtcgagagcggcgggggcgtggtgcagcccgggacctccctccggctgagctgcgtcgcctccggcttcaccttcagcaacttcgccatgcactgggtgcggcaggcgccggggaagggcctggagtgggccgccatcatctccacgcgcggcaacaaccggaactacgccgacagcgtgcgcgggcggttcaccgtctcccgcgacatcagcaagaacaccctctacctgcagatgaactccctgcggcccgaggacaccgccatgtactactgcgcgcgcgaccagcggtactacgagtgcgaggagtgggccagcgactactacgacttcggccgcgagcagccctgccaggacccccgcggggtggtgggcatcctcgacctgtgggggcagggcacgatggtcaccgtgtccagc

SEQ ID NO: 9408 - RNA, 432 nt, synthetic construct
  misc_feature 1..432: note = derived and/or modified sequence opt1 from anti-HIV_cap256-119-159499_VR-Chain
  source 1..432: mol_type = other RNA
caggtgcagctggtcgagagcggcgggggcgtggtgcagcccgggcgctccctccggctgagctgcgccgcctccggcttcgcgttcagccactacgggatcttctgggtccgccaggccccgggcaagggcctggagtgggtggcctccatcagcttcgacgggcgggactactaccacagcccccacgtgtggggccgcctcaccatctcccgggacaactccaagaacaccctgtacctgcagatgaacagcctccgcgccgaggacacggccctgtactactgcgcgcgggacctgcgcgagtccgagcgggaggagtgggagagcgactactacgacttcgggaagaagggcccctgcgtcaagccccgcggggtggccggctccctcgacatgtggggccaggggaccatggtgatcgtcagctcc

SEQ ID NO: 9409 - RNA, 432 nt, synthetic construct
  misc_feature 1..432: note = derived and/or modified sequence opt1 from anti-HIV_cap256-119-159114_VR-Chain
  source 1..432: mol_type = other RNA
gaggtgcagctggtcgagagcggcgggggcctcgtgcagcccgggggctccctgcgcctggcctgcgccgcgagcgggctcaccttccggaagcacggcatgcactgggtgcgccaggccccgggcaaggggctggagtgggtctcctacatcagctccgacggcgtgaacaactacctgatcgacagcgtgcgggggcgcttcaccgtctcccgggacaacagcaagaacacgctctacctgcagatggacggcctgcgcggggaggacaccgccctctactactgcgccaaggacctgcgggagctggagtgcgaggagtgggcctccgactactacgacttcggccgcccccagccctgcctcgacccccggggcgtgagcgggatctccaacgtgtggggccaggggaccatggtcaccgtgagctcc

SEQ ID NO: 9410 - RNA, 432 nt, synthetic construct
  misc_feature 1..432: note = derived and/or modified sequence opt1 from anti-HIV_cap256-119-156751_VR-Chain
  source 1..432: mol_type = other RNA
gaggtgcagctgctcgagagcggcgggggcctggtccagcccgggggctccctgcgcctcagctgcgccgcctccgggttcgcgttcagctcctacggcatgcactgggtgcggcaggccccgggcaaggggctggagtgggtggccagcatctcctacgacggccgcgacttctaccacgcccggagcgtctgggggcgcttcaccatctcccgggacaacagcaagaacaccctgcacctccagatgaactccctgcgccccgaggacacggccctgtacttctgcgcgcgggacctccgcgagagcgagtgcgaggagtgggagtcctactactacgacttcggcaagaaggggccctgcgtgaagccccggggcgtggtcggcgtgctggacatctgggggcagggcaccctggtgaccgtcagctcc

SEQ ID NO: 9411 - RNA, 432 nt, synthetic construct
  misc_feature 1..432: note = derived and/or modified sequence opt1 from anti-HIV_cap256-119-155656_VR-Chain
  source 1..432: mol_type = other RNA
gaggtgcagctggtcgagagcggcgggggcctcgtgcagcccgggggctccctgcgcctgagctgcgccgcctccgggatcaccttcagctcctacggcatgcactgggtgcggcaggcgccgggcaaggggctcgagtgggtcgccttcatccgctacgacggcagctccaagtactacgccgacagcgtgaaggggcggttcaccatctcccgcgacaacagcaagaacacgctgtacctgcagatggacggcctccgcggggaggacaccgccctgtactactgcgccaaggacctgcgggagctcgagtgcgaggagtgggcgtccgactactacgacttcggccggccccagccctgcctggacccccgcggcgtgagcgggatctccaacgtctggggccaggggaccatggtgaccgtgagctcc

SEQ ID NO: 9412 - RNA, 432 nt, synthetic construct
  misc_feature 1..432: note = derived and/or modified sequence opt1 from anti-HIV_cap256-119-154420_VR-Chain
  source 1..432: mol_type = other RNA
caggtgcgcctggtcgagagcggcgggggcgtggtgcagcccgggcggtccctccgcatcagctgcgccgcctcccagttcatgttcagccggtacggcatgcactgggtccgccaggcgccggggaagggcctggagtgggtggcctccatcagctacgacggcaccgacaagtaccacgccgacctggtgtgggggcggttcaccatctcccgcgacaacagcaagaacacgctctacctgcagatgaactccctgcgggccgaggacaccgccctctactactgcgcgcgcgacctgcgggagagcgagtgcgaggagtgggagtccgactactacgacttcggcaagaaggggccctgcgtcaagccccgcggcgtggccgggagcctggacatgtggggccagggcaccatggtgatcgtctccagc

SEQ ID NO: 9413 - RNA, 432 nt, synthetic construct
  misc_feature 1..432: note = derived and/or modified sequence opt1 from anti-HIV_cap256-119-153954_VR-Chain
  source 1..432: mol_type = other RNA
gaggtgcaggtcctggagagcggcgggggcctcgtgcagcccgggggctccctgcgcctgagctgcgtggcctcccagttcaccttcagcgggtgcggcctccactgggtccggcaggccccgggcaaggggctggagtgggtggcgtccatcagcttcgccggcaccaagaagcactacgggaactccgtgaagggccgcttcacgatcagccgggacaactccaagaacaccgtctacctggagatgaacagcctccgcgccgaggacaccgccctgtactactgcgccaaggacctgcgggagtacgagtgcgaggagtggacctccgactactacgacttcgggcgcccccagccctgcatcgacagccggggcgtggtgggcatcctcgacatctgggggcagggcacgatggtcaccgtgtccagc

SEQ ID NO: 9414 - RNA, 432 nt, synthetic construct
  misc_feature 1..432: note = derived and/or modified sequence opt1 from anti-HIV_cap256-119-153864_VR-Chain
  source 1..432: mol_type = other RNA
caggtgcacctggtcgagagcggcgggggcgtggtgcagcccgggggctccctccgcctgagctgcgccgcctccgggttcaccttcagcggctgcggcctgcactgggtccggcaggcgccggggaagggcctcgagtgggtggcctccatcagcttcgccgggaccaagaagcactacggctccagcgtgcgcgggcggttctccatcagccgcgacaactccaagaacacgctgtacctgcagatgaacagcctccggaccgaggacaccgccctgtacttctgcgccaaggacctgcgcgagtacgagtgcgaggagtggacctccgactactacgacttcggccggccccagccctgcatcgacagccgcggcgtcgtggggatcctcgacatctggggccaggggacgatggtgaccgtctccagc

SEQ ID NO: 9415 - RNA, 432 nt, synthetic construct
  misc_feature 1..432: note = derived and/or modified sequence opt1 from anti-HIV_cap256-119-153793_VR-Chain
  source 1..432: mol_type = other RNA
gaggtgcagctggtcgagagcggcgggggcgtggtgcagcccgggggctccctccgcctgagctgcgccacctccgggttcaccttcggcacgttcggcatgcactgggtccggcaggccccggggaagggcctggactgggtggcgtacatccgctacgacgggaagaccaagaactacggcgagagcgtgaaggggcggttcaccatctcccgcgacaacagcaagaacaccatgtccctccagatgaacagcctgcggcccgaggacacggccctgtactactgcgccaaggacctccgcgaggacgagtgcgaggagcggtggtccgactactacgacttcggcaagcagctgccctgccgcaagagccggggcgtcgccggggtgttcgacaactggggccaggggaccatggtgaccgtctccagc

SEQ ID NO: 9416 - RNA, 432 nt, synthetic construct
  misc_feature 1..432: note = derived and/or modified sequence opt1 from anti-HIV_cap256-119-153462_VR-Chain
  source 1..432: mol_type = other RNA
caggtgcagctggtcgagagcggcgggggcgtggtgcagcccgggggctccctccgcctgagctgcgccgcctccgggttcaccttcagcaactacggcatgcagtgggtccggcaggcgccgggcaaggggctggagtgggtggccgccatctcctacgacggccgcaacgagtactacgccgagagcgtgaaggggcggttcaccatctcccgcgacaacttcaagagcaccctcttcctgcagatgaactccctgcgggccgaggacacggcgctctactactgcgcccgcgacctgcgggagagcgagtgcgaggagtgggagtccgactactacgccttctaccgcaagctgccctgcgtcaagccccggggcgtggccgggaccctcgacatctggggccagggcaccatggtgacggtcagctcc

SEQ ID NO: 9417 - RNA, 438 nt, synthetic construct
  misc_feature 1..438: note = derived and/or modified sequence opt1 from anti-HIV_cap256-119-153124_VR-Chain
  source 1..438: mol_type = other RNA
caggtgcagctggtcgagagcggcgggggcgtggtgcagcccgggcgctccctcaccctgagctgcatcgcctcccagttcaacttcgccagctacggcatgcactgggtccggcaggcgccggggaagggcctggagtgggtggcctccatcagccacgacggcaccaagaagtaccacgccgagtccgtgtgggggcgcttcacgatcagcaaggacaactccaagaacaccctcttcctgcagatgaacagcctgcgggtcgaggacaccgccctctacttctgcgtgaaggaccagcgcgaggacgagtgcgaggagtggtggtccgactactacgacttcggccgggagctgccctgccgcaagagccgggggctgggcctcgccgggatcttcgacatgtggggccacggcaccatggtgacggtctccagc

SEQ ID NO: 9418 - RNA, 438 nt, synthetic construct
  misc_feature 1..438: note = derived and/or modified sequence opt1 from anti-HIV_cap256-119-153025_VR-Chain
  source 1..438: mol_type = other RNA
cagatgcagctggtggagagcggcgggggcgtcgtgcagcccgggaagtccctcaccctgagctgcgccgcctcccagttcaccttcagcaactacggcatgcactgggtgcgccaggcgccggggaagggcctggagtgggtcgcctccatcagcaacgacggcaacaagaagtaccacggggactccgtgtggggccggctcacgatcagccgcgacaactccaagaacaccctgttcctgcagatgaacagcctccggcccgaggacaccgccctgtacttctgcgtgaaggaccagcgcgaggacgagtgcgaggagtggtggtccgactactacgacttcgggcgggagctgccctgccgcaagttccggggcctcgggctggccggcatcttcgacatctggggccacgggaccatggtcacggtgagctcc

SEQ ID NO: 9419 - RNA, 432 nt, synthetic construct
  misc_feature 1..432: note = derived and/or modified sequence opt1 from anti-HIV_cap256-119-152713_VR-Chain
  source 1..432: mol_type = other RNA
gaggtgcagctggtcgagagcggcgggggcctcgtgcgccccgggggctccctgcggctgagctgcgccacctccgggttcaccttcagctcccactggatgagctgggtgcgccaggccccgggcaagggcctcgagtgggtcgcggggatctccttcgccggcacgaagacctactacggggacagcgtgaagggccggttcaccgtgtccaccgacatcagcaagaacacgctgtacctgcaggtcaactccctccgccccgaggacaccgccatgtactactgcgcccgggaccagcgctactacgagtgcgaggagtgggccagcgactactacgacttcgggaaggagcagccctgcctggacccccggggcgtggtgggcatcttcgacatctgggggcagggcaccatggtcaccgtgtccagc

SEQ ID NO: 9420 - RNA, 438 nt, synthetic construct
  misc_feature 1..438: note = derived and/or modified sequence opt1 from anti-HIV_cap256-119-151794_VR-Chain
  source 1..438: mol_type = other RNA
cacgtgcagctggtcgagagcggcgggggcgtggtgcagcccgggacctccctccgcctgagctgcgtcgcctccgagttcagcttcaagaactacggcatgcactgggtgcggcaggccccggggaagggcctggagtgggtggcgtccatcagcaacgacggcaccaagaagtaccacgccgagtccgtctgggaccgcttcagcatctccaaggacaacagcaagaacaccctcttcctgcagatgaactccctgcgggtggaggacacggccctctacttctgcgtgaaggaccagcgcgaggacgagtgcgaggagtggtggagcgactactacgacttcgggcgggagctgccctgccgcaagtcccggggcctggggctcgccggcatcttcgacatgtgggggcacggcaccatggtcaccgtgagctcc

SEQ ID NO: 9421 - RNA, 438 nt, synthetic construct
  misc_feature 1..438: note = derived and/or modified sequence opt1 from anti-HIV_cap256-119-150980_VR-Chain
  source 1..438: mol_type = other RNA
caggtgcagctggtcgagagcggcgggggcgtggtgcagcccgggaagtccctccgcctgagctgcgccgcctccggcttcatcctgagcaactacgcgatgcactgggtccggcaggccccggggaagggcctcgagtgggtggcctccatcagcaacgacggctccaagaagtaccacggggacagcgtgtgggcccgcttcatcatctcccgggacaacagcaagaacaccctgttcctgcagatgtccagcctccgcgccgaggacaccgcgctgtacttctgcgtccgggaccaccgcgaggacgagtgcgaggagtggtggtccgactactacgacttcggccgggagctgccctgccgcaagttccgggggctcggcctggccgggatcttcgacatctggggccacggcacgatggtgaccgtgagctcc

SEQ ID NO: 9422 - RNA, 432 nt, synthetic construct
  misc_feature 1..432: note = derived and/or modified sequence opt1 from anti-HIV_cap256-119-148895_VR-Chain
  source 1..432: mol_type = other RNA
caggtgcagctggtcgagagcggcgggggcgtggtgcagcccgggcgctccctccggctgagctgcgccgcctccggcttcaccttccgcagctacgggatgcactgggtccggcaggcgccgggcaagggcctggagtgggtggccgtgatctccagcgacggggacatcgagtactacacccagtccgtcaagggccgcttcacgatcagccgggacaactccaagaacaccctctacctgcagatgaacgccctgcgccccgaggacaccgccatgtactactgcgcccgggaccagcgctactacgagtgcgaggagtgggcgagcgactactacgacttcgggcgggagcagccctgccaggacccccgcggcgtggtgggggtcttcgacatgtggggccagggcaccatggtgacggtgtccagc

SEQ ID NO: 9423 - RNA, 438 nt, synthetic construct
  misc_feature 1..438: note = derived and/or modified sequence opt1 from anti-HIV_cap256-119-148848_VR-Chain
  source 1..438: mol_type = other RNA
cagatgcagctggtggagagcggcgggggcgtcgtgcagcccgggcggtccctcaccctgagctgcgccgcctcccagttcagcttcacctcctacggcatgcactgggtgcggcaggcgccggggaagggcctggagtgggtcgccagcatctccaacgacggcacgaagaagtaccacggggagagcgtgtgggaccgcttctccatcagccgggacaactccaagaacaccctcttcctgcagatgaacagcctgcgcgtggaggacaccgccctctacttctgcgtcaaggaccagcgggaggacgagtgcgaggagtggtggtccgactactacgacttcggcaaggagctgccctgccgcaagtggaagacccgcggggtggccggcatcctggacaactgggggcagggcacgatgctcaccgtgagctcc

SEQ ID NO: 9424 - RNA, 432 nt, synthetic construct
  misc_feature 1..432: note = derived and/or modified sequence opt1 from anti-HIV_cap256-119-148743_VR-Chain
  source 1..432: mol_type = other RNA
caggtgcagctggtcgagagcggcgggggcgtggtgcagcccgggcgctccctcaccctgagctgcgccgcctcccagttcaacttcgcgaactacggcatgcactgggtccggcaggccccggggaagggcctggagtgggtggccagcatctccaacgacggcaccaagaagtaccacgccgagagcgtgtgggaccgcttctccatcagcaaggacaactccaagaacaccctcttcctgcagatgaacagcctgcgggtcgaggacacggccctctacttctgcgtgaaggaccagcgcgaggacgagtgcgaggagtggtggtccgactactacgacttcgggaagaagctgccctgccgcaagagccggggcctggcggggatcttccacgtgtggggccacgggaccatggtcaccgtgtccagc

SEQ ID NO: 9425 - RNA, 432 nt, synthetic construct
  misc_feature 1..432: note = derived and/or modified sequence opt1 from anti-HIV_cap256-119-148595_VR-Chain
  source 1..432: mol_type = other RNA
gaggtgcagctggtcgagagcggcgggggcctcgtgcagcccgggggctccctgcgcctgagctgcgccgcctcccggttcaccttcgacaactacgggatgcactgggtgcgccaggcgccgggcaagggcctcgagtgggtcgccctgctgaactacgacgggagcaagaagtactacgtggactccgtgaagggccggttcatcatcttccgcgacaacagcaagaacaccctcttcctgcagatgaactccctgcggcccgaggacacggccctctacttctgcgtcaaggaccagcgcgaggacgcctgcgaggagtggtggagcgactactacgacttcgggaagaagctgccctgccggaagtcccgcggcctggccgggatcttccacgtgtggggccacggcaccatggtgaccgtcagctcc

SEQ ID NO: 9426 - RNA, 432 nt, synthetic construct
  misc_feature 1..432: note = derived and/or modified sequence opt1 from anti-HIV_cap256-119-148490_VR-Chain
  source 1..432: mol_type = other RNA
caggtgcagctggtcgagagcggcgggggcgtggtgcagcccgggcggtccctccggctgagctgcgtcgcctccggcttcaccttcagcgactacgccatgcactgggtgcgccaggcgccggggaagggcctggagtgggtggccaccatctccttcgacggcgccgacaagtaccacgccgacgacgtctgggggcggttcacgatcagccgcgacaactccaagaacaccctctacctgcagatgaacagcctgcggcccgaggacaccgccctctactactgcgcgaaggacctgcgcgaggacgagtgcgaggagcggtggtccgactactacgacttcggcaagcagctgccctgccgcaagagccgcggggtggccggcgtgttcgacaactgggggcagggcaccatggtcacggtgtccagc

SEQ ID NO: 9427 - RNA, 438 nt, synthetic construct
  misc_feature 1..438: note = derived and/or modified sequence opt1 from anti-HIV_cap256-119-148470_VR-Chain
  source 1..438: mol_type = other RNA
caggtgcagctggtcgagagcggcgggggcgtggtgcagcccgggcgctccctccggctgagctgcgtcgcctccggcttcaccttcagctcctacgggatccactgggtgcgccaggccccgggcaagggcctggagtgggtggcggtcatcagcgacgacgggtccaagaagtaccacgaggagagcgtgtggggccggttcaccatctccaaggacaacagcaagaacaccctcttcctgcagatgaactccctgcgcatcgaggacacggccctctacttctgcgtgaaggaccagcgggaggacgagtgcgaggagtggtggagcgactactacgacttcgggcgcgagctgccctgccggaagtcccgcggcctggggctcgccggcatcttcgacatgtggggccacgggaccatggtcaccgtgagctcc

SEQ ID NO: 9428 - RNA, 432 nt, synthetic construct
  misc_feature 1..432: note = derived and/or modified sequence opt1 from anti-HIV_cap256-119-148107_VR-Chain
  source 1..432: mol_type = other RNA
gaggtgcagctggtcgagagcggcgggggcctcgtgcagcccgggggctccctgcgcctgagctgcgccgcctccgggttcaccgtgagctccaactacatgacctgggtccggcaggcgccgcgcaagggcctcgagtgggtgggcagcatctcctacgacgggagcgacaagtaccacacgaactccctgtggggccggttcatcgtgagccgcgacaactccaagaacaccctgtacctccagatgaacaacctgcggcccgaggacaccgccctgtactactgcgtccgcgaccggcgcgagagcgagtgcgaggagcggtggtccgactactacgacttcgggaagcagctcccctgcgtgaagccccgcggcgtggccgggatcttcgacatctggggccagggcaccatggtcacggtgagctcc

SEQ ID NO: 9429 - RNA, 432 nt, synthetic construct
  misc_feature 1..432: note = derived and/or modified sequence opt1 from anti-HIV_cap256-119-147933_VR-Chain
  source 1..432: mol_type = other RNA
gagctgcagctcgtggagagcggcgggggcctggtccagcccgggtggtccctgcgcctcagctgcgaggcctccggcttcccgttcagcgccttctggatgacctgggtgcggcaggcgcccgggaagggcctgggctgggtggccttcatccgctacgacgggtccaacaagtactacgccgacagcgtcaagggccggttcaccatctcccgcgacaacagcatgacgaccctgtacctccagatgaactccctgcgggccgaggacgccgcggtgtactactgcgccaaggacctgcgcgaggacgagtgcgaggagtggtggagcgactactacgacttcgggaagcggctcccctgccgcaagtcccggggcgtggccggggtcttcgacaagtggggccagggcaccatggtgaccgtgagctcc

SEQ ID NO: 9430 - RNA, 432 nt, synthetic construct
  misc_feature 1..432: note = derived and/or modified sequence opt1 from anti-HIV_cap256-119-147434_VR-Chain
  source 1..432: mol_type = other RNA
caggtgcagctggtcgagagcggcgggggcgtggtgcaggccgggcgctccctccggctgagctgcgccgcgtcccagttcaccttcggccgctacgggatgcactgggtccggcaggcccccggcaagggcctggagtgggtggggagcatctcctacgacggcagcgacaagtaccacaccaactccgtgtgggggcgcttcatcgtcagccgggacaactccaagaacacgctctacctgcagatgaacagcctgcgcccggaggacaccgccatgtactactgcgcccgggaccagcgctactacgagtgcgaggagtgggcctccgactactacgacttcggccgggagcagccctgccaggacccccgcggggtggtgggcgtcttcgacatgtggggccaggggaccatggtgaccgtgagctcc

SEQ ID NO: 9431 - RNA, 435 nt, synthetic construct
  misc_feature 1..435: note = derived and/or modified sequence opt1 from anti-HIV_cap256-119-146106_VR-Chain
  source 1..435: mol_type = other RNA
caggtgcagctggtcgagagcggcgggggcgtggtgcagcccgggcgctccctccggctgagctgcgccgcctccggcttcaccttcagctccagcgggatgcactgggtccgccaggcgccgggcaagggcctgcagtgggtggccgtgatctcctacgacgggggcaacaagtactacgccgacagcgtcaaggggcggttcaccatctcccgcgacaacagcaagaacaacctctacctgcagatgaactccctgcggcccgaggacacggccctctactactgcgcccgcgacctgcgggagatggagtgcgaggagtggaagctgtacaactactacgacttccgcacccggggcccctgcgtggacccccgcggggtggtcggcagcttcgacgtgtggggccaggggaccgtggtcaccgtgtccagc

SEQ ID NO: 9432 - RNA, 438 nt, synthetic construct
  misc_feature 1..438: note = derived and/or modified sequence opt1 from anti-HIV_cap256-119-145604_VR-Chain
  source 1..438: mol_type = other RNA
gacgtgcagctggccgagagcggcgggggcctcgtccagcccgggggctccctgcgcctgagctgcgtggcctccgggttcaccttcagctccttcgagatgcactgggtgcggcaggcgccgggcaagggcctcgagtgggtcgccagcatctccaacgacgggaccaagcgctaccacgccgagagcgtgtgggaccggttctccatcagcaaggacaactccaagaacacgctgttcctgcagatgaacagcctccgcgtggaggacaccgccctgtacttctgcgtcaaggaccagcgggaggacgagtgcgaggagtggtggtccgactactacgacttcggccgcgagctgccctgccgcaagagccgggggctcggcctggccgggatcttcgacatgtggggccacggcaccatggtgaccgtgtccagc

SEQ ID NO: 9433 - RNA, 438 nt, synthetic construct
  misc_feature 1..438: note = derived and/or modified sequence opt1 from anti-HIV_cap256-119-143998_VR-Chain
  source 1..438: mol_type = other RNA
caggtgcagctggtcgagagcggcgggggcgtggtgcagcccgggcgctccctccggctgagctgcgccgcctccggcttcaccttccgcaactacgggatgcactgggtccggcaggcgccgggcaagggcctggagtgggtggccagcatctccaacgacgggagcaagaagtaccacggcgactccgtgtgggcccgcttcatcatcagccgggacaactccaagaacaccctcttcctgcagatgagctccctgcgcgccgaggacacggccctctacttctgcgtcaaggaccagcgggaggacgagtgcgaggagtggtggagcgactactacgacttcgggcgcgagctgccctgccggaagtcccgcggcctggggctcgcgggcatcttcgacatgtggggccacgggaccatggtgaccgtgagctcc

SEQ ID NO: 9434 - RNA, 438 nt, synthetic construct
  misc_feature 1..438: note = derived and/or modified sequence opt1 from anti-HIV_cap256-119-143441_VR-Chain
  source 1..438: mol_type = other RNA
gaggtgcacctggtcgagagcggcgggggcctcgcccagcccgggcgctccctgcggctgagctgcgccgcgtcccagttcaacttcgccagctacggcatgcactgggtgcgccaggccccggggaagggcctcgagtgggtggcctccatcagcaacgacggcaccaagcggtaccacgccgagtccgtctgggaccgcttcagcatctccaaggacaacagcaagaacaccctgttcctgcagatgaactccctccgggtggaggacacggcgctgtacttctgcgtgaaggaccagcgcgaggacgagtgcgaggagtggtggagcgactactacgacttcgggcgggagctgccctgccgcaagtcccggggcctcgggctggccggcatcttcgacatgtgggggcacggcaccatggtcaccgtgagctcc

SEQ ID NO: 9435 - RNA, 432 nt, synthetic construct
  misc_feature 1..432: note = derived and/or modified sequence opt1 from anti-HIV_cap256-119-141307_VR-Chain
  source 1..432: mol_type = other RNA
caggtgcacctggtcgagagcggcgggggcgtggtgcagcccgggcgctccctccggctgagctgcgccgcctcccagttcaccttcaaccgctacggcctgcactgggtccggcaggcgccggggaagggcctcgagtgggtggccggcatcagctacgacgggcgcgacaagtaccacgcccacttcgtgtggggccggttcatcatctcccgcgacaacagcaagaacaccctgtacctgcagatgaactccctccgggccgaggacacggccctgtactactgcgtccgcgacctgcgggagagcgagtgcgagctctgggagtccgactactacgacttcgggaagcgcctgccctgcgtgaagccccggggcgtggcggggaccttcgacctgtggggccagggcaccatggtcaccgtgagctcc

SEQ ID NO: 9436 - RNA, 432 nt, synthetic construct
  misc_feature 1..432: note = derived and/or modified sequence opt1 from anti-HIV_cap256-119-140896_VR-Chain
  source 1..432: mol_type = other RNA
gaggtgaagctggtcgagagcggcgggggcctcgtgcagcccgggggctccctgaagctgagctgcgccgcctccgggttcaccttcagctactacgcgatgcactgggtgcgccaggccccgggcaagggcctcgagtgggtcgccgtgatctcctacgacgggagcgacaagtactacgccgactccgtgaagggccggttcaccatcagccgcgacaactccaagaacacgctgcacctccagatgaacagcctgcggcccgaggacaccgccctgtacttctgcgcgcgcgacctgcgggagtccgagtgcgaggagtgggagagctactactacgacttcgggaagaagggcccctgcgtcaagccccgcggggtggtgggcgtcctcgacatctggggccaggggaccctggtgaccgtgtccagc

SEQ ID NO: 9437 - RNA, 432 nt, synthetic construct
  misc_feature 1..432: note = derived and/or modified sequence opt1 from anti-HIV_cap256-119-140090_VR-Chain
  source 1..432: mol_type = other RNA
gaggtgcagctggtcgagagcggcgggggcctcgtgcagcccgggggctccctgcgcctgagctgcgccgcctccgggttcgcgttcagctcctactggatgacctgggtgcggcaggccccgggcaagggcctcgagtgggtcgccgtgatcagctacgacgggtccaacaagtactacgccgacagcgtgcgcggccggttcaccatctcccgcgacagctccaagaacacgctgtacctggagatgaacagcctccggcccgaggacaccgccctgtactactgcgcgaaggacatgcgcgggtacgagtgcgaggagtggacctccgactactacgacttcggccggccccagccctgcatcgacagccgcggggtcgtgggcaccttcgacgtgtggggccaggggacgatggtcaccgtgtccagc

SEQ ID NO: 9438 - RNA, 438 nt, synthetic construct
  misc_feature 1..438: note = derived and/or modified sequence opt1 from anti-HIV_cap256-119-140037_VR-Chain
  source 1..438: mol_type = other RNA
caggtgcagctggtcgagagcggcgggggcctcgtgcagcccgggcgctccctgcggctgagctgcgccgcctccggcttcaccttcgacgactacgtgatgcactgggtccgccaggcgccggggaagggcctcgagtgggtggccagcatctccaacgacggcaccaagaagtaccacgaggagagcgtgtgggggcggttcacgatctccaaggacaacagcaagtccaccctgttcctgcagatgaacagcctccgcatcgaggacaccgccctgtacttctgcgtcaaggaccagcgggaggacgagtgcgaggagtggtggtccgactactacgacttcggccgcgagctgccctgccgcaagagccgggggctcggcctggccgggatcttcgacatgtggggccacggcaccatggtgacggtgtccagc

SEQ ID NO: 9439 - RNA, 432 nt, synthetic construct
  misc_feature 1..432: note = derived and/or modified sequence opt1 from anti-HIV_cap256-119-139135_VR-Chain
  source 1..432: mol_type = other RNA
gaggtgcagctggtcgagagcggcgggggcgtggtgcgccccgggggctccgtccggctcagctgcgtggcctccgggttcagcttccgctcctacggcatgcactgggtgcggcaggccccgggcaaggggctggagtgggtcgcgagcatctcctacgacggccgcgacttctaccacgcccggagcgtgtgggggcgcttcaccatctcccgggacaacagcaagaacaccctgcacctccagatgaactccctgcgccccgaggacacggccctgtacttctgcgcccgggacctccgcgagagcgagtgcgaggagtgggagtcctactactacgacttcggcaagaaggggccctgcgtgaagccccggggcgtcgtgggcgtgctggacatctgggggcagggcaccctggtcaccgtgagctcc

SEQ ID NO: 9440 - RNA, 438 nt, synthetic construct
  misc_feature 1..438: note = derived and/or modified sequence opt1 from anti-HIV_cap256-119-137881_VR-Chain
  source 1..438: mol_type = other RNA
caggtgcagctggtcgagagcggcgggggcctcgtgaagcccgggcgctccctgaccctgagctgcgccgcctcccagttcaccttcagcaactacggcatgcactgggtgcggcaggcgccggggaagggcctcgagtgggtcgcctccatcagcaacgacggcaacaagaagtaccacggggactccgtgtgggcccgcttcacgatcagccgggacaactccaagaacaccctgttcctgcagatgagctccctccgcaccgaggacaccgccctgtacttctgcgtgcgggaccgccgggaggacgagtgcgaggagtggtggagcgactactacgacttcggccgcgagctgccctgccggaagttccgcgggctcggcctggccgggatcttcgacatctggggccacggcacgatggtcaccgtgtccagc

SEQ ID NO: 9441 - RNA, 432 nt, synthetic construct
  misc_feature 1..432: note = derived and/or modified sequence opt1 from anti-HIV_cap256-119-137643_VR-Chain
  source 1..432: mol_type = other RNA
gaggtgcagctggtcgagagcggcggggacctcgtgcagcccggcgggtccctgcggctgagctgcgccgcctccggcttcagcttctccagctacgggatgcactgggtgcggcaggcgccggacaagggcctcgagtgggtcaccgtgatctcctacgacggcagcaacaagcactacgccgactccgtgaaggggcgcttcaccatcagccgggacaactccaagaacacgctgtacctggagatgaacaccctccgcgccgaggacaccgccctgtactactgcgccaaggacctgcgggagtacgagtgcgaggagtggaccagcgactactacgacttcggccgcccccagccctgcatcgactcccgcggggtcgtgggcatcctcgacatctgggggcagggcacgatggtgagcgtctccagc

SEQ ID NO: 9442 - RNA, 438 nt, synthetic construct
  misc_feature 1..438: note = derived and/or modified sequence opt1 from anti-HIV_cap256-119-137170_VR-Chain
  source 1..438: mol_type = other RNA
caggtgcagctggtcgagagcggcgggggcgtggtgcagcccgggcgctccctccggctgagctgcgccgcctccgagttcaccttcagccgctactccatgcactgggtccggcaggcgccgggcaaggggctggagtgggtggccgtgatcagctccgacggcagcaaccagttccacgccgactccgtctggggccgcttcaccatcagcaaggacaactccaagaacaccctcttcctgcagatgaacagcctgcggatcgaggacacggccctctacttctgcgtgaaggaccagcgcgaggacgagtgcgaggagtggtggtccgactactacgacttcgggcgggagctgccctgccgcaagagccggggcctggggctcgccggcatcttcgacatgtgggggcacggcaccatggtgaccgtctccagc

SEQ ID NO: 9443 - RNA, 432 nt, synthetic construct
  misc_feature 1..432: note = derived and/or modified sequence opt1 from anti-HIV_cap256-119-136616_VR-Chain
  source 1..432: mol_type = other RNA
caggtgcagctggtcgagagcggcgggggcgtggtgcagcccgggcgctccctccggctgagctgcgccgcctccggcttcaccttcagccgcaacgcgatcaactgggtccggcaggccccggggcgcggcctggagtgggtggccgtgatctccgacgacggcagcctcaagtactacgccgactccgtcaaggggcggttcaccatcagccgcgacaactccaagaacacgctgtacctgcagatgaacaacctccggcccgaggacaccgccctgtactactgcgtgcgcgaccggcgcgagagcgagtgcgaggagcggtggtccgactactacgacttcggcaagcagctgccctgcgtgaagccccgcggggtcgcgggcatcttcgacatctgggggcagggcaccatggtgaccgtgagctcc

SEQ ID NO: 9444 - RNA, 432 nt, synthetic construct
  misc_feature 1..432: note = derived and/or modified sequence opt1 from anti-HIV_cap256-119-136206_VR-Chain
  source 1..432: mol_type = other RNA
caggtgcagctggtcgagagcggcgggggcgtggtgcagcccgggcgctccctccggctgagctgcgccgcctcccagttcaccttcggccgctacgggatgcactgggtccggcaggcgccgggcaagggcctggagtgggtggccgccatcagcttcgccgggaccaagaagtactacggcgactccgcccgcgggcggttcacgatcagccgcgacaactccaagaacatgctgttcctccagatgaacagcctgcgggcggaggacaccgccctctactactgcgcccgcgacctgcgggactacgagtgcgaggagtgggaggcctactactacgacttcggccgcgtggggccctgcaccgacccccggggcgtcgtgggcatcctggacgtgtgggggcagggcaccctcgtcacggtgtccagc

SEQ ID NO: 9445 - RNA, 438 nt, synthetic construct
  misc_feature 1..438: note = derived and/or modified sequence opt1 from anti-HIV_cap256-119-135565_VR-Chain
  source 1..438: mol_type = other RNA
caggtgcacctggtcgagagcggcgggggcgtggtgcagcccgggaagtccctccgcctgagctgcgccgcctcccagttcaccttcgaccggtacggcatgcactgggtccgccaggcgccggggaagggcctggagtgggtggccagcatctccaacgacggcaccgacaagtaccacgccgacaacgtgtgggggcggttcacgatcagccgcgacaactccaagaacaccctctacctggagatgaacagcctgcggggcgaggacaccgccctctacttctgcgtcaaggaccagcgcgaggacgagtgcgaggagtggtggtccgactactacgacttcgggcgggagctgccctgccgcaagagccggggcctggggctcgccggcatcttcgacatgtggggccacgggaccatggtgacggtgtccagc

SEQ ID NO: 9446 - RNA, 432 nt, synthetic construct
  misc_feature 1..432: note = derived and/or modified sequence opt1 from anti-HIV_cap256-119-135025_VR-Chain
  source 1..432: mol_type = other RNA
gaggtgcagctggtcgagagcggcgggggcctcgtgcagcccgggggctccctgcgcctgagctgcgaggcctccgggttcaccttcaacacctacgagatgaactgggtgcggcagccgcccggccgcggcctcgagtgggtcgccgggatcagcttcgcggccacgaagacctactacggcgggtccgtgaagggccggttcaccgtgagccgcgacatctccaagaacaccctgtacctgcagatggacgggctccggggcgaggacacggccctgtactactgcgccaaggacctgcgcgagctcgagtgcgaggagtgggccagcgactactacgacttcggccggccccagccctgcctggacccgcgcggggtctccggcatcagcaacgtgtgggggcagggcaccatggtgaccgtctccagc

SEQ ID NO: 9447 - RNA, 432 nt, synthetic construct
  misc_feature 1..432: note = derived and/or modified sequence opt1 from anti-HIV_cap256-119-133983_VR-Chain
  source 1..432: mol_type = other RNA
cagatgcagctggtggagagcggcgggggcgtcgtgcagcccgggcggtccctcaccctgagctgcgccgcctcccagttcaacttcgcgaactacggcatgcactgggtgcggcaggccccggggaagggcctggagtgggtcgccagcatctccaacgacggcaccaagaagtaccacgaggagagcgtgtgggggcgcttcacgatctccaaggacaacagcaagaacaccctcttcctgcagatgaactccctgcggcccgaggacaccgccctctactactgcgccaaggacctgcgcgaggacgagtgcgaggagcggtggagcgactactacgacttcggcaagcagctgccctgccgcaagtcccgcggggtggcgggcgtcttcgacaactgggggcagggcaccatggtgacggtgagctcc

SEQ ID NO: 9448 - RNA, 438 nt, synthetic construct
  misc_feature 1..438: note = derived and/or modified sequence opt1 from anti-HIV_cap256-119-133917_VR-Chain
  source 1..438: mol_type = other RNA
cagatgcagctggtggagagcggcgggggcgtcgtgcagcccgggcgctccctcaccctgagctgcgccgcctcccagttcaccttcagcaactacggcatgcactgggtgcggcaggcgccggggaagggcctggagtgggtcgcctccatcagcaacgacggctccaagaagtaccacggggacagcgtgtgggcccgcttcacgatctcccgggacaacagcaagaacaccctcttcctgcagatgtccagcctgcgcgtggaggacaccgccctctacttctgcgtccgggaccagcgcgaggacgagtgcgaggagtggtggtccgactactacgacttcggccgggagctgccctgccgcaagttccgggggctgggcctcgccgggatcttcgacatctggggccacggcaccatggtgacggtgagctcc

SEQ ID NO: 9449 - RNA, 432 nt, synthetic construct
  misc_feature 1..432: note = derived and/or modified sequence opt1 from anti-HIV_cap256-119-132663_VR-Chain
  source 1..432: mol_type = other RNA
caggcccagctggtggagagcggcgggggcgtcgtgcagcccgggcgctccctccggatcagctgcgccgtgtcccagttcaccttcagccgctacggcatgcactgggtccggcaggcgccggggaagggcctggagtgggtggcctccatcagcttcgacggccgcgacaagtaccacagccccctggtgtgggggcggctcaccatctcccgcgacaactccaagaacacgctgttcctggagatgaacagcctccgggccgaggacaccgccgtctactactgcgcccgcgacctgcgggagtccgagtgcgaggagtggcagagcgactactacgcgttctacaagaagctgccctgcgtgaagccccgcggcgtggccgggtccctcgacatctggggccaggggaccgtcgtgaccgtgagctcc

SEQ ID NO: 9450 - RNA, 438 nt, synthetic construct
  misc_feature 1..438: note = derived and/or modified sequence opt1 from anti-HIV_cap256-119-132113_VR-Chain
  source 1..438: mol_type = other RNA
caggtgcagctggtcgagagcggcgggggcctcgtgaagcccgggggctccctgcgcctgagctgcgccgcctcccagttcaacttcgcgaactacgggatgcactgggtgcggcaggccccgggcaagggcctcgagtgggtcgccagcatctccaacgacgggaccaagaagtaccacgaggagagcgtgtggggccgcttcaccatctccaaggacaacagcaagtccacgctgttcctgcagatgaacagcctccggatcgaggacaccgccctgtacttctgcgtgaaggaccagcgcgaggacgagtgcgaggagtggtggtccgactactacgacttcgggcgggagctgccctgccgcaagagccggggcctcgggctggccggcatcttcgacatgtggggccacgggaccatggtcaccgtgtccagc

SEQ ID NO: 9451 - RNA, 432 nt, synthetic construct
  misc_feature 1..432: note = derived and/or modified sequence opt1 from anti-HIV_cap256-119-131839_VR-Chain
  source 1..432: mol_type = other RNA
caggtgcagctggtcgagagcggcgggggcgtggtgcagcccgggcggtccctccggctgagctgcgccgcctccggcttcaccttcagctcctacgcgatgcactgggtccgccaggccccggggaagggcctggagtgggtggccgtgatcagctacgacggctccaacaagtactacgccgacagcgtcaaggggcggttcaccatctcccgcgacaacagcaagaacacgctctacctgcagatgaactccctgcgggccgaggacaccgcggtgtactactgcgcccgcgaccagcggtactacgagtgcgaggagtgggccagcgactactacgacttcggccgcgagcagccctgccaggacccccgcggggtggtcggcgtgttcgacatgtgggggcagggcaccatggtgaccgtctccagc

SEQ ID NO: 9452 - RNA, 435 nt, synthetic construct
  misc_feature 1..435: note = derived and/or modified sequence opt1 from anti-HIV_cap256-119-130626_VR-Chain
  source 1..435: mol_type = other RNA
gaggtgcagctggtcgagagcggcgggggcctcatccaccccgggggctgcctgcgcctgtcctgcgccgtgagcgggttcaccttctccgactacccgatgcactgggtgcggcagagccccggcaagggcctcgagtgggtcgccgtgatctcctacgacgggatcaactactactacgcggacagcgtgaagggccgcttcaccatctcccgggacaacagcaagaacaacctgttcctgcagatgaactccctccgcctggaggacacggccctgtactactgcgcccgggacctccgcgagctggactgcgaggagtggaccctgtacaactactacgacttcgggagccggggcccctgcgtcgacccccgcggggtgggcggctccttcgacgtgtgggggcagggcaccatggtcaccgtgagctcc

SEQ ID NO: 9453 - RNA, 438 nt, synthetic construct
  misc_feature 1..438: note = derived and/or modified sequence opt1 from anti-HIV_cap256-119-130191_VR-Chain
  source 1..438: mol_type = other RNA
gaggtgcagctggtcgagagcggcgggggcctcatccagcccgggcgctccctgcggctgagctgcgccgcctccggcttcaccgtgagctccaacttcatgacctgggtgcgccaggcgccggggaagggcctcgagtgggtcgccagcatctccaacgacggcacgaagaagtaccacgccgagagcgtgtgggaccggttctccatcagcaaggacaactccaagaacaccctgttcctgcagatgaacagcctccgcgtggaggacaccgccctgtacttctgcgtcaaggaccagcgggaggacgagtgcgaggagtggtggtccgactactacgacttcgggcgcgagctgccctgccgcaagagccggggcctcgggctggccggcatcttcgacatgtgggggcacggcaccatggtgacggtgtccagc

SEQ ID NO: 9454 - RNA, 438 nt, synthetic construct
  misc_feature 1..438: note = derived and/or modified sequence opt1 from anti-HIV_cap256-119-129798_VR-Chain
  source 1..438: mol_type = other RNA
caggtgcagctggtcgagagcggcgggggcgtggtgcagcccgggaagtccctccgcctgagctgcgccgcctccggcttcatcttcagctcctacttcatgcactgggtccggcaggcgccggggaagggcctggagtgggtggccgtggtcaccgacgacggcagcaagaagtactacgccgactccgtgaaggggcgcttcaccatcagccgggactactccaagaacaccctcttcctgcagatgaaccgcctgcgggtggaggacacggccctctacttctgcgtcaaggaccagcgcgaggacgagtgcgaggagtggtggagcgactactacgacttcggccgggagctgccctgccgcaagttccgggggctgggcctcgccgggatcttcgacatgtggggccacggcaccatggtgaccgtgtccagc

SEQ ID NO: 9455 - RNA, 432 nt, synthetic construct
  misc_feature 1..432: note = derived and/or modified sequence opt1 from anti-HIV_cap256-119-128745_VR-Chain
  source 1..432: mol_type = other RNA
caggtgcagctggtcgagagcggcgggggcgtggtgcagcccgggcgctccctccggctgagctgcgccgcctccggcttcaccttcagcaactacgcgatgcactgggtccgccaggccccggggaagggcctggagtgggtggcctccatcagcttcgccggcaccaagacgcactacgggaactccgtgaagggccggttcagcatctcccgcgacaacagcatcaacaccgtctacctccagatgaactccctgcgggccgaggacaccgcgctgtactactgcgccaaggacctccgcgagtacgagtgcgaggagtggaccagcgactactacgacttcgggcggccccagccctgcatcgactcccgcggcgtggtggggatcctggacatctggagccagggcacgatggtcaccgtgtccagc

SEQ ID NO: 9456 - RNA, 438 nt, synthetic construct
  misc_feature 1..438: note = derived and/or modified sequence opt1 from anti-HIV_cap256-119-128593_VR-Chain
  source 1..438: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccagcatctcctacgacggccgggacttctaccacgcccgcagcgtgtgggggcggttcaccatctcccgcgacaacagcaagaacacgctccacctccagatgaactccctgcgggtcgaggacaccgccctgtacttctgcgtgaaggaccagcgcgaggacgagtgcgaggagtggtggagcgactactacgacttcggccgggagctgccctgccgcaagtcccgggggctgggcctcgcggggatcttcgacatctggggccacggcaccatggtgaccgtcagctcc

SEQ ID NO: 9457 - RNA, 438 nt, synthetic construct
  misc_feature 1..438: note = derived and/or modified sequence opt1 from anti-HIV_cap256-119-128152_VR-Chain
  source 1..438: mol_type = other RNA
caggtgcagctggtcgagagcggcgggggcgtggtgcagcccgggcgctccctccggctgagctgcgccgtctccggcttcaccttcaccagctacccgatgcactgggtgcgccaggcccccgggaagggcctggagtgggtggcgtccgtcagcaacgacggcacgaagaagtaccacggggactccgtgtgggaccggttcaccatcagccgcgacaactccaagaacaccctcttcctgcagatgagctccctgcgggccgaggacaccgccgtgtacttctgcgtccgcgacgagcgggaggacgagtgcgaggagtggtggagcgactactacgacttcggccgcgagctcccctgccggaagttccgcgggctgggcctggccgggatcttcgacatctggggccacggcacgctcgtgaccgtgtccagc

SEQ ID NO: 9458 - RNA, 438 nt, synthetic construct
  misc_feature 1..438: note = derived and/or modified sequence opt1 from anti-HIV_cap256-119-127693_VR-Chain
  source 1..438: mol_type = other RNA
gaggtgcagctgctcgagagcggcgggggcctggtccagcccgggggctccctgcgcctcagctgcgccgcctccgggttcaccttcagctcctacgcgatggcctgggtgcggcaggccccgggcaagggcctggagtgggtggccagcatctccaacgacgggagcaagaagtaccacggcgactccgtctgggcccgcttcatcatcagccgggacaactccaagaacaccctgttcctccagatgagctccctgcgcgtggaggacacggcgctgtacttctgcgtgcgggaccaccgcgaggacgagtgcgaggagtggtggagcgactactacgacttcgggcgggagctcccctgccgcaagttccggggcctggggctggccggcatcttcgacatctggggccacgggaccatggtcaccgtgtccagc

SEQ ID NO: 9459 - RNA, 432 nt, synthetic construct
  misc_feature 1..432: note = derived and/or modified sequence opt1 from anti-HIV_cap256-119-126684_VR-Chain
  source 1..432: mol_type = other RNA
caggtgcagctggtcgagagcggcgggggcgccgtgcggcccgggcggtccctccgcctgagctgcgccacctccggcttcaccttcagcaactacgcgatgcactgggtgcggcaggccccggggaagggcctggagtgggtcacgggcatctccttcgccgggaccaagacctactacggcgacagcgtgcgcgggcggttcaccgtgtcccgcgacatcagcaagaacaccctcttcctgcagatgaactccctgcggcccgacgacacggccatgtactactgcgcccgcgaccagcggtactacgagtgcgaggagtgggcgagcgactactacgacttcggccgcgagcagccctgcctcgacccccgcggggtcgtgggcatcttcgacctgtggggccaggggaccatggtgaccgtctccagc

SEQ ID NO: 9460 - RNA, 438 nt, synthetic construct
  misc_feature 1..438: note = derived and/or modified sequence opt1 from anti-HIV_cap256-119-126056_VR-Chain
  source 1..438: mol_type = other RNA
gaggtgcagctggtcgagagcggcgggggcctcgtgcagcccgggggctccctgcgcctgagctgcgccgactccgggttcaccttcagctcctactggatgagctgggtgcggcaggccccgggcaagggcctcgagtgggtcgcgtccatcagcaacgacgggaccaagaagtaccacgccgagtccgtgtgggaccgcttcagcatctccaaggacaacagcaagaacacgctgttcctgcagatgaactccctccgggtggaggacaccgccctgtacttctgcgtcaaggaccagcgcgaggacgagtgcgaggagtggtggagcgactactacgacttcggccgggagctgccctgccgcaagtcccgggggctcggcctggccgggatcttcgacatgtggggccacggcaccatggtgaccgtgagctcc

SEQ ID NO: 9461 - RNA, 432 nt, synthetic construct
  misc_feature 1..432: note = derived and/or modified sequence opt1 from anti-HIV_cap256-119-125765_VR-Chain
  source 1..432: mol_type = other RNA
caggtgcagctggtccagagcggcgggggcgtggtgcagcccgggcgctccctccggctgagctgcgccgcctccggcttcaccttcagctcctacgtcatgcactgggtgcgccaggcgccggggaagggcctggagggcgtggccgtcatcagcttcgacgggaacaacgagtactacgccgactccgtgaagggccggttcaccatcagccgcgacaactccaagaacacggtgtacctccagatgaacagcctgcgggtcgaggacaccgccctgtactactgcgccaaggacatgcgcgagtacgagtgcgaggagtggacctccgactactacgacttcgggcggccccagccctgcatcgacagccgcggcgtggtggggatcctcgacatctggggccagggcatcatggtcaccgtgtccagc

SEQ ID NO: 9462 - RNA, 438 nt, synthetic construct
  misc_feature 1..438: note = derived and/or modified sequence opt1 from anti-HIV_cap256-119-125106_VR-Chain
  source 1..438: mol_type = other RNA
caggtgcagctggtcgagagcggcgggggcgtggtgcagcccgggcgctccctccggctgagctgcgccgcctccggcttcatcttccgcagctacgggatgcactgggtccggcaggcgccgggcaagggcctggagtgggtggcctccatcagcaacgacgggaccaagcgctaccacgccgagtccgtgtgggaccggttcagcatctccaaggacaacagcaagaacaccctcttcctgcagatgaactccctgcgcgtcgaggacacggccctctacttctgcgtgaaggaccagcgggaggacgagtgcgaggagtggtggagcgactactacgacttcggccgcgagctgccctgccggaagtcccgcgggctgggcctcgccgggatcttcgacatgtggggccacggcaccatggtgaccgtcagctcc

SEQ ID NO: 9463 - RNA, 435 nt, synthetic construct
  misc_feature 1..435: note = derived and/or modified sequence opt1 from anti-HIV_cap256-119-124026_VR-Chain
  source 1..435: mol_type = other RNA
caggtgcagctggtcgagagcggcgggggcgtggtgcagtccgggcgcagcctccggctgacctgctccggcagcgccttccgcttctccagctacaccgtccactgggtgcggcaggcccccgggaagggcctggagtggctcgcgctgatctcctacgacggccagaagaagcacttcgccgacagcgtgaaggggcgcttcacgatctcccgggacaacagcaagaacaacctgttcctccagatgaactccctgcgcctggaggacaccgccctctactactgcgcccgggacctgcgcgagctggactgcgaggagtggaccctctacaactactacgacttcggcagccgggggccgtgcgtcgacccccgcggcgtcgggggctccttcgacgtgtggggccaggggaccatggtgacggtgagctcc

SEQ ID NO: 9464 - RNA, 432 nt, synthetic construct
  misc_feature 1..432: note = derived and/or modified sequence opt1 from anti-HIV_cap256-119-121783_VR-Chain
  source 1..432: mol_type = other RNA
ctgggccgcctcgtggccagcgggggcggggtcgtgcccccgggcgggtccctgaccctgagctgcgtgacctcccagttcacgttcagcggctgcggcctccactgggtccggcaggcccccgggaagggcctggagtgggtggcgtccatcagcttcgccgggaccaagaagcactacggctccagcgtgcgcgggcggttctccatcagccgcgacaactccaagaacaccctgtacctccagatgaacagcctgcggaccgaggacacggccctgtacttctgcgccaaggacctccgcgagtacgagtgcgaggagtggacctccgactactacgacttcggccggccccagccctgcatcgacagccgcggcgtcgtggggatcctggacatctggggccaggggaccatggtgaccgtctccagc

SEQ ID NO: 9465 - RNA, 432 nt, synthetic construct
  misc_feature 1..432: note = derived and/or modified sequence opt1 from anti-HIV_cap256-119-121208_VR-Chain
  source 1..432: mol_type = other RNA
ctgggccgcctcgtggccagcgggggcggggtcgtgcccccgggcaagtccctgaccctgagctgcgtggcctcccagttcaccttcagcgggtgcggcctccactgggtccggcaggcgcccggcaaggggctggagtgggtggcctccatcagcttcgccggcacgaagaagcactacgggaacttcgtgcgcggccggttcaccatctcccgcgacaacagcaagaacaccctgtacctccagatgaactccctgcgggccgaggacaccgccctgtactactgcgcgaaggacctccgcgagtacgagtgcgaggagtggacgagcgactactacgacttcgggcggccccagccctgcatcgactcccgcggcgtcgtgggcatcctggacatctgggggcagggcaccatggtgaccgtcagctcc

SEQ ID NO: 9466 - RNA, 432 nt, synthetic construct
  misc_feature 1..432: note = derived and/or modified sequence opt1 from anti-HIV_cap256-119-120945_VR-Chain
  source 1..432: mol_type = other RNA
caggtgcagctggtcgagagcggcgggggcgtggtgcagcccgggggctccctccgcctgagctgcgtcgcctccgggttcaccttcagcaactacggcatgcactgggtgcggcaggccccgggcaaggggctggcgtgggtggccttcatccgctacgacggctccaacaagtactacgtcgacagcgtgtgggggcggttcaccatctcccgcgacaacagcaagaacacgctccacctccagatgaactccctgcggcccgaggacaccgccctgtacttctgcgcccgcgacctgcgggagagcgagtgcgaggagtgggagtcctactactacgacttcggcaacaaggggccctgcgtgaagccccgcggcgtcgtgggcgtgctggacatctgggggcagggcaccctcgtcaccgtgagctcc

SEQ ID NO: 9467 - RNA, 432 nt, synthetic construct
  misc_feature 1..432: note = derived and/or modified sequence opt1 from anti-HIV_cap256-119-118229_VR-Chain
  source 1..432: mol_type = other RNA
caggtgcaggtcgtggagagcggcgggggcgtggtccagcccgggcgctccctgcggctcagctgcgccgcctccggcttcaccttcagcaactacgcgatccactgggtgcgccaggccccggggaagggcctggagtgggtggccctgatctcctacgacggctacaacaagtactacgccgacagcgtccgggggcgcttcaccatctcccgggacaacagcaacaacacggtgtacctccagatgaactccctgaagcccgaggacaccgccgtgtactactgcgcgcgcgacctgcgggagagcgagtgcgaggagtgggagtcctactactacgacttcggcaagaaggggccctgcgtcaagccccgcggcgtggtgggggtcctcgacatctggggccagggcaccctggtgaccgtgagctcc

SEQ ID NO: 9468 - RNA, 432 nt, synthetic construct
  misc_feature 1..432: note = derived and/or modified sequence opt1 from anti-HIV_cap256-119-118025_VR-Chain
  source 1..432: mol_type = other RNA
gaggtgcagctggtcgagagcggcgggggcgtggtgcagcccgggaagtccctccggctgagctgcaccgcctcccagttcaccttcagcaacttcggcatgcactgggtccggcaggccccggggaagggcctggagtgggtggcgtccatcagcttcgtgggcatcaagacgcactacgccaactccgtccgcgggcggttcaccatcagccgcgaccagtccaagaacaccctctacctgcagatgaacagcgtgcggatcgaggacaccgcccgctacttctgcgcccgggacatgcgcgagtacgagtgcgagctgtgggcctccgactactacgacttcggcaagccccagccctgcgaggacccccgcggggtggtcggcacgttcgacatgtgggggctcggcaccctggtgaccgtgagctcc

SEQ ID NO: 9469 - RNA, 432 nt, synthetic construct
  misc_feature 1..432: note = derived and/or modified sequence opt1 from anti-HIV_cap256-119-117418_VR-Chain
  source 1..432: mol_type = other RNA
caggtgcagctggtcgagagcggcgggggcgtggtgcagcccgggcgctccctccggctgagctgcgccgcctccggcttcaacttccgcaactacgacatcaactgggtccgccaggtgccggggaagggcctggagtgggtggcggccatcagcttcgacggcgccgacaagtaccacgccgacaacgtctgggggcggctctccatcagccgggacaactccaagagcaccctgtacctgcagatgaactccctccgccccgaggacaccgccgtgtacttctgcgcgaaggacctgcgggaggacgagtgcgaggagcgctggagcgactactacgacttcggcaagcagctgccctgccggaagtcccgcggggtggccggcatcttcgacaactgggggcagggcacgatggtcaccgtgagcgcc

SEQ ID NO: 9470 - RNA, 432 nt, synthetic construct
  misc_feature 1..432: note = derived and/or modified sequence opt1 from anti-HIV_cap256-119-117250_VR-Chain
  source 1..432: mol_type = other RNA
caggtgcgcctggtcgagagcggcgggggcgtggtgcagcccgggggctccctccggctgagctgcgccgcctcccagttcaccttcagcgcgtacgggatgcactgggtccgccaggccccgggcaagggcctggagtgggtggcctccatcagcttcgacgggaccgacaagttccacgccgacaaggtgtggggccggctcgtcatctcccgcgacaacagcaagaacacgctgtacctgcagatgaactccctccggcccgaggacaccgccgtgtactactgcgcgaaggacctgcgcgaggacgagtgcgaggagcggtggagcgactactacgacttcgggaagcagctgccctgccgcaagtcccggggcgtggccggggtcttcgacaactggggccagggcaccatggtgaccgtgagctcc

SEQ ID NO: 9471 - RNA, 432 nt, synthetic construct
  misc_feature 1..432: note = derived and/or modified sequence opt1 from anti-HIV_cap256-119-117230_VR-Chain
  source 1..432: mol_type = other RNA
caggtgcagctggtcgagagcggcgggggcggggtgcagcccggccgctccctccggctgagctgcgccgcctccgggttcaccctgagctcctacggcatgcactgggtgcgccaggcgccgggcaaggggctcgagtgggtcgccagcatctccttcgacggccgggactactaccacagcccccacgtgtgggggcgcctgaccatctcccgggacaacagcaagaacacgctgtacctccagatgaactccctgcgcgccgaggacaccgccctgtactactgcgcccgggacctccgcgagagcgagtgcgaggagtgggagtccgactactacgacttcggcaagaaggggccctgcgtgaagccccggggcgtcgcgggcagcctggacatgtgggggcagggcaccatggtgatcgtgtccagc

SEQ ID NO: 9472 - RNA, 432 nt, synthetic construct
  misc_feature 1..432: note = derived and/or modified sequence opt1 from anti-HIV_cap256-119-116999_VR-Chain
  source 1..432: mol_type = other RNA
caggtgcagctggtcgagagcggcgggggcgtggtgcagcccgggacctccctccgcatcagctgcgccgcctcccagttcaccttcagccggtacggcatgcactgggtccgccaggcgccggggaagggcctggagtgggtggcctccatcagctacgacggccgggactactaccacgccgggcgcgtgtggggccggttcacgatctcccgcgacaacagcaagaacaccctgtacctccagatgaactccctgcggcccgaggacaccgccctgtacttctgcgtccgcgacagccgggagtccgagtgcgaggagtgggagagcgactactacgacttcgggaagaagctcccctgcgtgaagccccgcggcgtggtcggggtgctggacctgtggggccagggcaccctcgtgacggtctccagc

SEQ ID NO: 9473 - RNA, 432 nt, synthetic construct
  misc_feature 1..432: note = derived and/or modified sequence opt1 from anti-HIV_cap256-119-116558_VR-Chain
  source 1..432: mol_type = other RNA
caggtgcagctggtcgagagcggcgggggcgtggtgcagcccgggcgctccctccggctgagctgcgccgcctccggcttcaccttcaaccgctacagcctgcactgggtccggcaggcgccggggaagggcctcgagtgggtggccttcacctcctacgacggcagcaacaagtactaccccgactccgtgaaggggcgcttcacgatcagccgggactccagcaagaacaccctgtacctggagatgaactccctccgccccgaggacaccgccctgtactactgcgccaaggacatgcggggctacgagtgcgaggagtggaccagcgactactacgacttcgggcgcccccagccgtgcatcgactcccggggcgtcgtggggacgttcgacgtgtggggccagggcaccatggtcaccgtgagctcc

SEQ ID NO: 9474 - RNA, 432 nt, synthetic construct
  misc_feature 1..432: note = derived and/or modified sequence opt1 from anti-HIV_cap256-119-116484_VR-Chain
  source 1..432: mol_type = other RNA
gacgtgcagctgctcgagagcggcggggacctggtccagcccggcgggtccctgcggctcagctgcgccgcctccggcttcaccttcaccaagtacgagatgacgtgggtgcggcaggcgccggggaagggcctggagtgggtggccagcatctcctacgacggcagcgacaagtaccacacctccagcctgtgggggcgcttcatcgtctcccgggacaacagcaagaacaccctctacctgcagatgaactccctgcgccccgaggacaccgccctctactactgcgtgcgggaccgccgggagagcgagtgcgaggagcgctggtccgactactacgacttcggcaagcagctgccctgcgtgaagccccgcggggtcgccggcatcttcgacatctgggggcagggcacgatggtgaccgtgagctcc

SEQ ID NO: 9475 - RNA, 438 nt, synthetic construct
  misc_feature 1..438: note = derived and/or modified sequence opt1 from anti-HIV_cap256-119-114844_VR-Chain
  source 1..438: mol_type = other RNA
gaggtgcagctggtcgagagcggcggggacctcgtgcagcccggccgctccctgcggctgagctgcgccgcctccgggttcaccttcagctcctactggatgagctgggtgcgccaggcgccgggcaaggggctcgagtgggtcgcctccatcagcaacgacggcaccaagaagtaccacgaggagtccgtgtggggccggttcacgatcagcaaggacaactccaagagcaccctgttcctgcagatgaactccctccgcgtggaggacaccgccctgtacttctgcgtcaaggaccagcgggaggacgagtgcgaggagtggtggagcgactactacgacttcgggcgcgagctgccctgccggaagtcccgcggcctcgggctggccggcatcttcgacatgtgggggcacggcaccatggtgacggtgagctcc

SEQ ID NO: 9476 - RNA, 438 nt, synthetic construct
  misc_feature 1..438: note = derived and/or modified sequence opt1 from anti-HIV_cap256-119-114141_VR-Chain
  source 1..438: mol_type = other RNA
ggcgggcgcagcggcgggggcggggtgggcaccacgccccggcgcggcccgctgcggctctcctgcgccgccagcgggttcaccctggacgactacgcgatgcactgggtccgccaggcccccggcaaggggctggagtgggtggcctccatcagcaacgacggcaccaagaagtaccacgccgagtccgtgtgggaccggttcagcatctccaaggacaacagcaagaacaccctcttcctgcagatgaactccctgcgcgtcgaggacaccgccctctacttctgcgtgaaggaccagcgggaggacgagtgcgaggagtggtggagcgactactacgtgttctgggagcgcgcgccctgccggacggtccccgggcgcggcccgggctggtacttcgacatggtggggcggcgcaccatggtgaccgtctccagc

SEQ ID NO: 9477 - RNA, 432 nt, synthetic construct
  misc_feature 1..432: note = derived and/or modified sequence opt1 from anti-HIV_cap256-119-111917_VR-Chain
  source 1..432: mol_type = other RNA
gaggtgcacctggtcgagagcggcgggggcctcgtgcagcccgggggctccctgcgcctgagctgcgccgcctccgggttcaccttcagctcctacggcatgcactgggtgcggcaggcgccgggcaaggggctcgagtgggtcgccaccatcagcttcgacggcgccgacaagtaccacgccgacgacgtgtgggggcgcttctccatcagccgggacaactccaagaacacgctgtacctgcagatgaacaacctccgccccgaggacaccgccctgtactactgcgcgaaggacctgcgggaggacgagtgcgaggagcgctggagcgactactacgacttcggcaagcagctcccctgccggaagtcccgcggggtggccggcgtcttcgacaactggggccaggggaccatggtgaccgtgagctcc

SEQ ID NO: 9478 - RNA, 432 nt, synthetic construct
  misc_feature 1..432: note = derived and/or modified sequence opt1 from anti-HIV_cap256-119-111862_VR-Chain
  source 1..432: mol_type = other RNA
caggtgcagctggtcgagagcggcgggggcgtggtgcagcccgggggctccctccgcctgagctgcgccgcctccgggttcacctacagcgactacggcatgcactgggtccggcaggcgccgggcaaggggctggagtgggtggcctccatcagcttcgccggcaccaagcagcactacgggaactccgtgaagggccgcttcacgatcagccgggacaactccaagaacaccgtctacctccagatgaacagcctgcgcgtggaggacaccgccctgtactactgcgccaaggacatgcgggagtacgagtgcgaggagtggacctccgactactacgacttcgggcgcccccagccctgcatcgacagccggggcgtggtcggcatcctcgacatctgggggcagggcatcatggtgacggtgtccagc

SEQ ID NO: 9479 - RNA, 432 nt, synthetic construct
  misc_feature 1..432: note = derived and/or modified sequence opt1 from anti-HIV_cap256-119-110064_VR-Chain
  source 1..432: mol_type = other RNA
ctgggccgcctcgtggccagcgggggcggggtcgtgcccccgggccggtccctgcgcctgagctgcgtggcctcccagttcaccttcagcgggtgcggcctccactgggtccggcaggcgcccggcaaggggctggagtgggtggcctccatcagcttcgccggcaccaagcagcactacgggaactccgtgaagggccgcttcacgatcagccgggacaactccaagaacaccgtctacctgcagatgaacagcctccgcgtggaggacaccgccctgtactactgcgccaaggacatgcgggagtacgagtgcgaggagtggacctccgactactacgacttcgggcgcccccagccctgcatcgacagccggggcgtggtcggcatcctggacatctgggggcagggcacgatggtgaccgtgtccttc

SEQ ID NO: 9480 - RNA, 432 nt, synthetic construct
  misc_feature 1..432: note = derived and/or modified sequence opt1 from anti-HIV_cap256-119-109192_VR-Chain
  source 1..432: mol_type = other RNA
caggtgcagctggtcgagagcggcgggggcgtggtgcagcccgggcgctccctccggctgagctgcgccgcctccggcttcaccttcagcaactacgcgatgcactgggtccgccaggccccggggaagggcctggagtgggtggccgtgatcgcctacgacggcgacaacaagtactacgccgactccgtcaaggggcggttcaccatcagccgcgacaactccaagaacacgctctacctgcagatgaacagcctgcgggcggaggacaccgccctctactactgcgccaaggacctgcgcgaggacgagtgcgaggagtggtggtccgactactacgacctgggcaagcagctcccctgccggaagtcccgcggggtggccggcgtgctggacaagtgggggctgggcaccatggtcaccgtgagcagc

SEQ ID NO: 9481 - RNA, 435 nt, synthetic construct
  misc_feature 1..435: note = derived and/or modified sequence opt1 from anti-HIV_cap256-119-108793_VR-Chain
  source 1..435: mol_type = other RNA
cagttccagctggtggagagcggcgggggcgtcgtgcagcccgggcgctccctccggctgagctgcgccgcctccggcttcaccttcagctcctacccgatgcactgggtgcgccaggcgcccgggaagggcctggagtgggtcgccctcatcagctacgacggcaccgacaagtactacgccgactccgtgaaggggcggttcacgatcagccgcgacaactccaagaacaccctgtacctgcagatgaacagcctccgggtggaggacaccgccgtctaccactgcgccaaggacctgggcgggtccaagagcgacgagtgggcgaccgactactactacgactggtccaaggcctaccccgtgcacgacccccgcgccgtggtcggcgtgttcgacatctgggggcagggcacgctggtgaccgtcagctcc

SEQ ID NO: 9482 - RNA, 432 nt, synthetic construct
  misc_feature 1..432: note = derived and/or modified sequence opt1 from anti-HIV_cap256-119-108127_VR-Chain
  source 1..432: mol_type = other RNA
caggtgcagctggtcgagagcggcgggggcgtggtgcagcccgggcgctccctccggatcagctgcgccgcctcccagttcaccttcaaccgctacggcatgcactgggtccggcaggcgccggggaagggcctggagtgggtggccagcatctcctacgacggcagcgacaagtaccacgccgggctggtgtggggccgcttcatcatctcccgggacaacagcaagaacaccctctacctgcagatgaactccctgcgcgccgaggacacggccctctactactgcgtccgggaccgccgggagagcgagtgcgaggagcgctggtccgactactacgacttcgggaagcagctgccctgcgtgaagccccggggcgtggcggggatcttcgacatctggggccagggcaccatggtcaccgtgagctcc

SEQ ID NO: 9483 - RNA, 438 nt, synthetic construct
  misc_feature 1..438: note = derived and/or modified sequence opt1 from anti-HIV_cap256-119-107758_VR-Chain
  source 1..438: mol_type = other RNA
gaggtgcagctggtcgagagcggcgggggcctcgtgaagcccgggggctccctgcgcctgagctgcgccgcctccgggttcaccttcagcaacgcgtggatgtcctgggtgcggcaggccccgggcaagggcctcgagtgggtcgccagcatctccaacgacgggaccaagaagtaccacgaggagagcgtgtggggccgcttcacgatctccaaggacaacagcaagaacaccctgttcctgcagatgaactccctccggatcgaggacaccgccctgtacttctgcgtgaaggaccagcgcgaggacgagtgcgaggagtggtggagcgactactacgacttcgggcgggagctgccctgccgcaagtcccggggcctcgggctggccggcatcttcgacatgtggggccacgggaccatggtcacggtgagctcc

SEQ ID NO: 9484 - RNA, 432 nt, synthetic construct
  misc_feature 1..432: note = derived and/or modified sequence opt1 from anti-HIV_cap256-119-107209_VR-Chain
  source 1..432: mol_type = other RNA
gaggtgcagctggtcgagagcggcgggggcctcgtgcagcccgggcggtccctgcggctgagctgcaccgcctccggcttcaccttcggggactacggcatgcactgggtgcgccaggccccgggcaaggggctcgagtgggtcgcggccatcagcttcgacggcgccgacaagtaccacgccgacaacgtgtgggggcggctgtccatcagccgcgacaactccaagagcacgctgtacctccagatgaactccctgcggcccgaggacaccgccgtgtacttctgcgcgaaggacctgcgcgaggacgagtgcgaggagcggtggagcgactactacgacttcggcaagcagctcccctgccgcaagtcccgcggggtcgccggcatcttcgacaactggggccaggggaccatggtgaccgtgagcgcc

SEQ ID NO: 9485 - RNA, 432 nt, synthetic construct
  misc_feature 1..432: note = derived and/or modified sequence opt1 from anti-HIV_cap256-119-107184_VR-Chain
  source 1..432: mol_type = other RNA
caggcccagctggtggagagcggcgggggcgtcgtgcagcccgggcgctccctcggcctgagctgcgccgcgtccaagttcagcctgtccagctacgggatgcactgggtgcggcaggccccgggccgcggcctcgagtgggtcgccgggatctccttcgccggcaccaagaagtactacgccgacagcgtgcgggggcgcttctccgtgagcaccgacatctccaagaacacgctgtacctgcagatgaacagcctccggcccgcggacaccgccctgtacttctgcgcccgcgacctgcggtactacgagtgcgaggagtgggcctccgactactacgacttcggcaaggagcagccctgcctcgacccccgcggggtcgtgggcatcttcgacctgtggggccaggggaccatggtgaccgtcagctcc

SEQ ID NO: 9486 - RNA, 438 nt, synthetic construct
  misc_feature 1..438: note = derived and/or modified sequence opt1 from anti-HIV_cap256-119-106827_VR-Chain
  source 1..438: mol_type = other RNA
gccgtgcagctggtcgagagcggcgggggcctcgtgcagcccgggggctccctgcgcctgagctgctccgtgagccagttcaccttcgggcggtacggcatgtactgggtccgccaggccccgggcaaggggctcgagtgggtggcggtgatctcctacgacggcgggaaccggtactacgccgacagcgtcaagaaccgcttctccatcagccgggacaactccaagaacaccctgttcctgcagatgagctccctccgcgccgaggacacggccctgtacttctgcgtgcgggaccaccgcgaggacgagtgcgaggagtggtggagcgactactacgacttcggccgggagctgccctgccgcaagttccgggggctcggcctggccggcatcttcgacatctgggggcacggcaccatggtgaccgtctccagc

SEQ ID NO: 9487 - RNA, 432 nt, synthetic construct
  misc_feature 1..432: note = derived and/or modified sequence opt1 from anti-HIV_cap256-119-106511_VR-Chain
  source 1..432: mol_type = other RNA
caggtgcagctggtcgagagcggcgggggcgtggtgcagcccgggcggtccctccggctgagctgcgtcgcctcccagttcagcttcgaccgctacggcatgcactgggtgcggcaggccccggggaagggcctggagtgggtggcgtccatcagcttcgacggcaccgacaagtaccacgccgacaaggtctgggggcgcttcaccatctcccgggacaacagcaagaacacgctctacctgcagatgaactccctgcgccccgaggacaccgccctctactactgcgccaaggacatgcgggaggacgagtgcgaggcctggtggagcgactactacgacctgggcaagcagctgccctgccgcgagtcccgcggggtggcgggcatcttcgacgagtgggggcagggcaccatggtgaccgtcagctcc

SEQ ID NO: 9488 - RNA, 432 nt, synthetic construct
  misc_feature 1..432: note = derived and/or modified sequence opt1 from anti-HIV_cap256-119-106327_VR-Chain
  source 1..432: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccgccatcagcggcgggggcgggaacacctacgtggccgactccgtcaagggccggttcacgatcagccgcgacaactccaagaacaccgtgtacctccagatgaacagcctgcggctggaggacaccgcgctctactactgcgccaaggacctgcgcgagtacgagtgcgaggagtggacctccgactactacgacttcgggcggccccagccctgcatcgacagccgcggcgtggtcggcatcctggacatctgggggcagggcacgatggtgaccgtgtccagc

SEQ ID NO: 9489 - RNA, 438 nt, synthetic construct
  misc_feature 1..438: note = derived and/or modified sequence opt1 from anti-HIV_cap256-119-105486_VR-Chain
  source 1..438: mol_type = other RNA
caggtgcagctggtcgagagcggcgggggcgtggtgcagcccgggggctccctccgcctgagctgcgccgcctccgggttcaccgtcagcggctacggcatgcactgggtgcggcaggcgccggccaaggggctggactgggtggccttcatctcccacgacggcagcaacaagtactacgccgactccgtccgcgggcggttcatcatcagccgcgacaactccaacaacaccctctacgtgcagatgagctccctgcgggccgaggacacggcgctgtacttctgcgtgcgcgaccaccgggaggacgagtgcgaggagtggtggagcgactactacgacttcggccgcgagctcccctgccggaagttccgcgggctgggcctggccggcatcttcgacatctgggggcacggcaccatggtcaccgtgtccagc

SEQ ID NO: 9490 - RNA, 432 nt, synthetic construct
  misc_feature 1..432: note = derived and/or modified sequence opt1 from anti-HIV_cap256-119-105197_VR-Chain
  source 1..432: mol_type = other RNA
caggtgcagctggtcgagagcggcgggggcgtggtgcagcccgggcggtccctccggctgagctgcgccgtctcccagttcaccttcggccgctacgggatgcactgggtgcggcaggccccgggcaagggcctggagtgggtggggagcatctcctacgacggcagcgacaagtaccacaccaactccctctgggggcgcttcatcgtcagccgggacaactccaagaacacgctgtacctgcagatgaacaacctccgccccgaggacaccgcgctgtactactgcgtgcgggaccgccgggagagcgagtgcgaggagcgctggtccgactactacgacttcggcaagcagctgccctgcgtgaagccccgcggggtcgtgggcgtgctcgacatctggggccaggggaccctggtcaccgtgagctcc

SEQ ID NO: 9491 - RNA, 432 nt, synthetic construct
  misc_feature 1..432: note = derived and/or modified sequence opt1 from anti-HIV_cap256-119-104946_VR-Chain
  source 1..432: mol_type = other RNA
caggagcagctggtggagagcggcgggggcgtcgtgcagcccgggcgctccctccggctgagctgcgtggcctcccgcttcaccttcagcgccttcggcatgcactgggtccggcaggcgccggggaagggcctggagtgggtggcctccatcagcttcgccggcatcaagaagtactacggggactccgtgaagggccgcttcaccatcagccgggacaactccaagaacacgctctacctgcagatggacgggctgcgcggcgaggacaccgccctctactactgcgccaaggacctgcgggagctggagtgcgaggagtgggcgagcgactactacgacttcgggcgcccccagccctgcatcgactcccggggcgtcgtgggcatcctcgacatctgggggcagggcatcatggtgaccgtcagctcc

SEQ ID NO: 9492 - RNA, 432 nt, synthetic construct
  misc_feature 1..432: note = derived and/or modified sequence opt1 from anti-HIV_cap256-119-103667_VR-Chain
  source 1..432: mol_type = other RNA
caggtgcacctggtcgagagcggcgggggcgtggtgcagcccgggaagtccctccgcctgagctgcgccgcctcccagttcaccttcaaccggttcggcatgcactgggtccgccaggcgccggggaagggcctggagtgggtggccggcatcagctacgacgggtccgacaagtaccacgccgacaaggtgtggggccggttcaccatcagccgcgacaactccaagaacacgctctacctgcagatgaacagcctgcgggccgaggacaccgccctctactactgcgcgaaggacctgcgcgaggacgagtgcgaggagtgggcctccgactactacgacttcgggaaggagcagccctgcctggacccccggggcgtcgtggggatcttcgacatctggggccagggcaccatggtgaccgtcagctcc

SEQ ID NO: 9493 - RNA, 438 nt, synthetic construct
  misc_feature 1..438: note = derived and/or modified sequence opt1 from anti-HIV_cap256-119-103385_VR-Chain
  source 1..438: mol_type = other RNA
gaggtgcagctggtcgagagcggcgggggcctcgtgcagaccgggggctccctgcgcctgagctgcgccgcctccgggttcaccttcagccggtacgacatgaactgggtgcgccaggcgcccggcaagggcctcgagtgggtcgcctccatcagcaacgacgggtccaagaagtaccacggcgacagcgtgtgggcccggttcacgatctcccgcgacaacagcaagaacaccctgttcctgcagatgtccagcctccgggtggaggacaccgccctgtacttctgcgtccgcgaccagcgggaggacgagtgcgaggagtggtggtccgactactacgacttcgggcgcgagctgccgtgccggaagttccgcggcctcgggctggccggcatcttcgacatctggggccacgggaccatggtgacggtgagctcc

SEQ ID NO: 9494 - RNA, 438 nt, synthetic construct
  misc_feature 1..438: note = derived and/or modified sequence opt1 from anti-HIV_cap256-119-103267_VR-Chain
  source 1..438: mol_type = other RNA
gaggtgcccagcgtcgagtccggcgggggcctggtgcagaccgggggcagcctcaccctgtcctgcgccgccagccagttcacgttctccaactacgggatgcactgggtgcgccaggcgccgggcaagggcctggagtgggtcgccagcatctccaacgacgggagcaagaagtaccacggcgactccgtgtgggcccggttcatcatcagccgcgacaactccaagaacaccctcttcctgcagatgagctccctgcgggccgaggacaccgccctctacttctgcgtgcgcgaccaccgggaggacgagtgcgaggagtggtggagcgactactacgacttcgggcgcgagctgccctgccggaagttccgcggcctggggctcgcgggcatcttcgacatctggggccacgggaccatggtcacggtgtccagc

SEQ ID NO: 9495 - RNA, 432 nt, synthetic construct
  misc_feature 1..432: note = derived and/or modified sequence opt1 from anti-HIV_cap256-119-103011_VR-Chain
  source 1..432: mol_type = other RNA
caggtgcagctggtcgagagcggcgggggcgtggtgcagcccgggggctccctccgcctgagctgcgccacctccgggttcaccttcggcacgttcggcatgcactgggtccggcaggccccggggaagggcctggactgggtggcggccatcagcttcgccgggaccaagaagaactacgccgactccgtgcgcggccggttcaccatcagccgcgactccagcaagaacaccctctacctgcagatgaactccctgcggcccgaggacacggccctctactactgcgtcaaggacatgcgcgggtacgagtgcgaggagtggaccagcgactactacgacttcggccggccccagccctgcatcgactcccgcggcgtggtggggaccttcgacgtctggggccaggggaccatggtgacggtgagctcc

SEQ ID NO: 9496 - RNA, 438 nt, synthetic construct
  misc_feature 1..438: note = derived and/or modified sequence opt1 from anti-HIV_cap256-119-102072_VR-Chain
  source 1..438: mol_type = other RNA
gaggtgcagctggtcgagagcggcgggggcctcgtgcagcccgggggctccctgcgcgtgagctgcgccgtctccgggttcaccttcagcaactacgagatgaactgggtgcggcaggccccgggcaagggcctggagtgggtggcgtccatcagcaacgacgggaccaagaagtaccacgccgagtccgtctgggaccgcttcagcatctccaaggacaacagcaagaacaccctcttcctgcagatgaactccctgcgggtggaggacacggccctctacttctgcgtgaaggaccagcgcgaggacgagtgcgaggagtggtggagcgactactacgacttcggccgggagctgccctgccgcaagtcccgggggctgggcctcgccgggatcttcgacatctggggccacggcaccatggtcaccgtgagctcc

SEQ ID NO: 9497 - RNA, 438 nt, synthetic construct
  misc_feature 1..438: note = derived and/or modified sequence opt1 from anti-HIV_cap256-119-101945_VR-Chain
  source 1..438: mol_type = other RNA
gaggtgcagctggtcgagagcggcgggggcctcgtgcagcccgggggctccctgcgcctgagctgcgccgcctccgggttcaccttcagctcctacgtgatgcactgggtccggcaggcgccgggcaagggcctcgagtgggtggccagcatctccaacgacgggaccaagaagtaccacgaggagagcgtgtggggccgcttcacgatctccaaggacaacagcaagaacaccctgttcctgcagatgaactccctccggatcgaggacaccgccctgtacttctgcgtcaaggaccagcgcgaggacgagtgcgaggagtggtggagcgactactacgacttcgggcgggagctgccctgccgcaagtcccggggcctcgggctggccggcatcttcgacatgtggggccacgggaccatggtgacggtgagctcc

SEQ ID NO: 9498 - RNA, 432 nt, synthetic construct
  misc_feature 1..432: note = derived and/or modified sequence opt1 from anti-HIV_cap256-119-101319_VR-Chain
  source 1..432: mol_type = other RNA
caggtgcagctggtcgagagcggcgggggcgtggtgcagcccgggaagtccctccgcctgagctgcgtcggctccgggttcaccttcgacgactacggcatgcactgggtgcggcaggccccgggcaaggggctggagtgggtggccagcatctcctacgacggccgcgacttctaccacgcgcggagcgtctgggggcgcttcaccatctcccgggacaacagcaagaacacgctccacctccagatgaactccctgcgccccgaggacaccgccctgtacttctgcgcccgggacctgcgcgagagcgagtgcgaggagtgggagtcctactactacgacttcggcaagaaggggccctgcgtgaagccccggggcgtggtcggcgtgctggacatctgggggcagggcaccctcgtgaccgtcagctcc

SEQ ID NO: 9499 - RNA, 432 nt, synthetic construct
  misc_feature 1..432: note = derived and/or modified sequence opt1 from anti-HIV_cap256-119-100871_VR-Chain
  source 1..432: mol_type = other RNA
caggtgcagctggtcgagagcggcgggggcgtggtgcagcccggggagtccctccggatcagctgcgccgcctcccagttcaccttcagccggtacggcatgcactgggtccgccaggcgccggggaagggcctggagtgggtggcctccatcagcttcgacggccgggacaagtaccactccagcctggtgtgggggcgcctcaccatctcccgggacaacagcaagtccacgctgttcctgcagatgaacagcctccgcgccgaggacaccgccctgtactactgcgcccgggacctgcgcgagtccgagtgcgaggagtgggagagcgactactacgacttcggcaagccccagccctgcgaggacccccgcggggtcgtgggcaccttcgacatgtgggggctcggcaccctggtgacggtctccagc

SEQ ID NO: 9500 - RNA, 432 nt, synthetic construct
  misc_feature 1..432: note = derived and/or modified sequence opt1 from anti-HIV_cap256-119-100838_VR-Chain
  source 1..432: mol_type = other RNA
gaggtgcagctggtcgagagcggcgggggcgtggtgcagcccgggggctccctccgcctgagctgcgccgcctccgggttcaccttcagctcctacggcatgcactgggtccggcaggcgccgggcaaggggctggagtgggtggccttcatccgctacgacggcagcaacaagtactacgccgactccgtgaaggggcggttcaccatcagccgcgacaactccaaccacacgctctacatgcagctggacagcctgcgggccgaggacaccgccctctactactgcgcgaaggacctgcgcgagtacgagtgcgaggagtggacctccgactactacgacttcggccggccccagccctgcatcgacagccgcggggtcgtgggcatcctggacatctggtcccagggcaccatggtgacggtcagctcc

SEQ ID NO: 9501 - RNA, 438 nt, synthetic construct
  misc_feature 1..438: note = derived and/or modified sequence opt1 from anti-HIV_cap256-119-100025_VR-Chain
  source 1..438: mol_type = other RNA
caggtgcagctggtcgagagcggcgggggcgtggtgcagcccgggcgctccctccggctgagctgcgccgcctccgtcttcaccttcagctactacggcatgcactgggtgcgccaggcgccggggaagggcctggagtgggtggccttcatctcccacgacggcagcaacaagtactacgccgactccgtccgggggcgcttcatcatcagccgggacaactccaacaacaccctctacgtgcagatgaacagcctgcgcgccgaggacacggccctgtacttctgcgtgaaggaccagcgggaggacgagtgcgaggagtggtggtccgactactacgacttcggccgcgagctcccctgccggaagttccgcgggctgggcctggcggggaccttcgacatctggggccacggcaccatgctcatcgtcagctcc

SEQ ID NO: 9502 - RNA, 432 nt, synthetic construct
  misc_feature 1..432: note = derived and/or modified sequence opt1 from anti-HIV_cap256-119-100000_VR-Chain
  source 1..432: mol_type = other RNA
cagatgcagctggtggagagcggcgggggcgtcgtgcagcccgggcggtccctcaccctgagctgcgccgcctcccagttcaccttcagcaactacggcatgcactgggtgcggcaggcgccggggaagggcctggagtgggtcgcctccatcagcaacgacggcaacaagaagtaccacggggactccgtgtgggcccgcttcacgatcagccgggacaactccaagaacaccctcttcctgcagatgagctccctgcgcaccgaggacaccgccctctacttctgcgtgcgggaccgccgggagagcgagtgcgaggagcgctggtccgactactacgacttcggcaagcagctgccctgcgtcaagccccgcggggtggccggcatcttcgacatctgggggcagggcacgatggtgaccgtcagctcc

SEQ ID NO: 9503 - RNA, 432 nt, synthetic construct
  misc_feature 1..432: note = derived and/or modified sequence opt1 from anti-HIV_cap256-119-098890_VR-Chain
  source 1..432: mol_type = other RNA
caggtgcagctggtcgagagcggcgggggcgtggtgcagcccggggagtccctccgcatcagctgcgtcgcctcccagttcaccttcggccggtacgggatgcactgggtgcgccaggccccgggcaagggcctggagtgggtggcgagcatctccttcgacgggcgggacaagtaccacagccccctggtctggggccgcctcaccatctcccgggacaacagcaagaacacgctgttcctgcagatgaactccctccgcaccgaggacaccgccctgtactactgcgcccgggacctgcgcgagagcgagtgcgaggagtgggagtccgactactacgccttctggcggaagctcccctgcgtgaagccccgcggggtggccggcaccctggacatctgggggcagggcacgatggtcagcgtgtccagc

SEQ ID NO: 9504 - RNA, 435 nt, synthetic construct
  misc_feature 1..435: note = derived and/or modified sequence opt1 from anti-HIV_cap256-119-098715_VR-Chain
  source 1..435: mol_type = other RNA
caggtgcagctggtcgagagcggcgggggcgtggtgcagcccgggcgctccctccggctgagctgcgccgcctccggcttcagcttcaacaaccacgggatgcactgggtccgccaggcgccgggcaagggcctggagtgggtggccgggatctccttcgccggcatcaagaagtactacgggaccagcgtgaagggccggttcaccatctcccgcgacaacagcaagaacaacctcttcctgcagatgaactccctgcgggtcgaggacacggccctctactactgcgcccgcgacctgcgggagatggagtgcgaggagtggaccctgtacaactactacgacttcgggagccgcggcccctgcgtggacccccggggcgtggtcgggtccttcgacgtgtggggccaggggaccatggtgaccgtcagctcc

SEQ ID NO: 9505 - RNA, 438 nt, synthetic construct
  misc_feature 1..438: note = derived and/or modified sequence opt1 from anti-HIV_cap256-119-098632_VR-Chain
  source 1..438: mol_type = other RNA
cagatgcagctggtggagagcggcgggggcgtcgtgcagcccgggcgctccctcaccctgagctgcgccgcctcccagttcaacttcgcgaactacgacatgcactgggtgcggcaggccccgggcaaggggctggagtgggtcgccttcatccgctacgacggcaacaacaagtactacgccgacagcgtgaagggccggttcaccatctcccgcgacaacagcaagtccaccctcttcctgcagatgaacagcctgcggatcgaggacacggccctctacttctgcgtgaaggaccagcgcgaggacgagtgcgaggagtggtggtccgactactacgacttcgggcgggagctgccctgccgcaagagccggggcctggggctcgcgggcatcttcgacatgtgggggcacggcaccatggtcaccgtgtccagc

SEQ ID NO: 9506 - RNA, 432 nt, synthetic construct
  misc_feature 1..432: note = derived and/or modified sequence opt1 from anti-HIV_cap256-119-097199_VR-Chain
  source 1..432: mol_type = other RNA
caggtgcagctggtcgagagcggcgggggcgtggtgcagcccgggcgctccctccggctgagctgcgccgcctccggcttcgcgttcagctcctacgccttccactgggtccgccaggccccggggaagggcctggagtgggtggcctacatccccttccacggcaaccagcagtactacggggacagcgtgaagggccggttcaccatctcccgcgacaacagccgggacaccctcttcctggagatgaactccctgcgccccgaggacacggccctctacttctgcgcgcgggaccagcgctactacgagtgcgaggagtgggccagcgactactacgacttcgggcgggagcagccctgcctggacccgcgcggcgtcgtggggatcttcgacctgtggggccagggcaccatggtgaccgtctccagc

SEQ ID NO: 9507 - RNA, 432 nt, synthetic construct
  misc_feature 1..432: note = derived and/or modified sequence opt1 from anti-HIV_cap256-119-096189_VR-Chain
  source 1..432: mol_type = other RNA
caggtgcagctggtcgagagcggcgggggcgtggtgcagcccgggcgctccctccggctgagctgcgccgcctccggcttcaagttcgggagcttcggcatgcactgggtccgccaggcgccgggcaaggggctggagtgggtggccgtgatctcctacgacggcagcgacaagtactacgggtccagcgtccggggccgcttctccatcagccgggacaactccaagaacaccctctacctgcagatgaacagcctgcgcaccgaggacacggccctctacttctgcgccaaggacctgcgggagtacgagtgcgaggagtggacctccgactactacgacttcgggcgcccccagccctgcatcgacagccggggcgtggtgggcatcctggacatctgggggcagggcaccatggtcaccgtgtccagc

SEQ ID NO: 9508 - RNA, 432 nt, synthetic construct
  misc_feature 1..432: note = derived and/or modified sequence opt1 from anti-HIV_cap256-119-094581_VR-Chain
  source 1..432: mol_type = other RNA
caggtgcacctggtcgagagcggcgggggcgtggtgcagcccgggcgctccctccggctgagctgcgccgcctccggcttcaacttcagcaactacgcgatccactgggtccgccagaccccggggaagggcctggagtgggtgaccctcatctccaacgacggcagcaacaagtactacgccgactccctgaaggggcggttcacgatcagccgcgacaactccaagaacaccctgtacctccagatgaacagcctgcgggccgaggacaccgccctgtactactgcgccaaggacctccgcgaggacgagtgcgaggagtggtggtccgactactacgacttcggcaagcagctgccctgccggaagtcccgcggggtggcgggcatcttcgacgggtggggccagggcaccatggtcacggtgagcagc

SEQ ID NO: 9509 - RNA, 432 nt, synthetic construct
  misc_feature 1..432: note = derived and/or modified sequence opt1 from anti-HIV_cap256-119-094200_VR-Chain
  source 1..432: mol_type = other RNA
gaggtgcagctggtcgagagcggcgggggcctcgtgcagcccgggggctccctgcggctgagctgcgccgcctccgggttcatcttcagctcctacgcgctccactgggtgcggcaggccccgggcaagggcctggagtgggtcgccagcatctccttcgccgggaccaagaaccactacggcaacagcgtgaaggggcgcttcaccatctcccgggacaacagcaagaacacggtgtacctgcagatgaactccctccgcgccgaggacaccgcgctgtactactgcgccaaggacctgcgggagtacgagtgcgaggagtggaccagcgactactacgacttcggccgcccccagccctgcatcgactcccgcggggtcgtgggcatcctcgacatctggagccagggcaccatggtgacggtctccagc

SEQ ID NO: 9510 - RNA, 432 nt, synthetic construct
  misc_feature 1..432: note = derived and/or modified sequence opt1 from anti-HIV_cap256-119-094158_VR-Chain
  source 1..432: mol_type = other RNA
cagatgcagctggtggagagcggcgggggcgtcgtgcagcccgggtccagcctcaccctgtcctgcgccgccagccagttcaccttctccaactacggcatgcactgggtgcgccaggcgccggggaagggcctggagtgggtcgccagcatctccaacgacggcacgaagaagtaccacggggacagcgtgtgggaccggttcaccatctcccgcgacaacagcaagaacaccctcttcctgcagatgaactccctgcgggccgaggacaccgccctctacttctgcgtgaaggaccagcgcgaggacgagtgcgaggagtggtggagcgactactacgacttcggcaagcagctgccctgccggaagtcccgcggggtcgccggcatcttcgacagctgggggcagggcacgatggtgaccgtgtccagc

SEQ ID NO: 9511 - RNA, 432 nt, synthetic construct
  misc_feature 1..432: note = derived and/or modified sequence opt1 from anti-HIV_cap256-119-092814_VR-Chain
  source 1..432: mol_type = other RNA
caggtgcagctggtcgagttcggcgggggcgtggtgcagcccgggggcagcctccggctgtcctgcgccgccagcgggttctacttcaccgactacggcatgcactgggtccggcaggcgccgggcgaggggctgcagtgggtggccttcatctcctacgacggcaacaccaagacgaccgccgacagcgtgcgcgggcggttcaccctctcccgcgacaacagcaagaacaccctgtacctgcagatgaactccgtccgggtggaggacacggcccgctacttctgcgcccgggacatgcgcgagtacgagtgcgagctctgggcgagcgactactacgacttcggcaagccccagccctgcgaggacccccgcggggtggtcggcaccttcgacatgtggggcctggggaccctggtgaccgtgtccagc

SEQ ID NO: 9512 - RNA, 432 nt, synthetic construct
  misc_feature 1..432: note = derived and/or modified sequence opt1 from anti-HIV_cap256-119-092808_VR-Chain
  source 1..432: mol_type = other RNA
caggtgcagctggtcgagagcggcgggggcgtggtgcagcccgggcgctccctccggctgagctgcgccgcctcccagttcagcttcggcaactacgggatgcactgggtccgccaggcgccgggcaagggcctggagtgggtggccgccatctccttcgccgggaccaagaccaactacgccgacagcgtgaagggccggttcacgatctcccgcgacaacagcaagaacaccgtctacctccagatgaactccctgcgggcggaggacaccgccctgtacttctgcgccaaggacatccgcgagtacgagtgcgagtactggaccagcgactactacgacttcgggcggccccagccctgcatcgactcccgcggcgtggtggggacgttcgacgtctggggccagggcaccatggtgaccgtgagctcc

SEQ ID NO: 9513 - RNA, 432 nt, synthetic construct
  misc_feature 1..432: note = derived and/or modified sequence opt1 from anti-HIV_cap256-119-092573_VR-Chain
  source 1..432: mol_type = other RNA
caggagcagctggtggagagcggcgggggcgtcgtgcagcccgggacctccctccgcctgagctgctccgccagcggcttcaccttctccaacttcgccatgaactgggtgcggcaggcgccggggaagggcctggagtgggtcagcttcatctccagcgacggcaagaacaagaactacgtggactccgtgaaggggcgcttcacgatcagccgggacaactacaagaacaccctctacctgcagatgaactccctgcgcaccgaggacaccgccgtctactactgcgccaaggacctcggcgggacgaaggacgacgagtgggccaccgactactacgactggagcaccgcctaccccgtgcaggacccccgggcggtggccggcgggttcgacctgtggggcctgggcaccatggtcacggtgtccagc

SEQ ID NO: 9514 - RNA, 432 nt, synthetic construct
  misc_feature 1..432: note = derived and/or modified sequence opt1 from anti-HIV_cap256-119-090815_VR-Chain
  source 1..432: mol_type = other RNA
caggtgcagctggtcgagagcggcgggggcgtggtggagcccgggcggtccctccggctgagctgcgccgcctcccagttcagcttctccagctacggcatgcactgggtccgccaggcgccggggaagggcctggagtgggtggccgccatctccttcgacggcgccgacaagtaccacgccgacaacgtgtgggggcggctcagcatctcccgcgacaacagcaagtccaccctgtacctgcagatgaacagcctccggcccgaggacaccgcggtctacttctgcgccaaggacctgcgcgaggacgagtgcgaggagcggtggtccgactactacgacttcggcaagcagctgccctgccgcaagagccgcggggtggccggcatcttcgacaactgggggcagggcacgatggtgaccgtctccgcc

SEQ ID NO: 9515 - RNA, 438 nt, synthetic construct
  misc_feature 1..438: note = derived and/or modified sequence opt1 from anti-HIV_cap256-119-090368_VR-Chain
  source 1..438: mol_type = other RNA
caggtgcagctggtcgagagcggcgggggcgtggtgcagcccgggcgctccctccggctgagctgcgccgcctccggcttcgcgttcagccactacgggatcttctgggtccgccaggccccgggcaagggcctggagtgggtggcctccatcagcaacgacgggaccaagaagtaccacgccgagtccgtgtgggaccggttcagcatctccaaggacaacagcaagaacaccctcttcctgcagatgaactccctgcgcgtcgaggacacggccctctacttctgcgtgaaggaccagcgggaggacgagtgcgaggagtggtggagcgactactacgacttcggccgcgagctgccctgccggaagtcccgcgggctgggcctcgcggggatcttcgacatgtggggccacggcaccatggtgaccgtcagctcc

SEQ ID NO: 9516 - RNA, 432 nt, synthetic construct
  misc_feature 1..432: note = derived and/or modified sequence opt1 from anti-HIV_cap256-119-089710_VR-Chain
  source 1..432: mol_type = other RNA
caggtgcagctggtcgagagcggcgggggcgtggtgcagcccgggcgctccctccggctgagctgcaccgcctccggcttcgggttcagcaactacgccatgcactgggtccgcctggcgccgggcaagggcctcgagtgggtggcctccatcagctacgacgggcgggactaccaccacgccggcgccgtgtgggggcgcttcatcatctcccgggacaacagcaagaactccctgcacctccagatgaacagcctgcgccccgaggacaccgccctgtacttctgcgcgcgggacctgcgcgagtccgagtgcgaggagtgggagagcgactactacaacttctggaagaagctcccctgcgtcaagccccggggcgtggtggggatcctggacatctggggccagggcacggtcgtgaccgtgtccagc

SEQ ID NO: 9517 - RNA, 432 nt, synthetic construct
  misc_feature 1..432: note = derived and/or modified sequence opt1 from anti-HIV_cap256-119-088555_VR-Chain
  source 1..432: mol_type = other RNA
caggtgcagctggtcgagagcggcgggggcgtggtgcaggccgggcgctccctccggctgagctgcgccgcgtcccagttcaccttcagccgctacggcatgcactgggtccggcaggcccccgggaagggcctggagtgggtggccggcatctcctacgacgggcgcgacaagtaccacgcccacttcgtgtggggccggttcatcatcagccgcgacaactccaagaacaccctctacctgcagatgaacagcctgcgggccgaggacacggcgctctactactgcgtccgcgacctgcgggagtccgagtgcgagctgtgggagagcgactactacgacttcgggaagcgcctcccgtgcgtgaagccccggggcgtggccgggaccttcgacctgtggggccagggcaccatggtcaccgtgtccagc

SEQ ID NO: 9518 - RNA, 432 nt, synthetic construct
  misc_feature 1..432: note = derived and/or modified sequence opt1 from anti-HIV_cap256-119-087962_VR-Chain
  source 1..432: mol_type = other RNA
gagatgcagctggtggagagcggcgggggcctcgtcaagcccgggcggtccctgcggctgagctgcgccgcctccggcttcaccttcagctcctacgcgatccactgggtgcgccaggccccggggaagggcctcgagtgggtggccgtcatcagctacgacggctccaacaagtactacgccgacagcgtgaaggggcggttcaccatctcccgcgacaacagcaagaacacggtgtacctgcagatgaactccctgcgggtcgaggacaccgccctctactactgcgcgaaggacctgcgcgagtacgagtgcgaggagtggaccagcgactactacgacttcggcaagccccagccctgcatcgactcccgcggggtggtgggcatcctggacatctgggggcagggcatcatggtcaccgtgagctcc

SEQ ID NO: 9519 - RNA, 432 nt, synthetic construct
  misc_feature 1..432: note = derived and/or modified sequence opt1 from anti-HIV_cap256-119-086903_VR-Chain
  source 1..432: mol_type = other RNA
caggtgcacctggtcgagagcggcgggggcgtggtgcagcccgggaagtccctccgcctgagctgcgccgcctcccagttcaccttcgaccggtacggcatgcactgggtccgccaggcgccggggaagggcctggagtgggtggccagcatctccaacgacggcaccgacaagtaccacgccgacaacgtgtgggggcggttcacgatcagccgcgacaactccaagaacaccctctacctggagatgaacagcctgcggggcgaggacaccgccctctactactgcgccaaggacatgcgcgaggacgagtgcgaggagtggtggtccgactactacgacttcgggcggccccagccctgcatcgacagccgcggcgtcgtggggaccttccacgtgtggggccagggcacgatggtcaccgtgtccagc

SEQ ID NO: 9520 - RNA, 432 nt, synthetic construct
  misc_feature 1..432: note = derived and/or modified sequence opt1 from anti-HIV_cap256-119-086804_VR-Chain
  source 1..432: mol_type = other RNA
gaggtgcagctggtcgagagcggcgggggcgtggtgcagcccgggcgctccctccggctgttctgcgccggcagcgggttcaccttctccagctacggcctgcactgggtccgccaggccccgggcaaggggctcgagtgggtgtccttcatcagctacgacggctccaccacgaagtacgcggacagcctgaaggggcggttcaccgtgtcccgcgacaacagcaagaacaccgtctacctggagatgaactccctccgggccgaggacaccgccctgtactactgcgccaaggacctgcgcgagtacgagtgcgaggagtggacgagcgactactacgacttcggccggccccagccctgcatcgactcccgcggggtggtgggcatcctcgacatctggggccaggggaccatggtcaccgtgagctcc

SEQ ID NO: 9521 - RNA, 432 nt, synthetic construct
  misc_feature 1..432: note = derived and/or modified sequence opt1 from anti-HIV_cap256-119-085910_VR-Chain
  source 1..432: mol_type = other RNA
gaggtgcagctgctcgagagcggcgggggcctggtccagcccgggggctccctgcgcctcagctgcgccgcctccgggttcaccttcagctcctacggcatgcactgggtgcggcaggcggccggcaaggggctggagtgggtggccagcatctcctacgacggccgcgactaccaccacgccggggccgtctggggccggttcatcatcagccgcgacaactccaagaacagcctgcacctccagatgaactccctgcggccggaggacaccgcgctgtacttctgcgcccgcgacctccgggagagcgagtgcgaggagtgggagtccgactactacaacttctggaagaagctgccctgcgtgaagccccgcggggtggtcggcatcctggacatctggggccaggggacggtggtgaccgtcagctcc

SEQ ID NO: 9522 - RNA, 432 nt, synthetic construct
  misc_feature 1..432: note = derived and/or modified sequence opt1 from anti-HIV_cap256-119-085772_VR-Chain
  source 1..432: mol_type = other RNA
gaggtgcggctggtcgagagcggcgggggcctcatccagcccgggggctccctgcggctgagctgcgccgcctccgggctcaccgtgagctccaaccacatgagctgggtgcgccaggcgccgggcaagggcctggagtgggtcgccgtgatctcctacgacgggagcaacaccttctacggcgactccgtgaaggggcggttcacggtcagccgcgacatctccaagaacaccctgtacctccagatgaacagcctgcggcccgaggacaccgccatgtactactgcgcccgcgaccagcggtactacgagtgcgaggagtgggcctccgactactacgacttcggccgcgagcagccctgccaggacccccgcggggtggtgggcgtcttcgacatgtggggccaggggaccatggtgacggtgagctcc

SEQ ID NO: 9523 - RNA, 432 nt, synthetic construct
  misc_feature 1..432: note = derived and/or modified sequence opt1 from anti-HIV_cap256-119-084603_VR-Chain
  source 1..432: mol_type = other RNA
caggtgcagctggtcgagagcggcgggggcgtggtgcagtccgggcgcagcctccggctgtcctgcgccgccagcggcttccccttctccgacttcgcgatgcactgggtccgccaggccccggggaagggcctggagtgggtggccagcatctccttcgtgggcatcaagacccactacgccaacagcgtccgggggcgcttcaccatctcccgggaccagagcaagaacacgctctacctgcagatgaactccgtgcgcgtggaggacaccggccggtactactgcgcccgcgacatgcgggagtacgagtgcgagctgtgggcgagcgactactacgacttcgggaagccccagccctgcgaggacccccgcggcgtcgtggggaccttcgacatgtggggcctcggcaccctggtgacggtctccagc

SEQ ID NO: 9524 - RNA, 432 nt, synthetic construct
  misc_feature 1..432: note = derived and/or modified sequence opt1 from anti-HIV_cap256-119-084276_VR-Chain
  source 1..432: mol_type = other RNA
caggtgcagctggtcgagagcggcgggggcgtggtgcagcccgggcgctccctccggctgagctgcgccgcctcccgcttcaccttcagctcctacgcgatgcactgggtccggcaggccccgggcaaggggctggagtgggtggccgtgatctggtacgacggcagcaacaagtactacgccgactccgtccgcggccggttcagcgtgtccaccgacatcagcaagaacacgctctacctgcagatgaactccctgcgccccgccgacaccgcgctctacttctgcgcccgggacctgcgctactacgagtgcgaggagtgggccagcgactactacgacttcgggaaggagcagccctgcctggacccccggggcgtggtcgggatcttcgacctctggggccaggggaccatggtgaccgtgtccagc

SEQ ID NO: 9525 - RNA, 432 nt, synthetic construct
  misc_feature 1..432: note = derived and/or modified sequence opt1 from anti-HIV_cap256-119-082288_VR-Chain
  source 1..432: mol_type = other RNA
caggtgtacctggtcgagagcggcgggggcgtggtgcagcccgggcggtccctccggctgagctccgccgccagccacttctccctgagctcctacggcatgcactgggtccgccaggcgccggggaagggcctcgagtgggtggccggcatcagcttcgccgggaccaagacctactacggcgactccgtgaaggggcggttcacggtcagcaccgacatctccaagaacaccctgtacctccaggtgaacagcctgcgccccgaggacaccgccatgtactactgcgcccgggaccagcgctactacgagtgcgaggagtgggcgtccgactactacgacttcggcaaggagcagccctgcctggacccccgcggggtggtcggcatcttcgacatctggggccaggggacgatggtgaccgtgagctcc

SEQ ID NO: 9526 - RNA, 432 nt, synthetic construct
  misc_feature 1..432: note = derived and/or modified sequence opt1 from anti-HIV_cap256-119-080383_VR-Chain
  source 1..432: mol_type = other RNA
caggtgcagctggtcgagagcggcgggggcgtggtgcagcccgggcgctccctccggatcagctgcgccgcctcccagttcaccttcagccgctacggcatgcactgggtccggcaggcgccggggaagggcctggagtgggtggcctccatcagctacgacggcaccgacaagtaccacgcccgcctggtgtgggggcggttcacgatctcccgcgacaacagcaagaacaccctctacctgcagatgaactccctgcgggccgaggacaccgccctctactactgcgtccgcgacgagcgggagagcgagtgcgagctgtgggagtccgactactacgacttcggcaagaagctgccctgcgtgaagccccgcggggtgaccggcagcctcgacatgtgggggcagggcacgcaggtcaccgtgtccagc

SEQ ID NO: 9527 - RNA, 438 nt, synthetic construct
  misc_feature 1..438: note = derived and/or modified sequence opt1 from anti-HIV_cap256-119-079333_VR-Chain
  source 1..438: mol_type = other RNA
gaggtgcagctggtcgagagcggcgggcgcctcgtgcagcccggctccccgctgcggctgagctgcgccgcctcccagttcaacttcgcgagctacgggatgcactgggtgcgccaggcccccggcaaggggctcgagtgggtcgcctccatcagcaacgacggcaccaagaagtaccacgccgagtccgtgtgggaccggttcagcatctccaaggacaacagcaagaacaccctgttcctgcagatgaactccctccgcgtggaggacacggccctgtacttctgcgtcaaggaccagcgggaggacgagtgcgaggagtggtggagcgactactacgacttcggccgcgagctgccctgccggaagtcccgcgggctcggcctggcggggatcttcgacatgtggggccacgggaccatggtgaccgtgagctcc

SEQ ID NO: 9528 - RNA, 441 nt, synthetic construct
  misc_feature 1..441: note = derived and/or modified sequence opt1 from anti-HIV_cap256-119-078618_VR-Chain
  source 1..441: mol_type = other RNA
cagatgcagctggtggagagcggcgggggcgtcgtgcagcccgggcgctccctcaccctgagctgcgccgcctcccagttcaacttcgcgagctacggcatgcactgggtgcggcaggccccggggaagggcctggagtgggtcgcctccatcagcaacgacggcaccaagaagtaccacgccgagtccgtgtgggaccgcttcagcatctccaaggacaacagcaagaacaccctcttcctgcagatgaactccctgcgggtggaggacacgaccctctacttctgcgtcaaggaccagcgcgaggacgagtgcgaggagtggtggagcgactactacgacttcgggcgggagctgccctgccgcaagtcccggggcctggggctcgccggcaacttctgcatctgcggggcggacggcaccatggtgacggtgagctcc

SEQ ID NO: 9529 - RNA, 432 nt, synthetic construct
  misc_feature 1..432: note = derived and/or modified sequence opt1 from anti-HIV_cap256-119-077466_VR-Chain
  source 1..432: mol_type = other RNA
caggtgcagctggtcgagagcggcgggggcgtggtgcagcccgggtccccgctccgcatcagctgcgccgtctcccagttcaccttcagccggtacggcatgcactgggtgcgccaggcccccgggaagggcctggagtgggtggcgtccatcagcttcgacggccgggacaagtaccactccagcctggtctgggggcgcctcaccatctcccgggacaacagcaagtccacgctgttcctgcagatgaacagcctccgcgccgaggacaccgccctgtactactgcgcccgggacctgcgcgagtccgagtgcgaggagtgggagagcgactactacgccttctaccggaagctcccctgcgtgaagccccgcggcgtggcggggaccctggacatctggggccaggggaccatggtcacggtgtccagc

SEQ ID NO: 9530 - RNA, 423 nt, synthetic construct
  misc_feature 1..423: note = derived and/or modified sequence opt1 from anti-HIV_cap256-119-076284_VR-Chain
  source 1..423: mol_type = other RNA
caggtgcagctggtcgagagcggcgggggcgtggtgcagcccgggcgctccctgcggctgagctgcgccgcctccaacacctacgcgatgcactgggtccgccaggccccgggcaaggggctggagtggatggccctcatcagctacgagggctccgacaagtactacgtggacagcgtgaagggccggttcaccatctcccgcgacaacagcaagtccacgctgtacctgcagatgaacagcctctccgccgaggacaccgccgtctacttctgcgcgaaggacctcgggggcaacaaggacgacgagtggaccaccgactactactacgactggagcaaggcccggcccgtgcaggacccccgcgtggtcgccgggacgttcgacatctggggccaggggaccatggtgaccgtgtccagc

SEQ ID NO: 9531 - RNA, 432 nt, synthetic construct
  misc_feature 1..432: note = derived and/or modified sequence opt1 from anti-HIV_cap256-119-074680_VR-Chain
  source 1..432: mol_type = other RNA
gaggtgcagctggtcgagagcggcgggggcctcgtgcagcccgggcgctccctgcggctgagctgcgccggctccgggttcaccttcgtggactacgccatgcactgggtccgccaggtgccgggcaagggcctcgagtgggtggggagcatctcctacgacggcagcgacaagtaccacaccaactccgtctgggggcggttcatcgtgagccgcgacaactccaagaacacgctgtacctgcagatgaacagcctccggcccgaggacaccgcgctgtactactgcgtgcgcgaccggcgcgagtccgagtgcgaggagcggtggagcgactactacgacttcggcaagcagctgccctgcgtcaagccccgcggggtggccggcatcttcgacatctggggccaggggaccatggtgaccgtctccagc

SEQ ID NO: 9532 - RNA, 432 nt, synthetic construct
  misc_feature 1..432: note = derived and/or modified sequence opt1 from anti-HIV_cap256-119-074081_VR-Chain
  source 1..432: mol_type = other RNA
gaggtgcagctggtcgagagcggcgggggcctcgtgcagcccgggggctccctgcgcctgagctgcgtggtctccggggtgaccgtgagctccaactacatgagctgggtccggcaggccccgggcaagggcctcgagtgggtggcctccatcagctacgacgggtccgacaagtaccacgcggaccgcgtgtggggccggttcaccatcagccgcgacaactccaagaacacgctgtacctgcagatgaacagcctccgggccgaggacaccgccctgtactactgcgtccgcgacgcccgggagtccgagtgcgagctgtgggagagcgactactacaacttcgggcgcaagctcccctgcgtgaagccccggggcgtggccgggaccctggacatctggggccagggcaccatggtcacggtgtccagc

SEQ ID NO: 9533 - RNA, 432 nt, synthetic construct
  misc_feature 1..432: note = derived and/or modified sequence opt1 from anti-HIV_cap256-119-071704_VR-Chain
  source 1..432: mol_type = other RNA
cagatgcagctggtggagagcggcgggggcgtcgtgcagcccgggggctccctccgcctgagctgcgccgtgtcccagttcaccttcaccagctacgggatgcactgggtccggcaggccccgggcaagggcctggagtgggtggcgacgatctccagcgacgggtccaagaagtaccacggcgacagcgtgtgggggcgcctcaccatctcccgggacaacagcaagaacaccctgttcctgcagatgaacaacctccgcgccgaggacaccgccctgtacttctgcgtcaaggaccagcgggaggacgagtgcgaggagtggtggtccgactactacgacttcggcaagaagctgccctgccgcaagagccccgggctcgccggcatcttcgacgtgtggggccacgggacgatggtgaccgtctccccc

SEQ ID NO: 9534 - RNA, 432 nt, synthetic construct
  misc_feature 1..432: note = derived and/or modified sequence opt1 from anti-HIV_cap256-119-071266_VR-Chain
  source 1..432: mol_type = other RNA
caggtgcagctggtcgagagcggcgggggcgtggtgcagcccggggagtccctccggctgagctgcgccgcctccggcttcaccttcagctccttcgggatgcactgggtccggcaggcgccgggcaagggcctggagtgggtggggagcatctcctacgacggcagcgacaagtaccacaccaactccgtgtgggggcgcttcatcgtcagccgggacaactccaagaacacgctctacctgcagatgaacagcctgcgccccgaggacaccgccctctactactgcgtgcgggaccgccgggagtccgagtgcgaggagcgctggagcgactactacgacttcggcaagcagctgccctgcgtgaagccccgcggggtcgccggcatcttcgacatctggggccaggggaccatggtgaccgtgtccagc

SEQ ID NO: 9535 - RNA, 432 nt, synthetic construct
  misc_feature 1..432: note = derived and/or modified sequence opt1 from anti-HIV_cap256-119-069667_VR-Chain
  source 1..432: mol_type = other RNA
gaggtgcagctggtcgagagcggcgggggcctcgtgcagcccgggcgctccctgcggctgagctgcgccgcctccggcttcagcttcaacacctacgggatgcactgggtgcgccaggcgccgggcaagggcctcgagtgggtcgccttcatccggtacgacgggtccaacaagtactacgccgacagcgtgaagggccgcttcaccatctcccgggacaacagcaagaacacgctgtacctgcagatggacgggctccgcggcgaggacaccgccctgtactactgcgccaaggacctgcgggagctcgagtgcgaggagtgggcgtccgactactacgacttcgggcgcccccagccctgcctggacccccggggcgtgagcggcatctccaacgtctgggggcagggcaccatggtgaccgtgagctcc

SEQ ID NO: 9536 - RNA, 432 nt, synthetic construct
  misc_feature 1..432: note = derived and/or modified sequence opt1 from anti-HIV_cap256-119-069591_VR-Chain
  source 1..432: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccggcatcagctacgacgggtccgacaagtaccacgccgacaaggtgtggggccggttcaccatcagccgcgacaactccaagaacacgctctacctgcagatgaacagcctgcgggccgaggacaccgcgctctactactgcgccaaggacctgcgcgaggacgagtgcgaggagtggtggtccgactactacgacttcgggaagcggctgccctgccgcaagagccggggcgtcgccggggtgttcgacaagtggggccagggcaccatggtgaccgtctccagc

SEQ ID NO: 9537 - RNA, 432 nt, synthetic construct
  misc_feature 1..432: note = derived and/or modified sequence opt1 from anti-HIV_cap256-119-068691_VR-Chain
  source 1..432: mol_type = other RNA
cagggccacctggtggccagcgggggcggggtcgtgcccccgggccgctccctcaccctgagctgcctggcctcccagttcaccttcagcgggtacggcttccactgggtgcggcaggcgcccggcaaggggctcgagtgggtcgcctccatcagcttcgccggcacgaagaagcactacgggaactccgtgaagggccgcttcaccatcagccgggacaactccaagaacaccctgtacctggagatgaacagcctccgccccgaggacaccgccctgtactactgcgccaaggaccggcgcgagtacgagtgcgaggagtggacgtccgactactacgacttcgggcggccccagccgtgcatcgacagccgcggcgtggtcggcatcctggacatctgggggcggggcaccatggtgaccgtgtccagc

SEQ ID NO: 9538 - RNA, 432 nt, synthetic construct
  misc_feature 1..432: note = derived and/or modified sequence opt1 from anti-HIV_cap256-119-068488_VR-Chain
  source 1..432: mol_type = other RNA
cagatgcagctggtggagagcggcgggggcgtcgtgcagcccgggatgtccctcaccctgagctgcgccgcctcccagttcaccttcagcaactacggcatgcactgggtgcgccaggcgccggggaagggcctggagtgggtcgcctccatcagcaacgacggctccaagaagtaccacggggacagcgtgaagggccggttcacgatctcccgcgacaacagcaagaacaccctctacctgcagatggacgggctgcggggcgaggacaccgccctctactactgcgccaaggacctgcgcgagctggagtgcgaggagtgggcctccgactactacgacttcgggcggccccagccctgcctcgacccccgcggcgtgagcggcatctccaacgtctgggggcagggcaccatggtgacggtgagctcc

SEQ ID NO: 9539 - RNA, 432 nt, synthetic construct
  misc_feature 1..432: note = derived and/or modified sequence opt1 from anti-HIV_cap256-119-067536_VR-Chain
  source 1..432: mol_type = other RNA
caggtgcagctggtcgagagcggcgggggcgtggtgcagcccgggcggtccctccggatcagctgcgcctccagccagttcaccttctcccgctacggcatgcactgggtccggcaggccccggggaagggcctggagtgggtggcgagcatctcctacgacggccgcgactaccaccacgccggggccgtgtggggccggttcatcatcagccgcgacaactccaagaacagcctgcacctccagatgaactccctgcggcccgaggacaccgccctgtacttctgcgcccgcgacctccgggagagcgagtgcgaggagtgggagtccgactactacgcgttctaccgcaagctgccctgcgtcaagccccgcggggtggccggcacgctggacatctgggggcagggcaccatggtgaccgtcagctcc

SEQ ID NO: 9540 - RNA, 432 nt, synthetic construct
  misc_feature 1..432: note = derived and/or modified sequence opt1 from anti-HIV_cap256-119-065852_VR-Chain
  source 1..432: mol_type = other RNA
caggtgcacctggtcgagagcggcgggggcgccgtgccctccgggcggagcctccggctgtcctgcgtggccagcggcttcaccttcggggtctacgacatccactgggtgcgccaggcgccgggcaagggcctggagtgggtggcctccatcagctacgacgggcgggacaagtaccactccagcctcgtctggggccgcctgaccatctcccgggacaacagcaagtccacgctgttcctccagatgaacagcctgcgcgccgaggacaccgccctgtactactgcgcccgggacctccgcgagtccgagtgcgaggagtggcagagcgactactacgcgttctacaagaagctgccctgcgtgaagccccgcggggtggccggcaccctggacatctgggggcagggcaccatggtcacggtgtccagc

SEQ ID NO: 9541 - RNA, 432 nt, synthetic construct
  misc_feature 1..432: note = derived and/or modified sequence opt1 from anti-HIV_cap256-119-065457_VR-Chain
  source 1..432: mol_type = other RNA
ctgggccgcctcgtggccagcgggggcggggtcgtgcccccgggccggagcccccgcctgtcctgcgtggcctcccagttcaccttcagcgggtgcggcctgcactgggtccggcaggcgcccggcaaggggctcgagtgggtggccgccatctccttcgacggcaccgacaagtaccacagcgacgacgtgtgggggcgcttcacgatctcccgggacaacagcaagaacaccctgtacctgcagatgaactccctccgccccgaggacaccgccctgtactactgcgccaaggacctgcaggaggacgagtgcgaggagtggtggagcgactactacgacttcggcaagcagctcccgtgccggaagtcccgcggggtcgcgggcatcttcgacgactggggccaggggaccatggtgacggtgagctcc

SEQ ID NO: 9542 - RNA, 432 nt, synthetic construct
  misc_feature 1..432: note = derived and/or modified sequence opt1 from anti-HIV_cap256-119-064501_VR-Chain
  source 1..432: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccggcatcagctacgacgggcgggacaagtaccacgcccactccgtgtggggccgcctcagcatctcccgggacaacagcaagaacaccctgtacctgcagatgaactccctccgcacggaggacaccgccctgtaccactgcgtccgggacctgcgcgagagcgagtgcgagctctgggagtccgactactacgacttcgggaagaagctgccctgcgtgaagccccggggcgtggcggggaccttcgacctgtggggccagggcaccatggtcacggtgagctcc

SEQ ID NO: 9543 - RNA, 432 nt, synthetic construct
  misc_feature 1..432: note = derived and/or modified sequence opt1 from anti-HIV_cap256-119-063568_VR-Chain
  source 1..432: mol_type = other RNA
caggtgcagcccgtcgagagcggcgggggcgtggtgtggccggggcggtccctgcggctcagctgcaccacctccggcttcacgttcagcaactacgccatccactgggtccgccaggcccccgggaagggcctgcagtgggtggcggtgatctcctacgacggcagcaacaagttctacgccgactccgtcaaggggcggttcaccatcagccgcgacaactccaagaacaccctgtacctccagatgaacagcctgcggcccgaggacaccgccctgtactactgcgccaaggacctccgcgaggacgagtgcgaggagcggtggtccgactactacgacttcggcaagcagctgccctgccgcaagagccgcggggtggccggcgtgttcgacaactgggggcagggcacgatggtcaccgtgtccagc

SEQ ID NO: 9544 - RNA, 435 nt, synthetic construct
  misc_feature 1..435: note = derived and/or modified sequence opt1 from anti-HIV_cap256-119-063103_VR-Chain
  source 1..435: mol_type = other RNA
caggtgcagctggtcgagagcggcgggggcctcgtgcagcccgggaagtccctgcgcctgagctgcgccgcctccggcttcaccttcagcacctacgggatgcactgggtgcggcaggcgccgggcaagggcctcgagtgggtcgccctgatctcctacgacgggagctacacgtactacgccgactccgtgaagggccgcttcaccatcagccgggacaactccaagagcaccctggacctccagctgaacaccctgcgccccgaggacacggccctctactactgcgcccgggacctgcgcgagatggagtgcgaggagtggaagctgtacaactactacgacttccggacccgcgggccctgcgtggacccccggggcgtcgtggggtccttcgacgtgtggggccagggcaccgtcgtgaccgtgagctcc

SEQ ID NO: 9545 - RNA, 432 nt, synthetic construct
  misc_feature 1..432: note = derived and/or modified sequence opt1 from anti-HIV_cap256-119-061027_VR-Chain
  source 1..432: mol_type = other RNA
caggtgcagctggtcgagagcggcgggggcgtggtgcagcccgggcggtccctccggctgagctgctccgccagcggcttcaccctgtccagctacgggatccactgggtccgccaggccccgggcaagggcctcgagtgggtggcggtgatgtccaacgacgggagcaaccagttctacggcgactccgtcaaggggcggttcaccatcagccgcgacatctccaagaacacgctgtacctgcagatgaacagcctccggcccgaggacaccgccatgtactactgcgcccgcgaccagcggtactacgagtgcgaggagtgggcctccgactactacgacttcggccgcgagcagccctgccaggacccccgcggggtggtgggcgtcttcgacatgtggggccaggggaccatggtgaccgtgagctcc

SEQ ID NO: 9546 - RNA, 432 nt, synthetic construct
  misc_feature 1..432: note = derived and/or modified sequence opt1 from anti-HIV_cap256-119-058232_VR-Chain
  source 1..432: mol_type = other RNA
caggtgcagctggtcgagagcggcgggggcgtggtgcagcccgggaagtccctccgcctgagctgcaaggcctcccagttcaccttcaaccggtacggcatgcactgggtccgccaggccccggggaagggcctggagtgggtggcggccatcagcttcgacggcaccgacaagtaccacgccgacaaggtgtgggggcggttcacgatctcccgcgacgacagcaagtccaccctctacctgcagatgaacagcctgcgggccgaggacaccgccctctactactgcgcgaaggacctgcgcgaggacgagtgcgaggagtggtggtccgactactacgacttcggcaagcagctgccctgccggaagtcccgcggggtcgccggcatcttcgacgggtggggccagggcaccatggtgacggtgagcagc

SEQ ID NO: 9547 - RNA, 432 nt, synthetic construct
  misc_feature 1..432: note = derived and/or modified sequence opt1 from anti-HIV_cap256-119-057341_VR-Chain
  source 1..432: mol_type = other RNA
caggtgcagctggtcgagagcggcgggggcgtggtgcagcccgggcggtccctccggctgagctgcgccgcctcccacttcagcctgtccagctacggcatgcactgggtccgccaggcgccggggaagggcctcgagtgggtggccggcgagtccttcgccgccaccaacaagtactacgccgacagcgtgaaggggcggttcatcgtctcccgcgacatcagcaagaacaccctgtacctggaggtgaactccctccgggcggaggacacggccctgtactactgcgcccgcgaccagcggtactacgagtgcgaggagtgggccagcgactactacgacttcggccgcgagcagccctgccaggacccccgcggggtggcgggcatcttcgacatctgggggcagggcaccatggtcaccgtgtccagc

SEQ ID NO: 9548 - RNA, 438 nt, synthetic construct
  misc_feature 1..438: note = derived and/or modified sequence opt1 from anti-HIV_cap256-119-056895_VR-Chain
  source 1..438: mol_type = other RNA
cagatgcagctggtggagagcggcgggggcgtcgtgcagcccgggcgctccctccggctgagctgcgccgcctcccagttcaccttcggcagctacgggatgcactgggtgcgccagatcccgggcaagggcctggagtgggtcgcgaccatctcctacgacgggacgaagaagtaccacgccgacagcgtgtgggaccggttcatcatctcccgcgacaacagcaagaacaccctcttcctgcagatgaactccctgcggcccgaggacaccgccctctacttctgcgtgaaggaccagcgccaggacgagtgcgaggagtggtggagcgactactacgacttcggccgggagctgccctgccgcaagtcccgggggctgggcctcgccgggatcttcgacatgtggggccacggcaccatggtcacggtgagctcc

SEQ ID NO: 9549 - RNA, 432 nt, synthetic construct
  misc_feature 1..432: note = derived and/or modified sequence opt1 from anti-HIV_cap256-119-056402_VR-Chain
  source 1..432: mol_type = other RNA
caggtgaagctggtcgagagcggcgggggcgtggtgcagcccgggaagtccctccggctgagctgcaccgcctcccagttcaccttcagcaacttcggcatgcactgggtccggcaggccccggggaagggcctggagtgggtggcgtccatcagcttcgtgggcatcaagaagcactacgccaactccgtccgcgggcggttcacgatcagccgcgaccagtccaagaacaccctctacctgcagatgaacagcgtgcgggtggaggacaccgcccgctacttctgcgcccgggacatgcgcgagtacgagtgcgagctgtgggcctccgactactacgacttcggcaagccccagccctgcgaggacccccgcggggtcgtgggcaccttcgacatgtgggggctcggcacgctggtgaccgtcagctcc

SEQ ID NO: 9550 - RNA, 432 nt, synthetic construct
  misc_feature 1..432: note = derived and/or modified sequence opt1 from anti-HIV_cap256-119-056034_VR-Chain
  source 1..432: mol_type = other RNA
caggtgcagctggtcgagagcggcgggggcgtggtgcagcccgggcggtccctccggctgagctgcgccgcctccggcttcaccttcagctcctacgcgatgcactgggtccgccaggccccggggaagggcctggagtgggtggccgccatcagcttcgccggcaccaagacgcactacgcggactccgtgaaggggcggttcaccatcagccgcgacaactccaagaacgccctctacctgcagatgaacaacctgcgggccgaggacaccgccctctactactgcgcgaaggacctgcgcgaggacgagtgcgaggagcggtggagcgactactacgacttcggcaagcagctgccctgccgcaagtcccgcggggtcgccggcgtgttcgacaactgggggcagggcaccatggtgacggtcagctcc

SEQ ID NO: 9551 - RNA, 432 nt, synthetic construct
  misc_feature 1..432: note = derived and/or modified sequence opt1 from anti-HIV_cap256-119-055042_VR-Chain
  source 1..432: mol_type = other RNA
caggtgcagctggtcgagagcggcgggggcgtggcccagcccgggcgctccctccggctgagctgcgccgcgtccggcttcaccttccgcagctacgggatgcactgggtgcggcaggccccgggcaagggcctggagtgggtcgccgtgatctccctcgacgggagcaacaagtactacgccgactccgtgaagggccgcttcagcatctcccgggacaacagcaagaacaccctgtacctgcagatgaactccctccgccccgaggacacggccgtctactactgcgcgaaggacctgcgggaggacgagtgcgaggagcgctggagcgactactacgacttcgggaagcagctgccctgccggaagtcccgcggcgtggccggggtgttcgacaactggggccagggcaccatggtcaccgtgagctcc

SEQ ID NO: 9552 - RNA, 438 nt, synthetic construct
  misc_feature 1..438: note = derived and/or modified sequence opt1 from anti-HIV_cap256-119-054776_VR-Chain
  source 1..438: mol_type = other RNA
caggtgcagctgatggagagcggcgggggcgtcgtgcagcccgggcgctccctccggctgagctgcaccgcctccggcttcaccttcagctcctacagcatgcactgggtgcgccaggccccggggaagggcctggagtgggtcgcgatcatctcctacgacgagagcaacaagtactacgccgactccgtgcagggccggttcacgatcagccgcgacaactccaagaacaccctcttcctgcagatgagctccctgcgggccgaggacaccgccctctacttctgcgtgcgcgaccaccgggaggacgagtgcgaggagtggtggagcgactactacgacttcgggcgcgagctgccctgccggaagttccgcggcctggggctcgccggcatcttcgacatctgggggcacggcaccatggtcacggtgtccagc

SEQ ID NO: 9553 - RNA, 432 nt, synthetic construct
  misc_feature 1..432: note = derived and/or modified sequence opt1 from anti-HIV_cap256-119-054539_VR-Chain
  source 1..432: mol_type = other RNA
cagatgcagctggtggagagcggcgggggcgtcgtgcagcccgggggctccctccgcctgagctgcgccgcctcccagttcaccttcgggagctacgcgatgcactgggtgcggcagccgcccggcgagcgccccgagtgggtcgccaccatctccttcgacggcacgaagaagtaccacgccgacagcgtgtgggggcggttcaccatctcccgcgacaacagcaagaacaccctgttcctccagatgaactccctgcggcccgaggacaccgccctgtacttctgcgtgaaggaccagcgcgaggacgcctgcgaggagtggtggagcgactactacgacttcggcaagaactgcctcgcggagtccccgggggcctggctggagttcttctacgtctggggccacgggacgatggtgaccgtgagctcc

SEQ ID NO: 9554 - RNA, 432 nt, synthetic construct
  misc_feature 1..432: note = derived and/or modified sequence opt1 from anti-HIV_cap256-119-054112_VR-Chain
  source 1..432: mol_type = other RNA
caggtgcagctggtcgagagcggcgggggcgtggtgcaggccgggcggtccctccggctgagctgcgccgcgtccggcttcaccttcagcacctacgccatgcactgggtccgccaggcccccgggaagggcctggagtgggtggccgtgatctcctacgacggcagcaacaagtactacgccgactccgtccgggggcgcttcacgatcagccgggacaactccaagaacaccctctacctgcagatgaacagcctgcgcgcggaggacaccgccctctactactgcgccaaggacatgcgggagtacgagtgcgaggagtggacctccgactactacgacttcggccgcccgcagccctgcatcgacagccgcggggtggtgggcacgttccacgtctgggggcagggcaccatggtgaccgtgtccagc

SEQ ID NO: 9555 - RNA, 432 nt, synthetic construct
  misc_feature 1..432: note = derived and/or modified sequence opt1 from anti-HIV_cap256-119-053339_VR-Chain
  source 1..432: mol_type = other RNA
caggtgcacctggtcgagagcggcgggggcgtggtgcagcccgggcggtccctccggctgagctgcgccgcctcccacttcagcctgtccagctacggcatgcactgggtccgccaggcgccggggaagggcctcgagtgggtgaccggcatctccttcgccgggaccaagacgtactacggcgacagcgtgcgggggcgcttcaccgtctcccgggacatcagcaagaacaccctgctgctccagatgaactccctgcgccccgacgacaccgccatctactactgcgcccgggaccagcgctactacgagtgcgaggagtgggccagcgactactacgacttcggcaaggagcagccctgcctggacccccgcggggtggtgggcatcttcgacctctggggccaggggacgatggtcaccgtgtccagc

SEQ ID NO: 9556 - RNA, 432 nt, synthetic construct
  misc_feature 1..432: note = derived and/or modified sequence opt1 from anti-HIV_cap256-119-052404_VR-Chain
  source 1..432: mol_type = other RNA
cagatgcagctggtggagagcggcgggggcgtcgtgcagcccgggcgctccctcaccctgagctgcatcgcctcccagttcaacttcgccagctacggcatgcactgggtgcggcaggcgccggggaagggcctggagtgggtcgcctccatcagccacgacggcaccaagaagtaccacgccgagtccgtgtgggggcgcttcacgatcagcaaggacaactccaagaacaccctcttcctgcagatgaacagcctgcgggtggaggacaccgccctctacttctgcgtcaaggaccagcgcgaggacgagtgcgaggagtggtggtccgactactacgacttcggcaagcagctgccctgccggaagtcccgcggggtggccggcgtgttcgacaactgggggcagggcaccatggtcacggtgagcagc

SEQ ID NO: 9557 - RNA, 432 nt, synthetic construct
  misc_feature 1..432: note = derived and/or modified sequence opt1 from anti-HIV_cap256-119-051123_VR-Chain
  source 1..432: mol_type = other RNA
caggtgcagctggtcgagagcggcgggggcgtggtgcagcccgggggctccctccgcctgagctgcgtcgggtcccagttcatcctgtaccggtacggcatgcactgggtgcgccaggccccgggcaaggggctcgagtgggtggccgcggtcagcttcgacggcaccgacaagtaccacgccgacgacgtgtgggggcggttcaccatctcccgcgacaacagcaagaacatcctgtacctgcagatgaactccctccgggccgaggacacggccctgtactactgcgccaaggacctgcgcgaggacgagtgcgaggagtggtggagcgactactacgacctcggcaagcagctgccctgccggaagtcccgcggggtggcgggcgtcttcgacaagtggggcctggggaccatggtgaccgtgagctcc

SEQ ID NO: 9558 - RNA, 438 nt, synthetic construct
  misc_feature 1..438: note = derived and/or modified sequence opt1 from anti-HIV_cap256-119-051077_VR-Chain
  source 1..438: mol_type = other RNA
gaggtgcagctggtcgagagcggcgggggcgtggtgcagtccgggcgcagcctccggctgtcctgcgccgccagccacttcaccttctcccgctacggcatgcactgggtccggcaggcgcccgggaagggcctggagtgggtggccagcatctcctacgacggccgcgacttctaccacgcccggagcgtgtgggggcgcttcaccatctcccgggacaacagcaagaacaccctcttcctgcagatgaactccctgcgcatcgaggacacggccctctacttctgcgtcaaggaccagcgggaggacgagtgcgaggagtggtggagcgactactacgacttcggccgcgagctgccgtgccggaagtcccgcgggctgggcctcgccgggatcttcgacatgtggggccacggcaccatggtgaccgtgagctcc

SEQ ID NO: 9559 - RNA, 432 nt, synthetic construct
  misc_feature 1..432: note = derived and/or modified sequence opt1 from anti-HIV_cap256-119-050442_VR-Chain
  source 1..432: mol_type = other RNA
caggcccagatggtggagagcggcgggggcgtcgtgcagcccgggcggtccctgcggctcagctgcgccgcgtccggcttcagcttctcctacttcgccatgcactgggtgcgccaggccccggggaagggcctggagtgggtcgccggcatcagcttcgccgcgaccaagacctactacgggggctccgtgaaggggcggttcacggtgagccgcgacatctccaagaacaccctgtacctccagatgaacagcctgcggcccgaggacaccgccatgtactactgcgcccgcgaccagcggtactacgagtgcgaggagtgggcctccgactactacgacttcggccgcgagcagccctgccaggacccccgcggggtcgtgggcgtgttcgacatgtggggccaggggaccatggtcacggtgagctcc

SEQ ID NO: 9560 - RNA, 432 nt, synthetic construct
  misc_feature 1..432: note = derived and/or modified sequence opt1 from anti-HIV_cap256-119-049433_VR-Chain
  source 1..432: mol_type = other RNA
caggtgcagctggtcgagagcggcgggggcgtggtgcagcccgggcgctccctccgggtcagctgccgcgcctccggcttcgccttcagctcctacgcgatgcactgggtgcggcaggccccggtgaaggggctggagtgggtcgccctgaccagctccgacggcgccgacaagtaccacgccgacgacgtgtggggccgcttcaccatcagccgggacaactccaagaacacgctctacctgcagatgaacagcctgcgccccgaggacaccgcgctctactactgcgccaaggacctgcgggaggacgagtgcgaggagcgctggtccgactactacgacttcgggaagcagctgccctgccgcaagagccggggcgtggccggggtcttcgacaactggggccaggggaccatggtgaccgtgtccagc

SEQ ID NO: 9561 - RNA, 432 nt, synthetic construct
  misc_feature 1..432: note = derived and/or modified sequence opt1 from anti-HIV_cap256-119-047532_VR-Chain
  source 1..432: mol_type = other RNA
ctgggccgcctcgtggccagcgggggcggggtcgtgcccccgggccggtccctgaccctgagctgcgtggcctcccagttcaccttcagcgggtgcggcctccactgggtccgccaggcgcccggcaaggggctggagtgggtggcctccatcagcttcgccggcacgaagaagcactacaccaactccgtgcgggggcgcttcaccatcagccgggacaactccaagaacaccgtctacctgcagatgaacagcctccgcgccgaggacacggccctgtactactgcgcgaaggacatgggcgagtacgagtgcgaggagtggacctccgactactacgacttcgggcggccccagccctgcatcgacagccgcggcgtggtgggcatcctggacatctgggggcagggcaccatggtcaccgtgtccagc

SEQ ID NO: 9562 - RNA, 432 nt, synthetic construct
  misc_feature 1..432: note = derived and/or modified sequence opt1 from anti-HIV_cap256-119-047489_VR-Chain
  source 1..432: mol_type = other RNA
caggtgcacctggtcgagagcggcgggggcgtggtgcagcccgggaagtccctccgcctgagctgcgccgcctcccagttcaccttcaaccggttcggcatgcactgggtccgccaggcgccggggaagggcctggagtgggtggccggcatcagctacgacgggtccgacaagtaccacgccgacaaggtgtggggccggttcaccatcagccgcgacaactccaagaacacgctctacctgcagatgaacagcctgcgggccgaggacaccgccctctactactgcgcgaaggacctgcgcgaggacgagtgcgaggagtggtggtccgactactacgacttcgggaagcggctgccctgccgcaagagccggggcgtcgccggggtgttcgacaagtggggccagggcaccatggtgaccgtctccagc

SEQ ID NO: 9563 - RNA, 438 nt, synthetic construct
  misc_feature 1..438: note = derived and/or modified sequence opt1 from anti-HIV_cap256-119-046020_VR-Chain
  source 1..438: mol_type = other RNA
gaggtgcagctgctccagagcggcgggggcctggtccagcccgggggctccctgcgcctcagctgcgccgcctccgggttcagcttctccagctacgcgatgtcctggatccggcaggccccgggcaagggcctggagtgggtggccagcatctcccacgacgggaccaagaagtaccacgccgagagcgtgtggggccgcttcaccatctccaaggacaacagcaagaacacgctgttcctccagatgaactccctgcgggtcgaggacaccgccctgtacttctgcgtgaaggaccagcgcgaggacgagtgcgaggagtggtggagcgactactacgacttcgggcgggagctcccctgccgcaagtcccggggcctggggctggcgggcatcttcgacatgtggggccacgggaccatggtgaccgtcagctcc

SEQ ID NO: 9564 - RNA, 432 nt, synthetic construct
  misc_feature 1..432: note = derived and/or modified sequence opt1 from anti-HIV_cap256-119-044746_VR-Chain
  source 1..432: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccgtgatcagctacgacggctccaacaagtactacgccgacagcgtcaaggggcggttcaccatctcccgcgacaacagcaagaacacggtgtacctcgagatgaactccctgcgggccgaggacaccgcgctgtactactgcgccaaggacctccgcgagtacgagtgcgaggagtggaccagcgactactacgacttcggccggccccagccctgcatcgactcccgcggggtggtcggcatcctggacatctgggggcagggcaccatggtgacggtgagctcc

SEQ ID NO: 9565 - RNA, 432 nt, synthetic construct
  misc_feature 1..432: note = derived and/or modified sequence opt1 from anti-HIV_cap256-119-044740_VR-Chain
  source 1..432: mol_type = other RNA
cagatgcacctggtggagagcggcgggggcgtcgtgcagcccgggatgtccctccgcctgagctgcgccgcctcccagttcaacttcggcagcttcgggatgcactgggtgcggcaggcgccgggcaagggcctggagtgggtcgccaccatctcctacgacgggaccaagaagtaccacagcgactccgtgtggggccgcctcagcatctcccgggacaacagcaagaacacgctgttcctgcagatgaactccctccgcaccgaggacaccgccctgtacttctgcgtgcgggaccagcgcgaggacgactgcgaggagtggtggagcgactactacgacttcgggaagaagctgccctgccggaagtcccgcggcctcgccgggatcttcgacatctggggccacggcaccatggtcacggtgagctcc

SEQ ID NO: 9566 - RNA, 432 nt, synthetic construct
  misc_feature 1..432: note = derived and/or modified sequence opt1 from anti-HIV_cap256-119-043790_VR-Chain
  source 1..432: mol_type = other RNA
ctgctccagctggtggagagcggcgggggcgtcgtgcagcccgggaactccctgcggctcagctgcgccgccgcgggcttcaccttctccgactacagcctgcactgggtgcggcaggccccggggaagggcctggagtgggtcgccatgatctccgacgacggcaacctcgacttctacgccgccagcgtgaaggggcgcttcaccatctcccgggacaacagcatcaacacggtgtacctgcagatgaactccctgcgcgcggaggacaccgccctctactactgcgccaaggacctgcgggagtacgagtgcgaggagtggaccagcgactactacgacttcggccgcccccagccctgcatcgactcccgcggggtcgtgggcatcctggacatctggagccaggggaccatggtgacggtctccagc

SEQ ID NO: 9567 - RNA, 432 nt, synthetic construct
  misc_feature 1..432: note = derived and/or modified sequence opt1 from anti-HIV_cap256-119-042880_VR-Chain
  source 1..432: mol_type = other RNA
gaggtgcgcctggtcgagagcggcgggggcctcgtgcagcccgggggctccctgcggctgagctgcgccgcctccgggttcaccctcagcgactactacatgtcctggatccgccaggcgccgggcaagggcctggagtgggtggccgccatcagcttcgccgggaccaagaagcactacggcaactccgtcaaggggcggttcacgatcagccgcgacaactccaagaacaccctgtacctcgagatgaacagcctgcgggtggaggacaccgccctgtactactgcgcgaaggacctccgcgagtacgagtgcgaggagtggacctccgactactacgacttcggccggccccagccctgcatcgacagccgcggggtggtcggcatcctggacatctggggccaggggacgatggtgaccgtgtccagc

SEQ ID NO: 9568 - RNA, 432 nt, synthetic construct
  misc_feature 1..432: note = derived and/or modified sequence opt1 from anti-HIV_cap256-119-042606_VR-Chain
  source 1..432: mol_type = other RNA
cagatgcagctggtggagagcggcgggggcgtcgtgcagcccgggcgctccctccggctgagctgcgccgcctcccagttcaccttcggcagctacgggatgcactgggtgcgccagatcccgggcaagggcctggagtgggtcaccgggatctccttcgcggccacgaagacctactacggcgacagcgtgcgggggcgcttcaccgtgtcccgggacatcagcaagaacaccctctacctgcagatgaactccctgcgccccgaggacacggccatgtactactgcgcccgggaccagcgctactacgagtgcgaggagtgggccagcgactactacgacttcggccgggagcagccctgccaggacccccgcggggtcgtgggcatcctcgacctgtggggccaggggaccatggtgaccgtctccagc

SEQ ID NO: 9569 - RNA, 432 nt, synthetic construct
  misc_feature 1..432: note = derived and/or modified sequence opt1 from anti-HIV_cap256-119-042444_VR-Chain
  source 1..432: mol_type = other RNA
caggtgcagctggtcgagagcggcggggacgtggtgcaccccggcgggtccctccgcctgagctgcgccgcctccggcttcaccttcagctcctacgggatccactgggtccggcaggcgccgggcaagggcctggagtgggtggccgccatcagctacgacgggtccgacaagtaccacaccaacagcgtgtggggccgcttcacggtctcccgggacaacagcaagaacaccgtgtacctccagatgaactccctgcgcgccgaggacaccgccctgtacttctgcgtgcgggaccgccgggagagcgagtgcgagctctgggagtccgactactacgacttcgggaagcgcctgccctgcgtcaagccccggggcgtggcgggggtgttcgacatctggggccagggcaccatggtcacggtgagctcc

SEQ ID NO: 9570 - RNA, 432 nt, synthetic construct
  misc_feature 1..432: note = derived and/or modified sequence opt1 from anti-HIV_cap256-119-040328_VR-Chain
  source 1..432: mol_type = other RNA
caggtgcagctggtcgagagcggcgggggcgtggtgcagcccgggggctccctccggctgagctgcgccgcctccgggttcaccttcagctcctacagcatgaactgggtccggcaggcgccgggcaagggcctggagtgggtggcctccatcagcttcgccgggaccaagcagcactacggcaactccgtgaaggggcgcttcacgatcagccgggacaactccaagaacaccgtctacctccagatgaacagcctgcgcctggaggacaccgccctctactactgcgccaaggacctgcgggagtacgagtgcgaggagtggacctccgactactacgacttcggccgcccccagccctgcatcgacagccgcggggtggtgggcatcctggacatctggggccaggggacgatggtcaccgtgtccagc

SEQ ID NO: 9571 - RNA, 432 nt, synthetic construct
  misc_feature 1..432: note = derived and/or modified sequence opt1 from anti-HIV_cap256-119-040164_VR-Chain
  source 1..432: mol_type = other RNA
cagatgcacctggtggagagcggcgggggcgtcgtgcagcccgggatgtccctccgcctgagctgcgccgcctcccagttcaacttcggcagcttcgggatgcactgggtgcggcaggcgccgggcaagggcctggagtgggtcgccaccatctcctacgacgggaccaagaagtaccacagcgactccgtgtggggccgcttcagcatctcccgggacaacagcaagaacacgctctacctgcagatgaactccctgcgcaccgaggacaccgccctctacttctgcgccaaggacctgcgggagtacgagtgcgaggagtggaccagcgactactacgacttcgggcgcccccagccctgcatcgactcccggggcgtggtcgggatcctggacatctggggccagggcacgatggtgaccgtgagctcc

SEQ ID NO: 9572 - RNA, 432 nt, synthetic construct
  misc_feature 1..432: note = derived and/or modified sequence opt1 from anti-HIV_cap256-119-039130_VR-Chain
  source 1..432: mol_type = other RNA
gaggagcagctggtggagagcggcgggggcctcgtccagcccgggcgctccctgcggctgagctgcaccggctccgggttccgcttcggcgactacgccatgaactgggtgcggcaggccccgggcaaggggctcgagtgggtgaccttcatcagctacgacggctccaacaagcactacgcggacagcgtcaaggggcgcttcacggtgtcccgggacaacagcaagaacaccctgcacctccagatgaactccctgcgccccgaggacaccgccctgtacttctgcgcccgggacctgcgcgagagcgagtgcgaggagtgggagtcctactactacgacttcggcaagaaggggccctgcgtgaagccccggggcgtcgtgggcgtgctcgacatctgggggcagggcaccctggtcacggtgagctcc

SEQ ID NO: 9573 - RNA, 432 nt, synthetic construct
  misc_feature 1..432: note = derived and/or modified sequence opt1 from anti-HIV_cap256-119-038138_VR-Chain
  source 1..432: mol_type = other RNA
caggtgcagctggtcgagagcggcgggggcgtggtgcagaccgggcgctccctccggctgagctgcaccggctcccagttcacgttcgggcgctacggcatgtactgggtccggcaggcccccggcaaggggctggagtgggtggccagcatctcctacgacggccgcgacttctaccacgcgcggagcgtgtgggggcgcttcaccatctcccgggacaacagcaagaacaccctccacctccagatgaactccctgcgcccggaggacaccgccctgtacttctgcgcccgggacctgcgcgagagcgagtgcgaggagtgggagtcctactactacgacttcggcaagaaggggccctgcgtcaagccccggggcgtggtgggcgtcctggacatctgggggcagggcacgctcgtgaccgtgagctcc

SEQ ID NO: 9574 - RNA, 432 nt, synthetic construct
  misc_feature 1..432: note = derived and/or modified sequence opt1 from anti-HIV_cap256-119-037868_VR-Chain
  source 1..432: mol_type = other RNA
caggtgcagctggtcgagagcggcgggggcgtggtgcagcccgggcggtccctccggctgagctgcgccgcctcccagttcaccttcagcaagtacggcatgcactgggtccgccaggcgccggggaagggcctgcagtgggtggccggcatctcctacgacgggagcgacaagtaccacgcccacttcgtgtggggccggttctccatcagccgcgacaactccaagaacgccctctacctgcagatgaacagcctgcggaccgaggacacggccctctacttctgcgtccgcgacctgcgggagtccgagtgcgaggagtggaagtccgactactacgacttcgggcgcaagggcccctgcctgaagccccgcggggtggcgggcagcttcgacatctggggccaggggaccgtggtcaccgtgagctcc

SEQ ID NO: 9575 - RNA, 432 nt, synthetic construct
  misc_feature 1..432: note = derived and/or modified sequence opt1 from anti-HIV_cap256-119-037102_VR-Chain
  source 1..432: mol_type = other RNA
caggtgaagctggtcgagagcggcgggggcgtggtgcagcccgggaagtccctccggctgagctgcaccgcctcccagttcaccttcagcaacttcggcatgcactgggtccggcaggccccggggaagggcctggagtgggtggcgtccatcagcttcgtgggcatcaagaagcactacgccaacttcgtccgcgggcggttcacgatctcccgcgaccagagcaagaacaccctctacctgcagatgaactccgtgcgggtggaggacaccgcccgctactactgcgcccgggacatgcgcgagtacgagtgcgagctgtgggccagcgactactacgacttcggcaagccccagccctgcgaggacccccgcggggtcgtgggcaccttcgacatgtgggggctcggcacgctggtgaccgtctccagc

SEQ ID NO: 9576 - RNA, 438 nt, synthetic construct
  misc_feature 1..438: note = derived and/or modified sequence opt1 from anti-HIV_cap256-119-036683_VR-Chain
  source 1..438: mol_type = other RNA
ggcgtgcagctggtcgagagcgggggcgccgtggtgcgccccgggggctccctcaccctgagctgcgccgcgtcccagttcatcctgagctcctacgggatgcactgggtccggcaggccccgggcaagggcctcgagtgggtggccagcatctccaacgacgggaccaagaagtaccacgccgagagcgtgtgggaccgcttctccatcagcaaggacaactccaagaacacgctgttcctgcagatgaacagcctccgggtcgaggacaccgccctgtacttctgcgtgaaggaccagcgcgaggacgagtgcgaggagtggtggtccgactactacgacttcggccgggagctgccctgccgcaagagccgggggctcggcctggcggggatcttcgacatgtggggccacggcaccatggtgaccgtctccagc

SEQ ID NO: 9577 - RNA, 432 nt, synthetic construct
  misc_feature 1..432: note = derived and/or modified sequence opt1 from anti-HIV_cap256-119-036495_VR-Chain
  source 1..432: mol_type = other RNA
caggtgcagctggtcgagagcggcgggggcgtggtgcagcccgggcgctccctccggctgagctgcgccgcctccggcttcagcttctccagctacgggatgcactgggtccgccaggcgccgggcaagggcctggagtgggtggcctccatcagcttcgtggggatcaagacccactacgccaactccgtccggggccgcttcaccatcagccgggaccagtccaagaacacgctctacctgcagatgaacagcgtgcgcatcgaggacaccgcccggtacttctgcgcccgcgacatgcgggagtacgagtgcgagctgtgggcgtccgactactacgacttcgggaagccccagccctgcgaggacccccgcggcgtggtcgggaccttcgacatgtggggcctcggcaccctggtgacggtgagctcc

SEQ ID NO: 9578 - RNA, 438 nt, synthetic construct
  misc_feature 1..438: note = derived and/or modified sequence opt1 from anti-HIV_cap256-119-035375_VR-Chain
  source 1..438: mol_type = other RNA
gaggtgcagctggtcgagagcggcgggggcctcgtgcagcccgggcgctccctgcggctgagctgcgccgcctccggcttcaccctcgaggactacgggatgcactgggtgcgccaggcgccgggcaagggcctggagtgggtcgccagcatctccaacgacgggaccaagaagtaccacgccgagagcgtgtgggaccggttctccatcagcaaggacaactccaagaacacgctgttcctccagatgaacagcctgcgcgtggaggacaccgccctgtacttctgcgtcaaggaccagcgggaggacgagtgcgaggagtggtggtccgactactacgacttcggccgcgagctcccctgccgcaagagccgggggctgggcctggccgggatcttcgacatgtggggccacggcaccatggtgaccgtgtccagc

SEQ ID NO: 9579 - RNA, 438 nt, synthetic construct
  misc_feature 1..438: note = derived and/or modified sequence opt1 from anti-HIV_cap256-119-035165_VR-Chain
  source 1..438: mol_type = other RNA
caggtgcacctggtcgagagcggcgggggcgtggggcagcccgcccgctccctccggctgagctgcgccgcgtccggcttcatcctgagctcctacgggctccactgggtgcgccaggccccgggcaagggcctggagtgggtcgccctgatcagctacgacgggaacaacgagtactacgccgagtccgtgtggggccggttcaccatcagcaaggacaactccaagaacaccctcttcctgcagatgaacagcctgcgcgtggaggacacggccctctacttctgcgtcaaggaccagcgggaggacgagtgcgaggagtggtggtccgactactacgacttcgggcgcgagctgccctgccgcaagagccggggcctggggctcgcgggcatcttcgacatgtggggccacgggaccatggtgaccgtgtccagc

SEQ ID NO: 9580 - RNA, 432 nt, synthetic construct
  misc_feature 1..432: note = derived and/or modified sequence opt1 from anti-HIV_cap256-119-035109_VR-Chain
  source 1..432: mol_type = other RNA
caggtgcagctggtcgagagcggcgggggcgtggtgcagcccgggcggtccctccggctgagctgcgccaccgccggcttcaccttctccagctacgcgatgcactgggtccgccaggccccggggaagggcctggagtgggtggcctccatcagctacgacggctccgacaagtaccacgccgacctcgtgtgggggcggttcacgatcagccgcgacaactccaagaacaccctgtacctgcagatgaacagcctccgggccgaggacaccgcgctgtactactgcgtccgcgacgcccgggagtccgagtgcgagctgtgggagagcgactactacaacttcggccgcaagctcccctgcgtgaagccccgcggggtggccggcaccctggacatctgggggcagggcacgatggtcaccgtgtccagc

SEQ ID NO: 9581 - RNA, 339 nt, synthetic construct
  misc_feature 1..339: note = derived and/or modified sequence opt1 from anti-HIV_cap256-119-033789_VR-Chain
  source 1..339: mol_type = other RNA
caggtgtacctggtcgagagcggcgggggcgtggtgcagcccgggcgctccctccggctgagctgcgccgcctcccacttcagcctgtccagctacggcatgcactgggtccgccaggcgccggacatctccaagaacaccctctacctccaggtgaacagcctgcggcccgaggacaccgccatgtactactgcgcccgcgaccagcggtactacgagtgcgaggagtgggcctccgactactacgacttcgggaaggagcagccctgcctggacccccgcggcgtggtcggcatcttcgacatctgggggcagggcacgatggtgaccgtgagctcc

SEQ ID NO: 9582 - RNA, 432 nt, synthetic construct
  misc_feature 1..432: note = derived and/or modified sequence opt1 from anti-HIV_cap256-119-033641_VR-Chain
  source 1..432: mol_type = other RNA
caggtgcagctggtcgagagcggcgggggcgtggtgcagaccgggcggtccctccggctgagctgcaccggctcccagttcacgttcgggcgctacggcatgtactgggtccggcaggcccccggcaaggggctggagtgggtggccgcgatcagctacgacggctccgacaagtaccacaccaacagcgtgtgggggcgcttcaccgtctcccgggacaacagcaagaacaccgtgtacctccagatgaactccctgcgcgccgaggacacggccctgtacttctgcgtgcgggaccgccgggagagcgagtgcgagctctgggagtccgactactacgacttcggcaagcgcctgccgtgcgtcaagccccgcggggtggccggcgtgttcgacatctggggccaggggaccatggtcaccgtgagctcc

SEQ ID NO: 9583 - RNA, 432 nt, synthetic construct
  misc_feature 1..432: note = derived and/or modified sequence opt1 from anti-HIV_cap256-119-032113_VR-Chain
  source 1..432: mol_type = other RNA
caggtgcagctggtcgagagcggcgggggcgtggtgcagcccgggcgcccgctccggctgtcctgcgtcggcagcgggttctccttcatcaccagcgccatgcactgggtgcgccaggcccccgacaagggcctggagtgggtggcgatcatctccgacggcgggaacaaccggcactacgccgacagcgtcaagggccgcttcaccatctcccgggacaacagcaagaacacggtgttcctcgaggtgaacaacctgcgccccgaggacaccgccatgtactactgcgcccgggaccagcgctactacgagtgcgaggagtgggcctccgactactacgacttcgggcgggagcagccctgccaggacccgcgcggcgtcgtgggggtgttcgacatgtggggccagggcaccatggtcaccgtgagctcc

SEQ ID NO: 9584 - RNA, 432 nt, synthetic construct
  misc_feature 1..432: note = derived and/or modified sequence opt1 from anti-HIV_cap256-119-031739_VR-Chain
  source 1..432: mol_type = other RNA
caggtgcagctggtcgagagcggcgggggcgtggtgcagcccgggcgctccctccggatcagctgcgccgcctcccagttcaccttcaaccgctacggcatgcactgggtccggcaggcgccggggaagggcctggagtgggtggccagcatctcctacgacggcagcgacaagtaccacgccgggctggtgtggggccgcttcatcatctcccgggacaacagcaagaacaccctctacctgcagatgaactccctgcgcgccgaggacacggccctctactactgcgtccgggacgagcgcgagagcgagtgcgagctgtgggagtccgactactacgacttcgggaagaagctgccctgcgtgaagccccggggcgtggcggggaccctcgacatctggggccagggcacccgcgtcaccgtgagctcc

SEQ ID NO: 9585 - RNA, 432 nt, synthetic construct
  misc_feature 1..432: note = derived and/or modified sequence opt1 from anti-HIV_cap256-119-030932_VR-Chain
  source 1..432: mol_type = other RNA
gaggtgcagctgctcgagagcggcgggggcgtcgtgcagcccgggcgctccctgcggctgagctgcgccgcctccggcttcgcgttcagccactacgggatcttctgggtgcgccaggccccgggcaagggcctcgagtgggtcaccgtgatctccggggacggcagcacccagtggtacgccgactccgtgcaggggcggttcacgatcagccgcgactccagcaagaacaccctgtacctgcagatggacggcctccgcggggaggacaccgccctgtactactgcgccaaggacctgcgggagctcgagtgcgaggagtgggcgtccgactactacgacttcggccggccccagccctgcctggacccccgcggcgtcagcgggatctccaacgtgtggggccaggggaccatggtgacggtcagctcc

SEQ ID NO: 9586 - RNA, 438 nt, synthetic construct
  misc_feature 1..438: note = derived and/or modified sequence opt1 from anti-HIV_cap256-119-030740_VR-Chain
  source 1..438: mol_type = other RNA
caggtgcagctggtcgagttcggcgggggcgtggtgcagaccgggcgcagcctccggctgtcctgcgccgccagcggcttcaccttctccgactacgggatgcactgggtccgccaggcgcccggcaagggcctggagtgggtggccagcatctccaacgacgggagcaagaagtaccacggcgactccgtgtgggcccggttcatcatcagccgcgacaactccaagaacaccctcttcctgcagatgagctccctgcgggccgaggacacggccctctacttctgcgtccgcgaccaccgggaggacgagtgcgaggagtggtggagcgactactacgacttcgggcgcgagctgccgtgccggaagttccgcggcctggggctcgcgggcatcttcgacatctggggccacgggaccatggtgaccgtgtccagc

SEQ ID NO: 9587 - RNA, 438 nt, synthetic construct
  misc_feature 1..438: note = derived and/or modified sequence opt1 from anti-HIV_cap256-119-030197_VR-Chain
  source 1..438: mol_type = other RNA
caggtgcacctggtcgagagcggcgggggcgtggtgcagcccgggaagtccctccgcctgagctgcgccgcctcccagttcaccttctgccggtacggcatgcactgggtccgccaggcgccggggaagggcctggagtgggtggccagcatctccaacgacggcaccgacaagtaccacgccgacaacgtgtgggggcggttcacgatcagccgcgacaactccaagaacaccctctacctggagatgaacagcctgcggggcgaggacaccgccctctactactgcgccaaggacatgcgcgaggacgagtgcgaggagtggtggtccgactactacgacttcgggaaggagctgccctgccggaagtggaagacccgcggcgtcgcggggatcctggacaactggggccagggcacgatggtgaccgtgagctcc

SEQ ID NO: 9588 - RNA, 438 nt, synthetic construct
  misc_feature 1..438: note = derived and/or modified sequence opt1 from anti-HIV_cap256-119-027047_VR-Chain
  source 1..438: mol_type = other RNA
cagatgcagctggtggagagcggcgggggcgtcgtgcagcccgggcgctccctcaccctgagctgcgccgcctcccagttcaccttccggaactacggcatgcactgggtgcgccaggcgccggggaagggcctggagtgggtcgccagcatctccaaggacggcacgaagaagtaccacggggacagcgtgtggggccggttcatcatctcccgcgacaacagcaagaacaccctcttcctgcagatgtccagcctgcgggccgaggacaccgccctctacttctgcgtgcgcgaccagcgggaggccgagtgcgaggagtggtggtccgactactacgacttcgggcgcgagctgccctgccggaagttccgcggcctggggctcgcgggcatcttcgacatctggggccacgggaccatggtcacggtgagctcc

SEQ ID NO: 9589 - RNA, 432 nt, synthetic construct
  misc_feature 1..432: note = derived and/or modified sequence opt1 from anti-HIV_cap256-119-026950_VR-Chain
  source 1..432: mol_type = other RNA
caggtgcagctggtcgagagcggcgggggcgtggtgcagcccgggaagtccctccggatcagctgcgccgcctcccggttcaccttcggccgcttcgggatgcactgggtccggcaggcgccgggcaagggcctggagtgggtggccagcatctcctacgacgggagcgacaagtaccacgccggcctggtgtgggggcgcttcatcatctcccgggacaacagcaagaacaccctctacctgcagatgaactccctgcgcgccgaggacacggccctctactactgcgtccgggacgagcgcgagagcgagtgcgagctgtgggagtccgactactacaacttcggcaagaactacccctgcgtgaagccccgcggggtggcgggcaccctggacatctggggccaggggaccaccgtcatcgtgagctcc

SEQ ID NO: 9590 - RNA, 438 nt, synthetic construct
  misc_feature 1..438: note = derived and/or modified sequence opt1 from anti-HIV_cap256-119-026279_VR-Chain
  source 1..438: mol_type = other RNA
cagatgcagctggtggagagcggcgggggcgtcgtgcagcccgggacctccctcaccctgagctgcgccgcctcccagttcagcttcacgtcctacggcatgcactgggtgcgccaggcgccggggaagggcctggagtgggtcgccagcatctccaacgacggcaccaagaagtaccacgccgagagcgtgtgggggcggttcaccatctccaaggacaacagcaagaacaccctcttcctgcagatgaactccctgcgcgtggaggacacggccctctacttctgcgtcaaggaccagcgggaggacgagtgcgaggagtggtggagcgactactacgacttcggccgcgagctgccctgccggaagtcccgcgggctgggcctcgccgggatcttcgacatctggggccacggcaccgtggtgatcgtcagctcc

SEQ ID NO: 9591 - RNA, 432 nt, synthetic construct
  misc_feature 1..432: note = derived and/or modified sequence opt1 from anti-HIV_cap256-119-025355_VR-Chain
  source 1..432: mol_type = other RNA
gaggtgcagctggtcgagagcggcgggggcctcgtgcagcccgggcgctccctgcggctgagctgcgccgcctccggcttcagcttctccgactacgcgatgcactgggtgcgccaggccccggggcagggcctcgagtgggtcgccttcatcagctacgacggcaccaagaagtaccactccgacagcgtgtgggggcggctgaccatctcccgcgacaacagccggaacacgctgttcctccagatgaactccctgcgcaccgaggacaccgccctgtacttctgcgtgcgggaccagcgcgaggacgactgcgaggagtggtggagcgactactacgacttcggcaagaagctcccctgccggaagtcccgcgggctggccggcatcttcgacatctgggggcacggcaccatggtcacggtgagctcc

SEQ ID NO: 9592 - RNA, 432 nt, synthetic construct
  misc_feature 1..432: note = derived and/or modified sequence opt1 from anti-HIV_cap256-119-025301_VR-Chain
  source 1..432: mol_type = other RNA
caggtgcacctggtcgccagcggcgggggcgtggtgcccccggggcgctccctccggctgagctgcgtcgcctcccagttcaccttcagcggcttcgggctgtactgggtgcgccaggcgcccggcaagggcctcgagtgggtggccgccatctccttcgccgggaccaagaagcactacgccaacagcgtcaagggccggttcacgatctcccgcgacaacagcaagaacaccctgtacctgcagatgaactccctccggcccgacgacaccgcgctgtactactgcgccaaggacctgcgcgagtacgagtgcgaggagtggaccagcgactactacgacttcgggcggccccagccgtgcatcgactcccgcggcgtggtggggatcctcgacatctggagccagggcacgatggtcaccgtgtccagc

SEQ ID NO: 9593 - RNA, 438 nt, synthetic construct
  misc_feature 1..438: note = derived and/or modified sequence opt1 from anti-HIV_cap256-119-025010_VR-Chain
  source 1..438: mol_type = other RNA
caggtgcagctggtcgagagcggcgggggcgtggtgcagcccgggcgctccctccggctgagctgcccggcctccggcttcagcttctccacctacgggatgcactgggtccgccaggcccccggcaagggcctggagtgggtggcgagcatctccaacgacgggaacaagaagtaccacggcgagagcgtgtgggaccggttcaccatctcccgcgacaacagcaagaacaccctcttcctgcagatgaaccggctgcgcgtcgaggacacggccctctacttctgcgtgaaggaccagcgggaggacgagtgcgaggagtggtggtccgactactacgacttcgggcgcgagctgccctgccggaagttccgcggcctggggctcgccggcatcttcgacgtgtggggccacgggaccatggtcaccgtgagctcc

SEQ ID NO: 9594 - RNA, 432 nt, synthetic construct
  misc_feature 1..432: note = derived and/or modified sequence opt1 from anti-HIV_cap256-119-024631_VR-Chain
  source 1..432: mol_type = other RNA
caggtgcagctgatggagagcggcgggggcgtcgtgcagcccgggggctccctccgcctgagctgcgccgcctccgggttcaccttcagctcctacggcatgcactgggtgcggcaggcgccgggcaaggggctggagtgggtcgccggcatcagctacgacgggtccgacaagtaccacgcccacttcgtgtggggccgcttcatcatcagccgggacaactccaagaacgccctctacctgcagatgaacagcctgcgccccgaggacaccgccctctacttctgcgtgcgggacctgcgcgagtccgagtgcgaggagtggcagagctactactacgacttcgggcggaagggcccctgcctgaagccccgcggcgtcgcggggtccttcgacatctggggccaggggacggtggtgaccgtcagctcc

SEQ ID NO: 9595 - RNA, 432 nt, synthetic construct
  misc_feature 1..432: note = derived and/or modified sequence opt1 from anti-HIV_cap256-119-024467_VR-Chain
  source 1..432: mol_type = other RNA
gaggtgcagctggtcgagagcggcgggggcctcgtgcagcccgggggctccctgaacgtgagctgcgccgcctccgggttcaccttccgcacctacgcgatgcactgggtccggcaggccccgggcaagggcctggagtgggtggccgccatcagctacgacggggacaacaagtactccgccgacagcgtgaagggccgcttcacgatctcccgggaccagagcaagaacaccctctacctgcagatgaactccgtccgcgtggaggacaccgcgcggtactactgcgcccgcgacatgcgggagtacgagtgcgagctgtgggccagcgactactacgacttcgggaagccccagccctgcgaggacccccgcggcgtggtcgggaccttcgacatgtggggcctcggcacgctggtgaccgtgtccagc

SEQ ID NO: 9596 - RNA, 432 nt, synthetic construct
  misc_feature 1..432: note = derived and/or modified sequence opt1 from anti-HIV_cap256-119-023805_VR-Chain
  source 1..432: mol_type = other RNA
caggtgcagctggtcgagagcggcgggggcgtggtgcagcccgggaagtccctccgcctgagctgcgccgcctcccagttcggcttcgggagctacggcatgcactgggtccggcaggcgccgggcaaggggctggagtgggtggccaccatctccttcgacggcgccgacaagtaccacgccgacgacgtgtgggggcgcttcagcatctcccgggacaacagcaagaacaccctctacctgcagatgaacaacctgcgccccgaggacacggccctctactactgcgcgaaggacctgcgggaggacgagtgcgaggagcgctggtccgactactacgacttcggcaagcagctgccctgccggaagtcccgcggggtcgccggcgtgttcgacaactggggccaggggaccatggtgaccgtcagcagc

SEQ ID NO: 9597 - RNA, 432 nt, synthetic construct
  misc_feature 1..432: note = derived and/or modified sequence opt1 from anti-HIV_cap256-119-021736_VR-Chain
  source 1..432: mol_type = other RNA
caggtgcagctggtcgagagcggcgggggcgtggtgcagcccgggcggtccgtccggctcagctgcgtggcctcccagttcagcttcgaccgctacggcatgcactgggtgcggcaggccccggggaagggcctggagtgggtcgcgtccatcagctacgacggcaccgacaagtaccacgccgacaaggtgtgggggcgcttcaccatctcccgggacaacagcaagaagacgctgtacctccagatgaactccctgcgccccgaggacgccgccctgtactactgcgccaaggacctccgggaggacgagtgcgaggagtggtggagcgactactacgacttcggcaagcagctgccctgccgcaagtcccgcggggtggcgggcatcttcgacagctgggggcagggcaccatggtcaccgtgtccagc

SEQ ID NO: 9598 - RNA, 438 nt, synthetic construct
  misc_feature 1..438: note = derived and/or modified sequence opt1 from anti-HIV_cap256-119-021203_VR-Chain
  source 1..438: mol_type = other RNA
cagatgcagctggtggagagcggcgggggcgtcgtgcagcccgggcgctccctcaccctgagctgcgccgcctcccagttcaccttcagcaactacggcatgcactgggtgcggcaggcgccggggaagggcctggagtgggtcgcctccgtgagcaacgacggcacgaagaagtaccacggggactccgtgtgggaccgcttcaccatcagccgggacaactccaagaacaccctcttcctgcagatgagctccctgcgcgccgaggacaccgccgtctacttctgcgtgcgggacgagcgcgaggacgagtgcgaggagtggtggagcgactactacgacttcggccgggagctcccctgccgcaagttccgggggctgggcctggccgggatcttcgacatctggggccacggcacgctcgtgaccgtctccagc

SEQ ID NO: 9599 - RNA, 432 nt, synthetic construct
  misc_feature 1..432: note = derived and/or modified sequence opt1 from anti-HIV_cap256-119-020569_VR-Chain
  source 1..432: mol_type = other RNA
caggtgcagctggtcgagagcggcgggggcgtggtgcagcccggggagtccctccgcatcagctgcgccgcctcccagttcaccttcagccggtacggcatgcactgggtccgccaggcgccggggaagggcctggagtgggtggcctccatcagcttcgacggccgggacaagtaccactccagcctggtgtgggggcgcctcaccatctcccgggacaacagcaagtccacgctgttcctgcagatgaacagcctccgccccgaggacaccgccctgtactactgcgcccgggacgtccgcgagtccgagtgcgaggagtggcagagcgactactacgccttctaccggaagctgccctgcgtgaagccccgcggcgtggcggggaccctcgacatctggggccaggggaccatggtcacggtgtccagc

SEQ ID NO: 9600 - RNA, 432 nt, synthetic construct
  misc_feature 1..432: note = derived and/or modified sequence opt1 from anti-HIV_cap256-119-019432_VR-Chain
  source 1..432: mol_type = other RNA
caggtgcagctggtccagagcggcgggggcgtggtgcagcccgggcgctccctccggatcagctgcgccgccccgtacttcaccttcggccgctacgggttccactgggtccggcaggcgcccggcaagggcctggagtgggtggcctccatcagcttcgacgggcgcgactactaccacagcccccacgtgtggggccggctgaccatctcccgcgacaactccaagaacacgctctacctgcagatgaacagcctgcgggccgaggacaccgccctctactactgcgcccgcgacctgcgggagtccgagtgcgaggagtgggagagcgactactacgacttcgggaagaagggcccctgcgtcaagccgcgcggggtggcgggctccctggacatgtggggccaggggaccatggtgaccgtcagctcc

SEQ ID NO: 9601 - RNA, 432 nt, synthetic construct
  misc_feature 1..432: note = derived and/or modified sequence opt1 from anti-HIV_cap256-119-018827_VR-Chain
  source 1..432: mol_type = other RNA
caggcccagctggtggagagcggcgggggcgtcgtgcagcccgggcgctccctccggctgagctgcgccgcgtcccacttcagcttcaaccgctacggcatgcactgggtgcggcaggccccggggaagggcctggagtgggtcgccggcatctcctacgacgggcgcgacttctaccacgccgacatcgtgtggggccggctcaccatcagccgcgacaactccaagaacaccgtgtacctgcagatgaacagcctgcgggccgacgacacggggctctactactgcgcgcgcgacgtccgggagtccgagtgcgaggagtgggagagctactactacgacttcggccgcaaggggccctgcctgaagccccggggcgtggccggcaccttcgacatgtgggggcagggcaccatcgtgtccgtcagcgcc

SEQ ID NO: 9602 - RNA, 432 nt, synthetic construct
  misc_feature 1..432: note = derived and/or modified sequence opt1 from anti-HIV_cap256-119-018483_VR-Chain
  source 1..432: mol_type = other RNA
ctggtgcagctcgtcgagagcggcgggggcgtggtgcagcccgggaagtccctgcgcctgagctgcgtcgcctcccagttcaccttcaaccggtacggcatgcactgggtgcgccaggccccggggaagggcctcgagtgggtggcgggcatcagctacgacgggcgggacaagtaccacgcccacttcgtctggggccgcatcaccatctcccgggacaacagcaagaacacgctgtacctgcagatgaactccctccgcgccgaggacaccgccctgtaccactgcgtgcgggacctgcgcgagagcgagtgcgagctctgggagtccgactactacgacttcgggaagaagctgccctgcgtgaagccccggggcgtcgccgggatcttcgacctgtggggccagggcaccatggtgaccgtgagctcc

SEQ ID NO: 9603 - RNA, 432 nt, synthetic construct
  misc_feature 1..432: note = derived and/or modified sequence opt1 from anti-HIV_cap256-119-018118_VR-Chain
  source 1..432: mol_type = other RNA
caggtgcacctggtcgccagcggcgggggcgtggtgcccccggggcggtccctcaccctgagctgcgtcgcctcccagttcaccttcagcggctgcgggctgcactgggtgcggcaggcgcccggcaagggcctcgagtgggtggcctccatcagcttcgccgggacgaagaagcactacggcaactccgtcaaggggcgcttcaccatcagccgggacaactccaagaacaccctgtacctgcagatgaacagcctccgccccgaggacaccgccctgtactactgcgccaaggacctgcgggagtacgagtgcgaggagtggacgtccgactactacgacttcggccgcgaccagccctgcatcgacagccgcggggtggtgggcatcctcgacatctggggccaggggaccatggtcaccgtgtccagc

SEQ ID NO: 9604 - RNA, 432 nt, synthetic construct
  misc_feature 1..432: note = derived and/or modified sequence opt1 from anti-HIV_cap256-119-017782_VR-Chain
  source 1..432: mol_type = other RNA
caggtgcagctggtcgagagcggcgggggcgtggtgcagcccgggaagtccctccgcctgagctgcgccgcctccggcttcccgttcagcaactacgcgatgcactgggtccggcagacccccgggcgcggcctggagtgggtggccggcatctccttcgccgccaccaagaagtactaccggcccagcgtgcgcgggcggttcacggtctccaccgacatcagcaagaacaccctctacctggagatgaactccctgcgccccgaggacaccgccctctacttctgcgcgcgggaccagcgctactacgagtgcgaggagtgggccagcgactactacgacttcggccgggagcagccgtgcctggacccccgcggggtggtgggcatcttcgacctgtgggggcagggcacgatggtcaccgtgtccagc

SEQ ID NO: 9605 - RNA, 432 nt, synthetic construct
  misc_feature 1..432: note = derived and/or modified sequence opt1 from anti-HIV_cap256-119-017669_VR-Chain
  source 1..432: mol_type = other RNA
caggtgcagctggtcgagagcggcgggggcgtggtgcagcccgggtccagcctccgcctgtcctgcgccgccagccacttcgcgttcaaccggtacggcatgcactgggtccgccaggccccggggaagggcctggagtgggtggccggcatctccttcgacggggccgacaagttccacgccgacaaggtgtggggccggttcaccatcagccgcgacaactccaagaacaccctcagcctgcagatgaactccctgcggcccgaggacacggcgctctactactgcgccaaggacctgcgcgaggacgagtgcgaggagtggtggagcgactactacgacttcgggcggcgcctgccctgccggaagtcccgcggcgtcagcgggatcttcgacaactggggccagggcaccatggtgaccgtgtccagc

SEQ ID NO: 9606 - RNA, 432 nt, synthetic construct
  misc_feature 1..432: note = derived and/or modified sequence opt1 from anti-HIV_cap256-119-016976_VR-Chain
  source 1..432: mol_type = other RNA
caggtgcagctggtcgagagcggcgggggcgtggtgcagcccgggcggtccctccggctgagctgcgccgcctcccagttcagcttcggcgacttcgggatgcactgggtccgccaggcgccgggcaagggcctggagtgggtggccgccatctccttcgccgggaccaagaagaactacgccgacagcgtgcggggccgcttcaccatctcccgggacagctccaagaacacgctctacctgcagatgaacagcctgcgccccgaggacaccgcgctctactactgcgtcaaggacatgcgggggtacgagtgcgaggagtggacctccgactactacgacttcggccgcccccagccctgcatcgacagccgcggggtggtgggcaccttcgacgtctggggccaggggacgatggtgaccgtgtccagc

SEQ ID NO: 9607 - RNA, 432 nt, synthetic construct
  misc_feature 1..432: note = derived and/or modified sequence opt1 from anti-HIV_cap256-119-015432_VR-Chain
  source 1..432: mol_type = other RNA
gaggtgcagctgctcgagagcggcgggggcctggtccagcccgggggctccctgcggctcagctgcgccgcctccgggttcaccttcagcggctactccctgaactgggtgcggcaggcgccgggcaaggggctggagtgggtggccagcatctcctacgacggcagcgacaagtaccacgccgaccgcgtctgggggcggttcaccatctcccgcgacaacagcaagaacacgctctacctgcagatgaactccctgcgggccgaggacaccgccctctactactgcgtgcgcgacgcgcgggagagcgagtgcgagctgtgggagtccgactactacaacttcggccgcaagctgccctgcgtgaagccccgcggggtcgccggcaccctcgacatctggggccaggggaccatggtgacggtgagctcc

SEQ ID NO: 9608 - RNA, 432 nt, synthetic construct
  misc_feature 1..432: note = derived and/or modified sequence opt1 from anti-HIV_cap256-119-015281_VR-Chain
  source 1..432: mol_type = other RNA
ctgggccgcctcgtggccagcgggggcggggtcgtgcccccgggccggtccctgcgcctgagctgcgtggcctcccagttcaccttcagcgggtgcggcctccactgggtccggcaggcgcccggcaaggggctggagtgggtggcctccatcagcttcgccggcaccaagaagcactacgggaactccgtgaagggccgcttcacgatcagccgggacaactccaagaacaccgtctacctggagatgaacagcctccgcgccgaggacaccgccctgtactactgcgcgaaggacctgcgggagtacgagtgcgaggagtggacctccgactactacgacttcgggcgcccccagccctgcatcgacagccggggcgtggtgggcatcctcgacatctgggggcagggcacgatggtcaccgtgtccagc

SEQ ID NO: 9609 - RNA, 432 nt, synthetic construct
  misc_feature 1..432: note = derived and/or modified sequence opt1 from anti-HIV_cap256-119-014957_VR-Chain
  source 1..432: mol_type = other RNA
caggtgcaggtcgtggagagcggcgggggcgtggtccagcccgggacctccctgcgcctcagctgcaccgtgtccggcttcagcttctccaactacgacctgcactgggtgcggcagacgccggccaaggggctggagtgggtcgccgtggtgagctacgacggctcccgcgagtactacaccgacagcgtcaagggccggttcatcatctcccgcgaccagagcaagaacaccctctacctgcagatgaactccgtgcggctggaggacaccgcgcgctactactgcgcccgggacatgcgcgagtacgagtgcgagctctgggccagcgactactacgacttcgggaagccccagccctgcgaggacccccggggcgtggtcgggacgttcgacatgtggggcctggggaccctggtgaccgtgtccagc

SEQ ID NO: 9610 - RNA, 432 nt, synthetic construct
  misc_feature 1..432: note = derived and/or modified sequence opt1 from anti-HIV_cap256-119-014777_VR-Chain
  source 1..432: mol_type = other RNA
caggtgcacctggtcgagagcggcgggggcgtggtgcagcccgggcggtccctccggctgagctgcgccgcctcccacttcagcctgtccagctacggcatgcactgggtccgccaggcgccggggaagggcctcgagtgggtggccggcatctccttcgccgccaccaagacctactacgggggcagcgtgaaggggcggttcacggtctcccgcgacatcagcaagaacaccctgtacctgcagatgaactccctccggcccgaggacaccgccatgtactactgcgcgcgcgaccagcggtactacgagtgcgaggagtgggccagcgactactacgacttcggccgcgagcagccctgccaggacccccgcggggtggtgggcgtcttcgacatgtggggccaggggaccatggtgacggtgtccagc

SEQ ID NO: 9611 - RNA, 432 nt, synthetic construct
  misc_feature 1..432: note = derived and/or modified sequence opt1 from anti-HIV_cap256-119-014313_VR-Chain
  source 1..432: mol_type = other RNA
caggtgcagctggtcgagagcggcgggggcgtggtgcagcccgggcgctccctccggatcagctgcgccgcctcccagttcaccttcagccgctacggcatgcactgggtccggcaggcgccggggaagggcctggagtgggtggcctccatcagctacgacggccgcgactaccaccacgccggggccgtgtggggccggttcatcatctcccgcgacaacagcaagaactccctgcacctccagatgaacagcctgcggcccgaggacaccgccctgtacttctgcgcgcgcgacctccgggagtccgagtgcgaggagtgggagagcgactactacaacttctggaagaagctgccctgcgtcaagccccgcggggtggtgggcatcctggacatctgggggcagggcacggtcgtgaccgtgtccagc

SEQ ID NO: 9612 - RNA, 438 nt, synthetic construct
  misc_feature 1..438: note = derived and/or modified sequence opt1 from anti-HIV_cap256-119-014219_VR-Chain
  source 1..438: mol_type = other RNA
cagatgcagctggtggagagcggcgggggcgtcgtgcagcccgggtccagcctcaccctgtcctgcgccgccagccagttcaccttctccaactacggcatgcactgggtgcgccaggcgccggggaagggcctggagtgggtcgccagcatctccaacgacggcacgaagaagtaccacggggacagcgtgtgggaccggttcaccatctcccgcgacaacagcaagaacaccctcttcctgcagatgaactccctgcgggccgaggacaccgccctctacttctgcgtgaaggaccagcgcgaggacgagtgcgaggagtggtggagcgactactacgacttcggccgggagctgccctgccgcaagttccgggggctgggcctcgccgggacgttcgacatctggggccacggcaccatgctgatcgtctccagc

SEQ ID NO: 9613 - RNA, 432 nt, synthetic construct
  misc_feature 1..432: note = derived and/or modified sequence opt1 from anti-HIV_cap256-119-013631_VR-Chain
  source 1..432: mol_type = other RNA
caggtgcagctggtcgagagcggcgggggcgtggtgcagcccgggcgctccctccggctgagctgcgccgcctcccagttcaccttcggcagctacgggatgcactgggtccgccagatcccgggcaagggcctggagtgggtggcgaccatctcctacgacgggacgaagaagtaccacgccgacagcgtgtgggaccggttcatcatctcccgcgacaacagcaagaacaccctcttcctgcagatgaactccctgcggcccgaggacaccgccctctacttctgcgtcaaggaccagcgccaggacgagtgcgaggagtggtggagcgactactacgacttcggccggcgcctgccctgccggaagtcccgcgggctggccggcatcttcgacgtgtgggggcacggcaccatggtgacggtcagctcc

SEQ ID NO: 9614 - RNA, 432 nt, synthetic construct
  misc_feature 1..432: note = derived and/or modified sequence opt1 from anti-HIV_cap256-119-012924_VR-Chain
  source 1..432: mol_type = other RNA
caggtgaccctggtcgagagcggcgggggcttcgtgcagcccgggggctccctccgcctgagctgcgccacctccgggttcacgttcagctcctacgccatgcactgggtgcggcaggcgccgggcaagggcctggagtgggtcgccgccatcagcttcgacggggccgacaagtaccacgccgacaacgtgtggggccgcctctccatcagccgggacaactccaagagcaccctgtacctgcagatgaactccctccgccccgaggacaccgcggtgtacttctgcgccaaggacctgcgggaggacgagtgcgaggagcgctggagcgactactacgacttcgggaagcagctgccctgccggaagtcccgcggcgtcgccgggatcttcgacaactggggccagggcaccatggtgacggtgagcgcc

SEQ ID NO: 9615 - RNA, 432 nt, synthetic construct
  misc_feature 1..432: note = derived and/or modified sequence opt1 from anti-HIV_cap256-119-011793_VR-Chain
  source 1..432: mol_type = other RNA
caggtgcagctggtcgagagcggcgggggcgtggtgcagcccgggggctccctccgcctgagctgcgtcgcctcccagttcaccttcagccggtacgggatgcactgggtgcgccaggccccgggcaagggcctggagtgggtggcgtccatcagctacgacgggcgggacaagtaccacgccgacttcgtctggggccgcctcaccatctcccgggacgacagcaagaagacgctgtacctgcagatggactccctccgcgtggacgacaccgccctgtactactgcgtgcgggacatgcgcgagagcgagtgcgagctgtgggagtccgactactacgacttcgggaagcggctcccctgcgtcaagccccgcggcgtggccgggatcttcgacatctggggccagggcaccatggtgaccgtcagctcc

SEQ ID NO: 9616 - RNA, 432 nt, synthetic construct
  misc_feature 1..432: note = derived and/or modified sequence opt1 from anti-HIV_cap256-119-011413_VR-Chain
  source 1..432: mol_type = other RNA
caggtgcagctggtcgagagcggcggggacgtggtgcagcccggccgctccctccggctgagctgcgccgcctccgggttcaccttcagcacctacggcatgcactgggtccgccaggcgccggggaagggcctggagtgggtggccgccatctccttcgccggcacgaagaagaactacgccgacagcgtgcgggggcgcttcaccatctcccgggacagctccaagaacaccctctacctggagatgaacagcctgcgccccgaggacaccgcgctctactactgcgccaaggacatgcggggctacgagtgcgaggagtggacgtccgactactacgacttcgggcgcccccagccctgcatcgacagccggggcgtcgtggggaccttcgacgtgtggggccagggcaccatggtcaccgtgtccagc

SEQ ID NO: 9617 - RNA, 432 nt, synthetic construct
  misc_feature 1..432: note = derived and/or modified sequence opt1 from anti-HIV_cap256-119-011323_VR-Chain
  source 1..432: mol_type = other RNA
caggtgaagctggtcgagagcggcgggggcgtggtgcccccggggaagtccctccgcctgagctgcaccgcctcccagttcaccttcagcaacttcggcatgcactgggtccggcaggcccccgggaagggcctggagtgggtggcgtccatcagcttcgtgggcatcaagacgcactacgccaactccgtccgcgggcggttcaccatcagccgcgaccagtccaagaacaccctctacctgcagatgaacagcgtgcgggtggaggacaccggccgctactactgcgcccgggacatgcgcgagtacgagtgcgagctgtgggcctccgactactacgacttcgggaagccccagccctgcgaggacccgcggggcgtcgtggggacgttcgacatgtggggcctcggcaccctggtgaccgtcagctcc

SEQ ID NO: 9618 - RNA, 432 nt, synthetic construct
  misc_feature 1..432: note = derived and/or modified sequence opt1 from anti-HIV_cap256-119-011233_VR-Chain
  source 1..432: mol_type = other RNA
caggtgcacctggtcgagagcggcgggggcgtggtgcagcccgggcgctccgtccggctcagctgcgccgcctcccacttcagcctgtccagctacggcatgcactgggtgcgccaggcgccggggaagggcctggagtgggtgaccggcatctccttcgccgggaccaagacgtactacggcgacagcgtccgggggcgcttcaccgtgtcccgggacatcagcaagaacaccctcttcctgcagatgaactccctgcgccccgacgacaccgccatgtactactgcgcccgggaccagcgctactacgagtgcgaggagtgggccagcgactactacgacttcggccgggagcagccctgcctcgacccccgcggggtggtcggcatcttcgacctgtggggccaggggacgatggtgaccgtgtccagc

SEQ ID NO: 9619 - RNA, 432 nt, synthetic construct
  misc_feature 1..432: note = derived and/or modified sequence opt1 from anti-HIV_cap256-119-009038_VR-Chain
  source 1..432: mol_type = other RNA
caggagcagctggtggagagcggcgggggcgtcgtgcagcccgggcgctccctccggctgagctgcgtggcctcccgcttcaccttcagcgccttcggcatgcactgggtccggcaggcgccggggaagggcctggagtgggtggcctccatcagcttcgccggcatcaagaagtactacggggactccgtgaagggccgcttcaccatcagccgggacaactccaagaacacgctctacctgcagatggacgggctgcgcggcgaggacaccgccctctactactgcgccaaggacctgcgggagctggagtgcgaggagtgggcgagcgactactacgacttcgggcgcccccagccctgcctcgacccccggggcgtctccggcatcagcaacgtgtgggggcagggcaccatggtgaccgtctccagc

SEQ ID NO: 9620 - RNA, 432 nt, synthetic construct
  misc_feature 1..432: note = derived and/or modified sequence opt1 from anti-HIV_cap256-119-008756_VR-Chain
  source 1..432: mol_type = other RNA
caggtgcagctggtcgagagcggcgggggcgtggtgcagcccgggaagtccctccgcctgagctgcgtcgtgtcccagttcaccttcggccggtacgggatgcactgggtgcgccaggccccgggcaagggcctggagtgggtcgccagcatctcctacgacgggagcgacaagtaccacacctccagcctctggggccggttcatcgtgtcccgcgacaacagcaagaacacgctgtacctgcagatgaactccctccggcccgaggacaccgcgctgtactactgcgtgcgcgaccggcgcgagagcgagtgcgaggagcggtggtccgactactacgacttcgggaagcagctgccctgcgtcaagccccgcggcgtggccgggatcttcgacatctggggccagggcaccatggtgaccgtcagctcc

SEQ ID NO: 9621 - RNA, 438 nt, synthetic construct
  misc_feature 1..438: note = derived and/or modified sequence opt1 from anti-HIV_cap256-119-008055_VR-Chain
  source 1..438: mol_type = other RNA
cagatgcagctggtggagagcggcgggggcgtcgtgcagcccgggcgctccctcaccctgagctgcgccgcctcccagttcagcttcgcgaactacggcatgcactgggtgcggcaggccccggggaagggcctggagtgggtcgcctccatcagcaacgacggcaccaagaagtaccacgaggagtccgtgtgggggcgcttcacgatcagcaaggacaactccaagaacaccctcttcctgcagatgaacagcctgcggatcgaggacaccgccctctacttctgcgtgaaggaccagcgcgaggacgagtgcgaggagtggtggtccgactactacgacttcggccgggagctgccctgccgcaagagccgggggctgggcctcgccgggatcttcgacatgtggggccacggcaccatggtcacggtgtccagc

SEQ ID NO: 9622 - RNA, 435 nt, synthetic construct
  misc_feature 1..435: note = derived and/or modified sequence opt1 from anti-HIV_cap256-119-006949_VR-Chain
  source 1..435: mol_type = other RNA
caggtgcacctggtcgagagcggcgggggcgtggtgcagcccgggcgctccctccggctgagctgcgccgcctccggcttcagcgtctccaacaactacatgaactgggtgcgccaggcgccgggggagggcctggagtgggtggccctcatcagcttcgacggccggcagaaggacctggccgactccgtcaaggggcgcttcgccatcagccgggacaactccaagaacaccctgtacctccagatgaacagcctgcgcctggaggacaccgccctctactactgcgcgcgggacctgcgcgagctggactgcgaggagtggacgctctacaactactacgacttcggctcccgggggccctgcgtggacccccgcggcgtcgggggcagcttcgacgtgtggggccaggggaccatggtgaccgtgtccagc

SEQ ID NO: 9623 - RNA, 432 nt, synthetic construct
  misc_feature 1..432: note = derived and/or modified sequence opt1 from anti-HIV_cap256-119-006685_VR-Chain
  source 1..432: mol_type = other RNA
caggtgcagctggtcgagagcggcgggggcgtggtgcagcccgggcgctccctccgggtcagctgcgccgcctcccacttcaccttcagccgctacggcatgcactgggtgcggcaggcgccggggaagggcctggagtgggtggcctccatcagctacgacggccgcgacttctaccacgcccggtccgtctgggggcgcttcaccatcagccgggacaactccaagaacacgctgcacctccagatgaacagcctgcgccccgaggacaccgccctgtacttctgcgcccgggacctccgcgagtccgagtgcgaggagtgggagagctactactacgacttcggcaagaaggggccctgcgtgaagccccggggcgtggtcggggtgctggacatctggggccagggcaccctggtgaccgtctccagc

SEQ ID NO: 9624 - RNA, 432 nt, synthetic construct
  misc_feature 1..432: note = derived and/or modified sequence opt1 from anti-HIV_cap256-119-006015_VR-Chain
  source 1..432: mol_type = other RNA
caggtgcagctggtcgagagcggcgggggcgtggtgcagcccgggaagtccctccgcctgagctgcgccgcctcccggttcaccttcaaccgctacggcatgcactgggtccggcaggcgccggggaagggcctggagtgggtggccgccatcagcttcgacggcaccgacaagtaccactccgacgacgtgtgggggcgcttcacgatcagccgggacaactccaagaacaccctctacctgcagatgaacagcctgcgccccgaggacaccgccctctactactgcgccaaggacctgcaggaggacgagtgcgaggagtggtggtccgactactacgacttcggcaagcagctgccctgccggaagtcccgcggggtcgcgggcatcttcgacgactgggggcagggcaccatggtgacggtgagcagc

SEQ ID NO: 9625 - RNA, 432 nt, synthetic construct
  misc_feature 1..432: note = derived and/or modified sequence opt1 from anti-HIV_cap256-119-005841_VR-Chain
  source 1..432: mol_type = other RNA
caggtgcagctggtcgagagcggcgggggcgtggtgcagcccgggcgctccctccggctgagctgcgccgcctcccagttcagcttcggcaacttcgggatgcactgggtccgccaggcgccgggcaagggcctggagtgggtggccgccatctccttcgccgggaccaaggagaactacgccaacagcgtgcggggccgcttcaccatctcccgggacaacagcaagaacacgctctacctgcagatgaactccctgcgcgcggaggacaccgccctctactactgcaccaaggacatgcgggagtacgagtgcgaggagtggaccagcgactactacgacttcgggcgcccccagccctgcatcgactcccggggcgtcgtggggacgttcgacgtgtggggccagggcaccatggtcaccgtgagctcc

SEQ ID NO: 9626 - RNA, 432 nt, synthetic construct
  misc_feature 1..432: note = derived and/or modified sequence opt1 from anti-HIV_cap256-119-005824_VR-Chain
  source 1..432: mol_type = other RNA
caggtgcagctggtcgagagcggcgggggcgtggtgcagcccgggggctccctccgcctgagctgcgccgcctccgggttcaccttccggcgctacgcgatgcactgggtccggcaggccccgggcaagggcctggagtgggtggccagcatctcctacgacgggagcgacaagtaccacacctccagcctctggggccgcttcatcgtgtcccgggacaacagcaagaacacgctgtacctgcagatgaactccctccgccccgaggacaccgccctgtactactgcgtccgggaccgccgggagagcgagtgcgaggagcgctggtccgactactacgacttcgggaagcagctgccctgcgtgaagccccggggcgtggccgggatcttcgacatctggggccagggcaccatggtcaccgtgagctcc

SEQ ID NO: 9627 - RNA, 432 nt, synthetic construct
  misc_feature 1..432: note = derived and/or modified sequence opt1 from anti-HIV_cap256-119-005494_VR-Chain
  source 1..432: mol_type = other RNA
caggtgcgcctggtcgagagcggcgggggcgtggtgcagcccgggcggtccctccgcatcagctgcgccgcctcccagttcatgttcaacaagtacggcatgcactgggtccggcaggcgccggggaagggcctggagtgggtggccagcatctcctacgacggcagcgacaagtaccacgccgacctggtgtgggggcgcttcaccatctcccgggacaacagcaagaacaccctctacctgcagatgaactccctgcgcgccgaggacacggccctctactactgcgtccgggacgcgcgcgagagcgagtgcgagctgtgggagtccgactactacaacttcggccggaagctgccctgcgtgaagccccgcggggtggccggcaccctcgacatctgggggcagggcaccatggtcaccgtgagctcc

SEQ ID NO: 9628 - RNA, 432 nt, synthetic construct
  misc_feature 1..432: note = derived and/or modified sequence opt1 from anti-HIV_cap256-119-004949_VR-Chain
  source 1..432: mol_type = other RNA
caggtgcagctggtcgagagcggcgggggcgtggtgcagcccgggcggtccctccggctgagctgcgccgcctccaagttcagcctgtccagctacggcatgcactgggtccgccaggcgccggggcggggcctcgagtgggtggccggcatctccttcgccgccaccaagaagtactaccgccccagcgtgcgggggcgcttcaccgtctccacggacatcagcaagaacaccctgtacctggagatgaactccctccggcccgaggacaccgccctgtacttctgcgcgcgcgaccagcggtactacgagtgcgaggagtgggccagcgactactacgacttcggccgcgagcagccctgcctggacccgcgcggggtggtgggcatcttcgacctctgggggcagggcaccatggtcacggtgtccagc

SEQ ID NO: 9629 - RNA, 432 nt, synthetic construct
  misc_feature 1..432: note = derived and/or modified sequence opt1 from anti-HIV_cap256-119-004422_VR-Chain
  source 1..432: mol_type = other RNA
cacgtgcagctggtcgagagcggcgggggcgtggtgcagcccgggcgctccctccggctgagctgcgccgcctccggcctgagcttctccagctacgcgatgcactgggtccgccaggccccggggaagggcctcgagtgggtggccgtggtctcctacgacggcaccaccaagttctacgccgacagcgtgaaggggcggttcacgatctcccgcgacaacagcaagaacaccctgtacctgcagatgaactccctccggggcgaggacaccgccctgtactactgcgcgaaggacctgcgcgagtacgagtgcgaggagtggaccagcgactactacgacttcgggcggccccagccctgcatcgactcccgcggcgtggtcgggatcctcgacatctggagccagggcacgatggtgaccgtgtccagc

SEQ ID NO: 9630 - RNA, 432 nt, synthetic construct
  misc_feature 1..432: note = derived and/or modified sequence opt1 from anti-HIV_cap256-119-003932_VR-Chain
  source 1..432: mol_type = other RNA
caggtgcagctgctcgagagcggcgggggcgtcgtgcagcccgggggctccctgcgcctgagctgcaaggcctcccacttcagcttcgaccggtacgggatgcactgggtgcgccaggccccgggcaagggcctcgagtgggtcgcggccatctccttcgacggggccgacaagtaccacgccgacaacgtgtggggccggctgagcatctcccgcgacaacagcaagtccaccctgtacctccagatgaacagcctgcggcccgaggacaccgccgtgtacttctgcgcgaaggacctgcgcgaggacgagtgcgaggagcggtggtccgactactacgacttcgggaagcagctcccctgccgcaagagccggggcgtcgccgggatcttcgacaactggggccagggcacgatggtgaccgtgtccgcc

SEQ ID NO: 9631 - RNA, 438 nt, synthetic construct
  misc_feature 1..438: note = derived and/or modified sequence opt1 from anti-HIV_cap256-119-003577_VR-Chain
  source 1..438: mol_type = other RNA
caggtgcagctggtcgagagcggcgggggcggggtgcagcccggccgctccctccggctgagctgcgccgcctccgggttcaccttccgcagctacgcgatgcactgggtgcggcaggccccgggcaagggcctggagtgggtcgccgtgatctccaacgacgggaccaagaagtaccacgccgagagcgtgtgggaccgcttctccatcagcaaggacaactccaagaacaccctcttcctgcagatgaacagcctgcgggtcgaggacacggccctctacttctgcgtgaaggaccagcgcgaggacgagtgcgaggagtggtggtccgactactacgacttcggccgggagctgccctgccgcaagagccgggggctgggcctcgcggggatcttcgacatgtggggccacggcaccatggtgaccgtctccagc

SEQ ID NO: 9632 - RNA, 432 nt, synthetic construct
  misc_feature 1..432: note = derived and/or modified sequence opt1 from anti-HIV_cap256-119-002155_VR-Chain
  source 1..432: mol_type = other RNA
ctgggccgcctcgtggccagcgggggcggggtcgtgcccccgggccggtccctgcgcctgagctgcgtggcctcccagttcaccttcagcgggtgcggcctccactgggtccgccaggtgcccggcaaggggctggagtgggtggcgtccatcagcttcgccggcaccaagacgcactacgggaactccgtcaagggccggttcagcatctcccgggacaacagcatcaacaccgtgtacctgcagatgaactccctccgcgccgaggacaccgccctgtactactgcgccaaggacctgcgggagtacgagtgcgaggagtggaccagcgactactacgacttcgggcgcccccagccctgcatcgactcccggggcgtggtcggcatcctcgacatctggagccaggggacgatggtgaccgtgtccagc

SEQ ID NO: 9633 - RNA, 432 nt, synthetic construct
  misc_feature 1..432: note = derived and/or modified sequence opt1 from anti-HIV_cap256-119-002017_VR-Chain
  source 1..432: mol_type = other RNA
caggtgcagctggtcgagagcggcgggggcgtggtgcagcccgggcgctccctccggctgagctgcgccgcctccggcttcaccttcagctactacgggatccactgggtccgccaggcgccgggcaagggcctggagtgggtggcctccatcagctacgacgagcgggacttctaccacgcccgctccgtgtgggggcggttcgccatcagccgcgacaactccaagaacaccctccacctccagatgaacagcctgcggcccgaggacacggccctgtacttctgcgcgcgcgacctgcgggagtccgagtgcgaggagtgggagagctactactacgacttcggcaagaaggggccctgcgtcaagccccgcggcgtggtgggggtcctggacatctggggccagggcaccctcgtgaccgtgtccagc

SEQ ID NO: 9634 - RNA, 432 nt, synthetic construct
  misc_feature 1..432: note = derived and/or modified sequence opt1 from anti-HIV_cap256-119-001312_VR-Chain
  source 1..432: mol_type = other RNA
caggtgcagctgatggagagcggcgggggcgtcgtgcagcccgggcgctccctccggctggcctgcgccgcgagcggcttcaccttctccagctacgccatccactgggtgcgccaggccccggggaagggcctggagtgggtcgccgccatctccttcgcgggcaccaagaagaactacgccgacagcgtgcgggggcgcttcacgatctcccgggacagctccaagaacaccctctacctggagatgaacagcctgcgccccgaggacaccgccctctactactgcgccaaggacatgcggggctacgagtgcgaggagtggacctccgactactacgacttcgggcgcccccagccctgcatcgacagccggggcgtggtcgggacgttcgacgtgtggggccagggcaccatggtgaccgtctccagc

SEQ ID NO: 9635 - RNA, 438 nt, synthetic construct
  misc_feature 1..438: note = derived and/or modified sequence opt1 from anti-HIV_cap256-119-001017_VR-Chain
  source 1..438: mol_type = other RNA
cagatgcagctggtggagagcggcgggggcgtcgtgcagcccgggcgctccctcaccctgagctgcgccgcctcccagttcagcttcaccaactacggcatgcactgggtgcggcaggcgccggggaagggcctggagtgggtcgcctccatcagcaacgacggcaacaagaagtaccacggggagtccgtgtgggaccgcttcacgatcagccgggacaactccaagaacaccctcttcctgcagatgaaccgcctgcgggtggaggacaccgccctctacttctgcgtcaaggaccagcgcgaggacgagtgcgaggagtggtggagcgactactacgacttcggccgggagctgccctgccgcaagttccgggggctgggcctcgccgggatcttcgacgtgtggggccacggcaccatggtgacggtctccagc

SEQ ID NO: 9636 - RNA, 432 nt, synthetic construct
  misc_feature 1..432: note = derived and/or modified sequence opt1 from anti-HIV_cap256-119-000594_VR-Chain
  source 1..432: mol_type = other RNA
caggtgcagctggtcgagagcggcgggggcctcgtgcagcccgggacctccctgcgcctgagctgcgccgcctccgcgttcaccttcaagaactacggcatgcactgggtgcggcaggccccggggaagggcctcgactgggtcgccagcatctcctacgacggccgcgacaagtaccacagctccctggtgtgggggcggctgacgatcagccgcgacaactccaagagcaccctcttcctgcagatgaactccctgcgggccgaggacaccgccctctactactgcgcgcgcgacctgcgggagagcgagtgcgaggagtggcagtccgactactacgccttctacaagaagctgccctgcgtgaagccccgcggcgtcgccgggaccctcgacatctggggccaggggacgatggtgaccgtgagctcc

SEQ ID NO: 9637 - RNA, 432 nt, synthetic construct
  misc_feature 1..432: note = derived and/or modified sequence opt1 from anti-HIV_cap256-059-241099_VR-Chain
  source 1..432: mol_type = other RNA
caggtgcagctggtcgagagcggcgggggcgtggtgcagcccgggcggtccctccggctgagctgcgccgcctccggcttcaccttcagctcctacgggatgcactgggtccgccaggcgccgggcaagggcctggagtgggtggccgtgatcagctacgacgggtccaacaagtactacgtcgacagcgtgcagggccggttcaccatctcccgcgacaacagcaagaacacgatgttcctccagatgaactccctgcggaccgaggacaccgccgtgtactactgcgcccgcgacctgggggagagcgaggtcgaggagtgggccaccgactactacgacttctccatcgcgtaccccgtggagggcccccgcggggtggtcggcatcttcgacatctggggccaggggacgatggtgaccgtgagctcc

SEQ ID NO: 9638 - RNA, 432 nt, synthetic construct
  misc_feature 1..432: note = derived and/or modified sequence opt1 from anti-HIV_cap256-059-207529_VR-Chain
  source 1..432: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgggatcagcttcgccggcatcaacaagtactacgggaactccgtgaagggccggttcaccatcagccgcgacaactcccggaacacgctctacctgcagatgaacagcctgcgcgccgaggacaccgccctctactactgcgcgcgggacctgcgcgagatggagtgcgaggagtgggcctccgactactacgacttcgggcggggcggcccctgccaggacccccgcggggtcgtgggcaccttcgacatctgggggcagggcaccatggtgacggtcagctcc

SEQ ID NO: 9639 - RNA, 435 nt, synthetic construct
  misc_feature 1..435: note = derived and/or modified sequence opt1 from anti-HIV_cap256-059-205541_VR-Chain
  source 1..435: mol_type = other RNA
cagatgcagctggtggagagcggcgggggcgtcgtgcagcccgggggctccctccgcctgagctgcgccgcctccgggttcagcttctcctactacgcgatggactgggtgcggcaggccccgggcaagggcctggagtgggtcgccttcatcagctccgacgggagcgacaagaactacgccgactccgtgaagggccgcttcaccatcagccgggacaactccaagaacaccctctacctgcagatgaacagcctgcgcgccgaggacacggcggtgtactactgcgccaaggacgtcgggggccacaagaacgacgagtgggccaccaactactactacgacatctccatcgcctaccccatccaggacccccgggcggtggccggggccttcgacgtgtggggccagggcaccatggtcaccgtgagctcc

SEQ ID NO: 9640 - RNA, 432 nt, synthetic construct
  misc_feature 1..432: note = derived and/or modified sequence opt1 from anti-HIV_cap256-059-188439_VR-Chain
  source 1..432: mol_type = other RNA
caggtgcagctggtcgagagcggcgggggcgtggtgcagcccgggcgctccctccggctgagctgcgccgcctcccagttcaccttcagcaactacggcatgcactgggtccgccaggcgccggggaagggcctggagtgggtggccgccatctccttcgccggcatcaacaagtactacaccgacagcgtgaaggggcggttcacgatctcccgcgacaacagcaagaacaccctctacctgcagatgaactccctgcgggccgaggacaccgcgctctactactgcgccaaggacctgcgcggcttcgagtgcgaggagtgggccagcgactactacgacttcgggcgggacctgccctgccaggacccccgcggcgtcgtggggaccttcgacgtgtggggccagggcacgaaggtcaccgtgtccagc

SEQ ID NO: 9641 - RNA, 432 nt, synthetic construct
  misc_feature 1..432: note = derived and/or modified sequence opt1 from anti-HIV_cap256-059-187234_VR-Chain
  source 1..432: mol_type = other RNA
caggtgcagctggtcgagagcggcgggggcgtggtgcaggccgggcgctccctccggctgagctgcgccgcgtcccagttcaccttcggcagctacgggatgcactgggtccgccaggcccccggcaagggcctggagtgggtggccgccatctccttcgccgggaccaagatccactacgcggacagcgtgaagggccggttcacgatctcccgcgacaacagcaagaacgccctctacctgcagatgcactccctgcgggccgaggacaccgccctctactactgcgcgaaggacctgcgcgagtacgagtgcgaggagtgggccagcgactactacgacttcgggcgggaccagccgtgccaggacccccgcggcgtcgtggggatcttcgacatctggggccagggcaccatggtgaccgtctccagc

SEQ ID NO: 9642 - RNA, 432 nt, synthetic construct
  misc_feature 1..432: note = derived and/or modified sequence opt1 from anti-HIV_cap256-059-187047_VR-Chain
  source 1..432: mol_type = other RNA
caggtgcagctggtcgagagcggcgggggcgtggtgcagcccgggcgctccctccggctgagctgcgccgtctcccagctgaccttcagctcctacggcatgcactgggtgcgccaggccccggggaagggcctcgagtgggtggcggccatcagcttcgtcggcatcaagaagtactacgccgactccgtgaaggggcggttcaccatcagccgcgacaactccaagaacacgctgtacctgcagatgaacagcctccgggtggaggacaccgccctgtactactgcgccaaggacctgcgcgagtacgagtgcgaggagtgggcgtccgactactacgacttcggccgggaccagccctgccaggacgcccgcggggtcgtgggcaccagcgacatctgggggcagggcaccatggtgacggtctccagc

SEQ ID NO: 9643 - RNA, 432 nt, synthetic construct
  misc_feature 1..432: note = derived and/or modified sequence opt1 from anti-HIV_cap256-059-186068_VR-Chain
  source 1..432: mol_type = other RNA
caggtgcagctggtcgagagcggcgggggcgtggtgcagcccgggcggtccctccggctgagctgcgccgcctcccagttcagcttctccaactacggcatgcactgggtccgccaggcgccggggaagggcctggagtgggtggccggcatcagcttcgccgccaccaagaagtactacgccgactccgtgaaggggcggttcagcgtctcccgcgacaacagcaagaacgcgctctacctgcagatgaactccctgcgggccgaggacaccgccctctactactgcgcccgcgacctgcgggactacgagtgcgaggagtgggcgagcgactactacgacttcggccgcgagtacccctgccaggacccccgcggggtggtgggcacgttcgacatctgggggcagggcaccatggtcaccgtgtccacc

SEQ ID NO: 9644 - RNA, 435 nt, synthetic construct
  misc_feature 1..435: note = derived and/or modified sequence opt1 from anti-HIV_cap256-059-182835_VR-Chain
  source 1..435: mol_type = other RNA
caggtgcagctggtcgagagcggcgggggcctcgtgcagcccgggcgctccctgcggctgagctgcgccgcctccggcttcagcttcaacaacttcgcgatggactgggtgcgccaggccccggggaagggcctcgagtgggtcgccttcgtgtccagcgacggctccaacaagaactacgccgacagcgtgaaggggcggttcatcatctcccgcgacaacagcaagaacaccgtctacctgcagatgaactccctgcgggtggaggacaccgccgtgtactactgcgcgaaggacctcggcgccaacaaggacgacgagtgggccacggactactactacgacctgagcgtcgcccgccccgtgcccgacccccgggcggtggtcggggccttcgacgtgtggggccaggggaccatggtgaccgtctccagc

SEQ ID NO: 9645 - RNA, 432 nt, synthetic construct
  misc_feature 1..432: note = derived and/or modified sequence opt1 from anti-HIV_cap256-059-176659_VR-Chain
  source 1..432: mol_type = other RNA
cgcgtgcagctggtcgagagcggcgggggcgtggtgcagcccgggcggtccctccgcctgagctgcgccgcctcccagttcagcttctccaactacggcatgcactgggtccggcaggcgccggggaagggcctggagtgggtggccggcatcagcttcgccgccatcaagaagtactacgccgactccgtgaaggggcgcttcaccatcagccgggacaactccaagaacgcgctctacctgcagatgaacagcctgcgcgccgaggacaccgccctctactactgcgcccgggacctgcgcgagtacgagtgcgaggagtgggcgtccgactactacgacttcggccgggagctgccctgccaggacccccgcggggtcgtgggcacgttcgacacctgggggcagggcaccatggtgaccgtcagcacg

SEQ ID NO: 9646 - RNA, 432 nt, synthetic construct
  misc_feature 1..432: note = derived and/or modified sequence opt1 from anti-HIV_cap256-059-172956_VR-Chain
  source 1..432: mol_type = other RNA
caggtgcagctggtcgagagcggcgggggcgtggtgcagcccgggcggtccctccggctgagctgcgccgcctcccagttcagcttctccagctacggcatgcactgggtccgccaggcgccggggaagggcctggagtgggtggccgccatgtccttcgccggcaccaaccagtactacgccgcgagcgtgaaggggcggttcaccatctcccgcgacaacagcaagaacacgctctacctgcacatgaactccctgcggcccgaggacaccgccctctactactgcgcccgcgacctgcgggagtacgagtgcgaggagtgggccgcggactactacgacttcggccgcgagtacccctgccaggacccccgcggggtcgtgggcatcttcgacgtgtgggggcagggcaccctggtcaccgtgagctcc

SEQ ID NO: 9647 - RNA, 432 nt, synthetic construct
  misc_feature 1..432: note = derived and/or modified sequence opt1 from anti-HIV_cap256-059-171272_VR-Chain
  source 1..432: mol_type = other RNA
caggtgctgctcgtcgagagcggcgggggcgtggtgcagcccgggcgctccctgcggctgagctgcgccgcctcccagttcaccttcagcaactacggcatgcactgggtccgccaggcgccggggaagggcctcgagtgggtggccgccatctccttcgccggcatgaagaagtactacgccgacagcgtgaaggggcggttcaccatctcccgcgacaacagcaagaacacgctgtacctgcagatgaactccctccgggcggaggacaccgccctgtactactgcgccaaggacctgcgcgagttcgagtgcgaggagtgggccagcgactactacgacttcggccgggcgcagccctgccaggacccccgcggggtcgtgggcaccttcgacctctgggggcagggcaccatggtgacggtctccagc

SEQ ID NO: 9648 - RNA, 432 nt, synthetic construct
  misc_feature 1..432: note = derived and/or modified sequence opt1 from anti-HIV_cap256-059-168734_VR-Chain
  source 1..432: mol_type = other RNA
caggtgcagctggtcgagagcggcgggggcgtggtgcagcccgggcgctccctccggctgagctgcaccgcctcccagttcagcttctccagctacggcatgcactgggtccgccaggccccggggaagggcctggagtgggtggcggccatctccttcgccggcaccaagaagtactacgtggggacggtcaagggccggttcaccatcagccgcgacaactccaagaacaccctctacctgcagatgaacagcctgcgggccgaggacaccgccctctactactgcgcgaaggacatgcgcgagtacgagtgcgaggagtgggcctccgactactacgacttcgggcgggagtacccctgccaggacccccgcggcgtggtggggacgttcgacatctggggccagggcaccatggtcaccgtgagctcc

SEQ ID NO: 9649 - RNA, 432 nt, synthetic construct
  misc_feature 1..432: note = derived and/or modified sequence opt1 from anti-HIV_cap256-059-155838_VR-Chain
  source 1..432: mol_type = other RNA
caggtgcagctggtcgagagcggcgggggcgtggtgcagcccgggcgctccctccggctgagctgcgccgtctcccagttcaccttcagcaactacggcatgcactgggtgcgccaggccccggggaagggcctggagtgggtggcggccatctccttcgccggcaccaagaagtcctacgccgccagcgtcaaggggcggttcacgatcagccgcgacaactccaagaacaccctctacctgcagatgaacagcctgcggcccgaggacaccgcgctctactactgcgccaaggacatgcgcggcttcgagtgcgaggagtgggcctccgactactacgacttcgggcgggagcagccctgccaggacccccgcggcgtggtggggatcttcgacctgtggggccagggcaccatggtcagcgtgtccagc

SEQ ID NO: 9650 - RNA, 432 nt, synthetic construct
  misc_feature 1..432: note = derived and/or modified sequence opt1 from anti-HIV_cap256-059-149799_VR-Chain
  source 1..432: mol_type = other RNA
caggtgcacctggtcgagagcggcgggggcgtggtgcagcccgggcgctccctccggctgagctgcgccgcctcccagttcaccttcagcaactacggcttccactgggtccgccaggcgccggggaagggcctggagtgggtggccgccatctccttcgccggcgtgaagaagcactacgccgacagcgtcaaggggcggttcaccatctcccgcgacaacagcaagaacacgctctacctgcagctgaactccctccgggcggaggacaccgccctgtactactgcgccaaggacctgcgcgagtacgagtgcgaggagtgggccagcgactactacgacttcggccgggacttcccctgccaggacccccgcggggtggtgggcaccttcgacatctgggggcagggcaccatggtcacggtgtccagc

SEQ ID NO: 9651 - RNA, 432 nt, synthetic construct
  misc_feature 1..432: note = derived and/or modified sequence opt1 from anti-HIV_cap256-059-148168_VR-Chain
  source 1..432: mol_type = other RNA
caggtgcagctggtcgagagcggcgggggcgtggtgcagcccgggcgctccctccggctgagctgcaccgcctcccagttcaccttcagcaactacggcatgcactgggtccgccaggccccggggaagggcctggagtgggtggcgggcatctccttcgccgccacgaagaagtactacagcgactccgtgaaggggcggttcaccatcagccgcgacaactccaagaacgccctctacctgcagatgaacagcctgcgggccgaggacaccgcgctctaccactgcgccaaggacctgcgcgagtacgagtgcgaggagtgggcctccgactactacgacttcggccgggagcagccctgccaggacccccgcggggtcgtgggcaccttcgacatctgggggcagggcacgatggtgaccgtcagcacc

SEQ ID NO: 9652 - RNA, 435 nt, synthetic construct
  misc_feature 1..435: note = derived and/or modified sequence opt1 from anti-HIV_cap256-059-144685_VR-Chain
  source 1..435: mol_type = other RNA
caggtgcacctggtcgagagcggcgggggcgtggtgcagcccgggcgctccctccggctgagctgcgccgcctccggcttcaccttcagcaacttcgcgatggactgggtccgccaggccccggggaagggcctggagtgggtggccttcgtgtccagcgacggcaacaacaagaactacggggactccgtcaagggccggttcaccatcagccgcgacaactccaagaacaccctcttcctgcagatgaacagcctgcgggccgaggacacggccctctactactgcgtgaaggacgtgggggactacaagtccgacgagtgggcgacccactactactacgacctgagcatcgccgaccccatccaggacccccgcgccgtcgtgggcgccttcgacatctgggggcggggcaccatggtggcggtctccagc

SEQ ID NO: 9653 - RNA, 432 nt, synthetic construct
  misc_feature 1..432: note = derived and/or modified sequence opt1 from anti-HIV_cap256-059-140017_VR-Chain
  source 1..432: mol_type = other RNA
caggtgcagctggtcgagagcggcgggggcgtggtgcagcccgggcgctccctccggctgagctgcgccgcctcccagttcagcttcggcaacttcgggatgcactgggtccgccaggcgccgggcaagggcctggagtgggtggccgggatctccttcgccggcaccaagaagtactacgccgacagcgtgaaggggcggttcaccatctcccgcgacaacagcaagtccgccctcttcctgcagatgaacagcctgcgggcggaggacacggccctctactactgcgccaaggacctgcgctactacgagtgcgaggagtgggcctccgactactacgacttcggccgggaccagccctgccaggacccccgcggggtcgtgggcaccttcgacatgtggggccaggggaccatggtgaccgtcagctcc

SEQ ID NO: 9654 - RNA, 432 nt, synthetic construct
  misc_feature 1..432: note = derived and/or modified sequence opt1 from anti-HIV_cap256-059-137547_VR-Chain
  source 1..432: mol_type = other RNA
caggtgcagctggtcgagagcggcgggggcgtggtgcagcccgggcgctccctccggctgagctgcgccgcctcccagttcaccttcagccgctacggcatgcactgggtccggcaggcgccggggaagggcctggagtgggtggccgccatctccttcgccggcatcaagaagaactacgccgacagcgtgaaggggcgcttcaccatctcccgggacaacagcaagaacacgctctacctgcagatgaactccctgcgcgcggaggacaccgccctctactactgcgcccgggacctgcgcgagttcgagtgcgaggagtgggccagcgactactacgacttcggccgggacttcccctgccaggacccccgcggggtcgtgggcatcttcgacatctgggggcagggcaccatggtgaccgtctccagc

SEQ ID NO: 9655 - RNA, 435 nt, synthetic construct
  misc_feature 1..435: note = derived and/or modified sequence opt1 from anti-HIV_cap256-059-131908_VR-Chain
  source 1..435: mol_type = other RNA
caggtgcagctggtcgagagcggcgggggcgtggtgcagcccgggcgctccctccggctgagctgcaccgcctccggcttcaccttcagcaactacgggatccactgggtccgccaggccccgggcaagggcctggagtgggtggcggccatctcctacgaggggagcatcaagtactacgtggactccgtcaagggccggttcacgatcagccgcgacgactccaagaacaccctcttcctgcagatgaacagcctgcggaccgaggacaccgccgtgtactactgcacgcgcgacgtgcgggagtgggagaccgaggagtgggccaccaactactactacgacctctccatcgcctaccccatccgccacccccgcggggtcgtgggcatcttcgacgtgtgggggctgggcacccgggtcacggtgagctcc

SEQ ID NO: 9656 - RNA, 432 nt, synthetic construct
  misc_feature 1..432: note = derived and/or modified sequence opt1 from anti-HIV_cap256-059-116006_VR-Chain
  source 1..432: mol_type = other RNA
caggcccagctggtggagagcggcgggggcgtcgtgcagcccgggcgctccctccggctgagctgcgccgcgtcccagttcagcttctccagctacggcatgcactgggtgcgccaggccccggggaagggcctggagtgggtcgcctccatcagcttcgccggcgtgaagaagaccaacgccgactccgtgaaggggcggttcaccatcagccgcgacaactccaagaacacgctccacctccagatgaacggcctgcggaacgacgacaccgcgctgtactactgcgcccgcgacctgcgggacttcgagtgcgaggagtgggccagcgactactacgacttcgggcgcgagttcccctgccaggacccccggggcgtcgtggggaccttcgacatctggggccagggcaccaaggtgacggtctccagc

SEQ ID NO: 9657 - RNA, 411 nt, synthetic construct
  misc_feature 1..411: note = derived and/or modified sequence opt1 from anti-HIV_cap256-059-115783_VR-Chain
  source 1..411: mol_type = other RNA
caggtgcagctggtcgagagcggcgggggcgtggtgcagcccgggcgctccctccggctgagctgcgccgcctcccagttcaccttcagctcctacggcatgcactgggtccgccaggcgccggggaagggcctggagtgggtggccgccatcagctacgccgactccgtgaagggccggttcaccatcagccgcgacaactccaagaacacgctctacctgcagatgaacagcctgcgggccgaggacaccgcgctctactactgcgccaaggacctgcgcgagatggagtgcgaggagtgggcctccgactactacgacttcgggcgggacctgccctgccaggacccccgcggcgtcgtggggaccctcgacatctggggccaggggaccatggtgacggtcagctcc

SEQ ID NO: 9658 - RNA, 432 nt, synthetic construct
  misc_feature 1..432: note = derived and/or modified sequence opt1 from anti-HIV_cap256-059-114609_VR-Chain
  source 1..432: mol_type = other RNA
caggtgcagctggtcgagagcggcgggggcgtggtgcagcccgggcgctccctccggctgagctgcgccgcctcccagctgaccttcagcaacttcggcatgcactgggtccgccaggcgccggggaagggcctcgagtgggtggccggcatctccttcgccgggaccaagaagtactacgccgacagcgtgaagggccggttcacgatctcccgcgacaacagcaagaacgccctgtacctgcagatgaacaccctccgggcggaggacaccgccctgtacttctgcgccaaggacctgcgcgagtacgagtgcgaggagtgggcctccgactactacgacttcgggcgggaccagccctgccaggacccccgcggcgtcgtggggatcttcgacatctggggccagggcaccatggtgacggtcagctcc

SEQ ID NO: 9659 - RNA, 432 nt, synthetic construct
  misc_feature 1..432: note = derived and/or modified sequence opt1 from anti-HIV_cap256-059-113952_VR-Chain
  source 1..432: mol_type = other RNA
caggcccagctggtggagagcggcgggggcgtcgtgcagcccgggcgctccctccggctgagctgcgccgcgtcccacttcaccttcagctcctacggcttccactgggtgcgccaggccccggggaagggcctggagtgggtcgccggcatcagcttcgccgccaccaagaagtactacgcggactccgtgaaggggcggttcacgatcagccgcgacaactccaaggacgccctctacctgcagatgaacagcctgcgggccgaggacaccgccctctactactgcgcgcgcgacctgcggggctacgagtgcgaggagtgggcctccgactactacgacttcgggcgcgaccagccctgccaggacccccggggcgtggtcgggatcttcgacctgtggggccagggcaccatggtgaccgtgagctcc

SEQ ID NO: 9660 - RNA, 432 nt, synthetic construct
  misc_feature 1..432: note = derived and/or modified sequence opt1 from anti-HIV_cap256-059-113878_VR-Chain
  source 1..432: mol_type = other RNA
caggtgcagctggtcgagagcggcgggggcgtggtgcagcccgggcgctccctgcggctgagctgcgccgcctccggcttcaccttcagcacctacgcgatgcactgggtccgccaggccccggggaagggcctggagtgggtggccctcatctcctacgacgccacgaacaagtactacgtggacagcgtcaagggccggttcaccatctcccgcgacaacagcaagaacaccctgtacctgcagatgtccagcctcaccgccgaggacacggcggtgtactactgcgccaaggacctcgggggcatcaagatcgacgagtgggggaccgactactacgacatctccgtgagctaccccgtccaggacccccgggccgtggccggcatcttcgacgtgtgggggcacggcaccatggtctccgtgagctcc

SEQ ID NO: 9661 - RNA, 432 nt, synthetic construct
  misc_feature 1..432: note = derived and/or modified sequence opt1 from anti-HIV_cap256-059-113622_VR-Chain
  source 1..432: mol_type = other RNA
caggtgcagctggtcgagagcggcgggggcgtggtgcagcccgggcgctccctccggctgagctgcgccgcctcccagttcaccttcaccagctacggcatgcactgggtccgccaggcgccggggaagggcctggagtgggtggccggcatctccttcgccgggacgaagaagcactacgccgacagcgtgaagggccggttcaccatctcccgcgacaacagcaagtccaccctctacctgcagatgaacagcctgcgggccgaggacaccgcgctctactactgcgccaaggacatgcgcgagtacgagtgcgaggagtgggcctccgactactacgacttcgggcgggaccagccctgccaggacccccgcggcgtcgtggggatcttcgacctgtggggccagggcacgatggtgaccgtcagctcc

SEQ ID NO: 9662 - RNA, 432 nt, synthetic construct
  misc_feature 1..432: note = derived and/or modified sequence opt1 from anti-HIV_cap256-059-109427_VR-Chain
  source 1..432: mol_type = other RNA
caggtgcagctggtcgagagcggcgggggcgtggtgcagcccgggcggtccctccggctgagctgcgccgcctcccagttcaccttcagcaactacggcatgcactgggtccgccaggcgccggggaagggcctggagtgggtggcctccatcagcttcgccggcatcaagaagcactacaccgactccgtgaaggggcggttcacgatcagccgcgacaactccaagaacaccctcttcctgcagatgaacagcctgcgggccgaggacaccgccctctactactgcgcgcgcgacctgcgggagtacgagtgcgaggagtgggcctccgactactacgacttcggccgcgaccagccctgccaggacccccgcggggtcgtgggcaccagcgacatctgggggcagggcacgaaggtgaccgtctccagc

SEQ ID NO: 9663 - RNA, 432 nt, synthetic construct
  misc_feature 1..432: note = derived and/or modified sequence opt1 from anti-HIV_cap256-059-109081_VR-Chain
  source 1..432: mol_type = other RNA
caggagcagctggtggagagcggcgggggcgtcgtgcagcccgggcgctccctccggctgagctgcgccgcctcccagttcagcttctccgcgtacggcatgcactgggtgcgccaggccccggggaagggcctggagtgggtcgccggcatcagcttcgccgccaccaagaagtactacgaggactccgtgaaggggcggttcaccatcagccgcgacaactccaagaacacgctctacctgcagatgaacagcctgcggggcgaggacaccgcgctctactactgcgccaaggacatgcgcgagatggagtgcgaggagtgggcctccgactactacgacttcgggcggccccagccctgccaggacccccgcggcgtggtcgggatcttcgacatgtggggccagggcaccatggtgaccgtgagctcc

SEQ ID NO: 9664 - RNA, 432 nt, synthetic construct
  misc_feature 1..432: note = derived and/or modified sequence opt1 from anti-HIV_cap256-059-107590_VR-Chain
  source 1..432: mol_type = other RNA
caggagcagctggtggagagcggcgggggcgtcgtgcagcccgggcgctccctccggctgagctgcgccgcctcccagttcagcatctccgcgtacggcatgcactgggtgcgccaggccccggggaagggcctggagtgggtcgccggcatcagcttcgccgggaccaagaagtactacgccgactccgtgaagggccggttcaccatcagccgcgacaactccaagaacacgctctacctgcagatgaacagcctgcgcggggaggacaccgcgctctactactgcgccaaggacatgcgggagatggagtgcgaggagtgggcctccgactactacgacttcggccgggaccagccctgccaggacccccgcggggtggtcggcatcttcgacatgtggggccaggggaccatggtgaccgtgagctcc

SEQ ID NO: 9665 - RNA, 435 nt, synthetic construct
  misc_feature 1..435: note = derived and/or modified sequence opt1 from anti-HIV_cap256-059-107504_VR-Chain
  source 1..435: mol_type = other RNA
caggtgctgctcgtcgagagcggcgggggcgtggtgcagcccgggaagtccctgcgcctgagctgctccgccagccggttcaccttctccaactacggcatgcactgggtccgccaggccccggggaagggcctcgagtgggtggcggccgtgagcttcgccggcatcaagaagaccaacgccgactccgtcaaggggcggttcacgatcagccgcgacaactccaagaacaccctgtacctgcagatgaacagcctccgggccgaggacaccgcgctgtactactgcgcccgcgacctgcgggacttcgagtgcgaggagtgggcctccgactactacgacttctggggcgacccccagccctgccaggacccccgcggggtggtgggcaccttcgacctctgggggcagggcacgatggtcaccgtgagctcc

SEQ ID NO: 9666 - RNA, 432 nt, synthetic construct
  misc_feature 1..432: note = derived and/or modified sequence opt1 from anti-HIV_cap256-059-099614_VR-Chain
  source 1..432: mol_type = other RNA
gaggtgctgctcctggagagcggcgggggcctggtccagcccgggcgctccctccggctgagctgcgccgcctcccagttcaccttcagctcctacggcatgcactgggtgcgccaggcgccggggaagggcctggagtgggtggccggcatcagcttcgtcgggatcaagaagtactacgccgactccgtgaagggccggttcaccatcagccgcgacaactccaagaacacgctctacctgcagatgaacagcctgcgggccgaggacaccgccctctactactgcgcgcgcgacctgcgggagtacgagtgcgaggagtgggcctccgactactacgacttcgggcgcgaccagccctgccaggacccccggggcgtggtcgggaccttcgacatctggggccagggcaccatggtgacggtgagctcc

SEQ ID NO: 9667 - RNA, 432 nt, synthetic construct
  misc_feature 1..432: note = derived and/or modified sequence opt1 from anti-HIV_cap256-059-098972_VR-Chain
  source 1..432: mol_type = other RNA
caggtgcagctggtcgagagcggcgggggcgtggtgcagcccgggcgctccctccggctgagctgcgccgcctcccagttcaccttcagctcctacggcatgcactgggtccgccaggcgccggggaagggcctggagtgggtggccagcatctccttcgccggcatcaagaagaactaccgggacagcgtgaaggggcgcttcaccatctcccgggacaacagcaagaacacgctctacctgcagatgacctccctgcgccccgaggacaccgccctctactactgcgccaaggacctgcggggcttcgagtgcgaggagtgggcgagcgactactacgacttcgggcgcgagctgccctgccaggacccccggggcgtcgtggggaccttcgacatgtggggccagggcacgatggtgaccgtctccagc

SEQ ID NO: 9668 - RNA, 432 nt, synthetic construct
  misc_feature 1..432: note = derived and/or modified sequence opt1 from anti-HIV_cap256-059-097236_VR-Chain
  source 1..432: mol_type = other RNA
caggtgcagctggtcgagagcggcgggggcgtggtgcagcccgggcgctccctccggctgagctgcgccgcctccggcttcagcttctccaacttcgggttccactgggtccgccaggcgccgggcaagggcctggagtgggtggccgccatcagcttcgtggggaacaagaagtactacgccgagtccgtcaagggccggttcaccatcagccgcgagaactccaagaacatgctgttcctccagatgaacagcctgcgcggggaggacaccgccgtgtactactgcgcgaaggacctccgggagttcgagtgcgaggagtgggcctccgactactacgacttcggccgggagcagccctgccaggacccccgcggggtggtcggcagcatcgacgtgtggggccacgggtccctggtgacggtcagctcc

SEQ ID NO: 9669 - RNA, 432 nt, synthetic construct
  misc_feature 1..432: note = derived and/or modified sequence opt1 from anti-HIV_cap256-059-091487_VR-Chain
  source 1..432: mol_type = other RNA
caggtgcagctggtcgagagcggcgggggcgtggtgcagcccgggcgctccctccggctgagctgcgccgcctcccagttcaccttcaaccgctacggcatgcactgggtccggcaggcgccggggaagggcctggagtgggtggccgtgatcagctacgacggcaccaacaagtactacggggagtccgtcaagggccgcttcacgatcagccgggacaactccaagaacaccctctacctgcagatgaacagcctgcgcgccgaggacaccgccctctactactgcgccaaggacctgcgggaggacgagtgcgaggagtggtggtccgactactacgacttcgggcgcgagctgccctgccgcaagagccggggcgtggcggggatcttcgacatctggggccagggcaccatggtgacggtctccagc

SEQ ID NO: 9670 - RNA, 432 nt, synthetic construct
  misc_feature 1..432: note = derived and/or modified sequence opt1 from anti-HIV_cap256-059-089812_VR-Chain
  source 1..432: mol_type = other RNA
caggtgcagctggtcgagagcggcgggggcgtggtgcagcccgggcgctccctccggctgagctgcgccgcctcccagctgaccttcagctcctacggcatgcactgggtccgccaggcgccggggaagggcctcgagtgggtggccggcatcagcttcgccgggaccaagaagcactactccgacagcgtgaagggccggttcacgatctcccgcgacaacagcaagaacgccctgtacctgcagatgaactccctccgggccgaggacaccgcgctgtactactgcgccaaggacctgcgcgagtacgagtgcgaggagtgggccagcgactactacgacttcgggcgggagcagccctgccaggacccccgcggcgtcgtggggatcttcgacatgtggggccagggcaccatggtgaccgtctccagc

SEQ ID NO: 9671 - RNA, 432 nt, synthetic construct
  misc_feature 1..432: note = derived and/or modified sequence opt1 from anti-HIV_cap256-059-088468_VR-Chain
  source 1..432: mol_type = other RNA
caggtgcagctggtcgagagcggcgggggcgtggtgcagcccgggcggtccctccggctgagctgcgccgcctcccagttcaccttcagctcctacggcatgcactgggtccgccaggcgccggggaagggcctggagtgggtggccgccatcagcttcgtgggcatcaagaagtactacgccaactccgtcaaggggcggttcaccatcagccgcgacaactccaagaacacgctctacctgcagatgaacagcctgcgggccgaggacaccgcgctctactactgcgcccgcgacctgcgggagtacgagtgcgaggagtgggcctccgactactacgacttcggccgcgggggcccctgccaggacccccgcggggtggtgggcagcttcgacatctggggccaggggaccatggtcaccgtgtccagc

SEQ ID NO: 9672 - RNA, 432 nt, synthetic construct
  misc_feature 1..432: note = derived and/or modified sequence opt1 from anti-HIV_cap256-059-088341_VR-Chain
  source 1..432: mol_type = other RNA
caggtgcagctggtcgagagcggcgggggcgtggtgcagcccgggcggtccctccggctgagctgcgccgcctcccagttcaccttcagctcctacggcatgcactgggtccgccaggcgccggggaagggcctggagtgggtggccgccatcagcttcgccggcatcaagaagcactacgccgactccgtgaaggggcggttcaccatcagccgcgacaactccaagaacatggtcttcctccagatgaacagcctgcgggcggaggacacggccctgtactactgcgcccgcgacctccgggagtacgagtgcgaggagtgggcctccgactactacgacttcggccgcgaccagccctgccaggacccccgcggggtggtgggcaccagcgacatctgggggcagggcaccatggtcaccgtgtccagc

SEQ ID NO: 9673 - RNA, 432 nt, synthetic construct
  misc_feature 1..432: note = derived and/or modified sequence opt1 from anti-HIV_cap256-059-086533_VR-Chain
  source 1..432: mol_type = other RNA
caggtgctgctcgtcgagagcggcgggggcgtggtgcagcccgggcgctccctgcggctgagctgcgccgcctcccagttcaccttcagcaacttcggcatgcactgggtccgccaggcgccggggaagggcctcgagtgggtggccggcatctccttcgtggggatcaagaagtactacgccggcagcgtcaaggggcggttcaccatctcccgcgacaacagcaagaacacgctgtacctgcagatgaactccctccgggccgaggacaccgccctgtactactgcgcgaaggacctgcgcgagttcgagtgcgaggagtgggccagcgactactacgacttcggccggccccagccctgccaggacccccgcggggtggtgggcaccttcgacctctggggcctggggaccctggtcacggtgtccagc

SEQ ID NO: 9674 - RNA, 432 nt, synthetic construct
  misc_feature 1..432: note = derived and/or modified sequence opt1 from anti-HIV_cap256-059-086043_VR-Chain
  source 1..432: mol_type = other RNA
gaggtgcacctggtcgagagcggcgggggcctcgtgaagcccgggggctccctgcgcctgagctgcgccgcctccgggttcaccttcagcacctactccatgaactgggtgcggcaggcgccgggcaagggcctcgagtgggtcgccttcgtggccttcgacgagagcgacaagtactacgccgactccgtgaaggggcgcttcacgatcagccgggacaactccaagaacaccctgagcctgcagatgaactccctccgcgtcgaggacaccgccatctactactgcgcgaaggaggtgggcgacaacaaggacgacgagtgggccagcgactactacgacctgtccatcgcctaccccatccaggacccccgggccgtggggcgcggctacgacatctgggggcagggcaccatggtcacggtgagctcc

SEQ ID NO: 9675 - RNA, 432 nt, synthetic construct
  misc_feature 1..432: note = derived and/or modified sequence opt1 from anti-HIV_cap256-059-084191_VR-Chain
  source 1..432: mol_type = other RNA
caggtgcagctggtcgagagcggcgggggcgtggtgcagcccgggcggtccctccggctgagctgcgccgcctcccagttcaccttcagctcctacggcatgcactgggtccgccaggcgccggggaagggcctggagtgggtggccgccatcagcttcgtgggcatcaagaagtactacgccgactccgtcaaggggcggttcaccgtgagccgcgacaactccaagagcacgctctacctgcagatgaactccctgcgggccgaggacaccgcgctctactactgcgcccgcgacctgcgggagtacgagtgcgaggagtgggccagcgactactacgacttcggccgcgaccagccctgccaggacccccgcggggtggtcggcatcttcgacatctgggggcagggcaccgccgtgaccgtgtccagc

SEQ ID NO: 9676 - RNA, 417 nt, synthetic construct
  misc_feature 1..417: note = derived and/or modified sequence opt1 from anti-HIV_cap256-059-082135_VR-Chain
  source 1..417: mol_type = other RNA
caggtgcagctggtcgagagcggcgggggcgtggtgcagcccgggcgctccctccggctgagctgcaccgcctccggcttcaccttccgcagctacgccatccactgggtccggcaggcgccggggaagggcctggagtgggtggccctcatctcctacgacggcagcaacaagtactacgccgactccgtgaaggggcgcttcacgatcagccgggacaactccaagaacaccctgtacctgcagatgaacagcctcacctccgaggacaccgccgtctactactgcgccaaggacctgggcgggagcaagacggacgagtggggcaccgactactgctaccccgtgcaggacccccgcgtggtcgtgggggcgttcgacatctggggccacggcaccatggtgaccgtctccagc

SEQ ID NO: 9677 - RNA, 432 nt, synthetic construct
  misc_feature 1..432: note = derived and/or modified sequence opt1 from anti-HIV_cap256-059-079417_VR-Chain
  source 1..432: mol_type = other RNA
caggtgcagctggtcgagagcggcgggggcgtggtgcagcccgggcgctccctccggctgagctgcgccgcctccggcttcagcttctccaactacgcgatggactgggtccgccaggccccggggaagggcctggagtgggtggccttcgtgagctccgacggcaacaacaagaagtacgccgacagcgtcaaggggcggttcaccctctcccgcgacaactacaagaacaccgtgtacctgcagatgaacagcctgacggtggaggacaccgccgtctactactgcgcgaaggacctcggcgccaacaaggacgacgagtgggggaccgactactacgacatgtccgtgagctaccccatccccgacccccgggccgtggtcggcgccttcgacgtgtgggggcagggcaccctggtgacggtctccagc

SEQ ID NO: 9678 - RNA, 435 nt, synthetic construct
  misc_feature 1..435: note = derived and/or modified sequence opt1 from anti-HIV_cap256-059-076027_VR-Chain
  source 1..435: mol_type = other RNA
caggtgcagctggtcgagagcggcgggggcgtggtgcagcccgggcgctccctccggctgagctgcgccgcctccggcttcagcttctccaagtacgggatgcactgggtccgccaggcgccgggcaagggcctggagtgggtggccttcgtggccttcgacgagagcgagaagtactacgccgcctccgtcaaggggcggttcaccatcagccgcgacaactccaagaacaccctcagcctgcagatgaactccctgcggacggaggacaccgcgatctactactgcgccaaggaggtgggcgacaacaaggacgacgagtggaccagcccctactactacgacatctccatcgcctaccccgtgcacgacccccgcgccgtcgtgggggtgagcgacgtctggggccaggggaccatggtgacggtgtccagc

SEQ ID NO: 9679 - RNA, 432 nt, synthetic construct
  misc_feature 1..432: note = derived and/or modified sequence opt1 from anti-HIV_cap256-059-075082_VR-Chain
  source 1..432: mol_type = other RNA
caggtgcagctggtcgagagcggcgggggcgtggtgcagcccgggcgctccctccggctgagctgcgccgcctcccagttcaccttcagctcctacggcatgcactgggtccgccaggcgccggggaagggcctggagtgggtggccgccatcagcttcgtgggcatcaagaagtactacgccgactccgtcaaggggcggttcaccatcagccgcgacaactccaagaacacgctctacctgcagatgaacagcctgcgggccgaggacaccgcgctctactactgcgccaaggacctgcgcgagatggagtgcgaggagtgggcctccgactactacgacttcggccgggacctgccctgccaggacccccgcggggtggtgggcaccctcgacatctgggggcagggcaccatggtcacggtgagctcc

SEQ ID NO: 9680 - RNA, 432 nt, synthetic construct
  misc_feature 1..432: note = derived and/or modified sequence opt1 from anti-HIV_cap256-059-072575_VR-Chain
  source 1..432: mol_type = other RNA
cagggccagctggtggagagcgggggcggggtcgtgcagcccggccggtccctccggctgagctgcgccgcctcccagttcaccttcagcaacttcgggatgcactgggtgcgccaggcgccgggcaagggcctggagtgggtcgccgtgatctcctacgacgggaccaagaagtactacgccgacagcgtgaagggccggttcacgatctcccgcgacaacagcaagaacaccctctacctgcagatgaactccctgcgggccgaggacaccgccctctactactgcgcgaaggacatgcgcgaggacgagtgcgaggagtggggcgccgactactacgacttcgggaaggactacccctgccaggccagccgcggggtcgtgggcatcttcgacatctggggccaggggaccatggtgacggtctccgcc

SEQ ID NO: 9681 - RNA, 432 nt, synthetic construct
  misc_feature 1..432: note = derived and/or modified sequence opt1 from anti-HIV_cap256-059-071926_VR-Chain
  source 1..432: mol_type = other RNA
caggtgcagctggtcgagagcggcgggggcgtggtgcagcccgggcgctccctccggctgagctgcgccgcctcccagctgagcttctccaactacggcatgcactgggtccgccaggcgccggggaagggcctcgagtgggtggccggcatcagcttcgtggggatcaagaagtactaccgggactccgtcaagggccgcttcaccatcagccgggacaactccaagaacaccctgtacctgcagatgaacagcctccgcacggaggacaccgccctgtactactgcgtgaaggacctgcgggagttcgagtgcgaggagtgggcctccgactactacgacttcgggcgcgaccagccctgcctcgacccccggggcgtggtcgggaccttcgacatctggggccagggcaccatggtgacggtgagctcc

SEQ ID NO: 9682 - RNA, 432 nt, synthetic construct
  misc_feature 1..432: note = derived and/or modified sequence opt1 from anti-HIV_cap256-059-069638_VR-Chain
  source 1..432: mol_type = other RNA
caggtgcagctggtcgagagcggcgggggcgtggtgcagcccgggcgctccctccggctgagctgcgccgcctccggcttcaccttcagcaagaacgcgatgcactgggtccgccaggccccggggcggggcctggagtgggtggcctccgtggccttcgacggcagcgacaagtactacgccgactccgtcaaggggcgcttcaccatcagccgggacaactccaagaacacgctcagcctgcagatgaactccctgcgcgcggaggacaccgccgtgtactactgcgccaaggaggtggacctctacaaggacgacgagtggggcagcgactactacgacctgtccatcgcctaccccatccaggacccccgggcggtcgtcgggggcttcgggatctggggccagggcaccatggtgaccgtgagctcc

SEQ ID NO: 9683 - RNA, 432 nt, synthetic construct
  misc_feature 1..432: note = derived and/or modified sequence opt1 from anti-HIV_cap256-059-069165_VR-Chain
  source 1..432: mol_type = other RNA
ctggtgcagctcgtcgagagcggcgggggcgtggtgcagcccgggcgctccctgcggctgagctgcgccgcctcccgcttcaccttcagcaactacggcatgcactgggtccggcaggcgccggggaagggcctcgagtgggtggccggcatctccttcgccgggaccacgaagtactacgccgacagcgtgcgcggccggttcaccatctcccgcgacaacagcaagaacaccctgtacctgcagatgaactccctccgggccgaggacaccgcgctgtactactgcgccaaggacatgcgcgagatggagtgcgaggagtgggccagcgactactacgacttcgggcggccccagccctgccaggacccccgcggcgtcgtggggatcttcgacatctggggccagggcacgatggtgaccgtctccagc

SEQ ID NO: 9684 - RNA, 432 nt, synthetic construct
  misc_feature 1..432: note = derived and/or modified sequence opt1 from anti-HIV_cap256-059-068956_VR-Chain
  source 1..432: mol_type = other RNA
caggtgcagctggtcgagagcggcgggggcgtggtgcagcccgggcgctccctccggctgagctgcgccgcctccggcttcaccttcagcacctacgcgatgcactgggtccgccaggccccggggcggggcctggagtgggtggccctcatctcctacgacggcagcaacaagtactacgtggactccgtcaaggggcgcttcacgatcagccgggacaactccaagaacaccctgtacctgcagatgaacagcctcaccgccgaggacaccgccgtgtactactgcgcgaaggacctgggcgggtccaaggacgacgagtgggccacggactactacgacctgagcatcgcctaccccatccaggacccccgcgccgtggcgggcatcttcgacgtctgggggcggggcaccgtggtgaccgtctccagc

SEQ ID NO: 9685 - RNA, 432 nt, synthetic construct
  misc_feature 1..432: note = derived and/or modified sequence opt1 from anti-HIV_cap256-059-068876_VR-Chain
  source 1..432: mol_type = other RNA
caggtgcagctggtcgagagcggcgggggcgtggtgcagcccgggcgctccctccggctgagctgcgccgcctcccagttcaccttcagctcctacggcatgcactgggtccgccaggcgccggggaagggcctggagtgggtggccgccatcagcttcgccggcaccaagaagtactacgccaactccgtgaaggggcggttcacgatcagccgcgacaactccaagaacaccctcagcctgcagatgaactccctgcggggcgaggacaccgcgcgctactactgcgcccgggacccccgcgagtacgagtgcgaggagtgggccagcgactactacgacttcgggcgggaccagccctgccaggacccccgcggcgtcatcgggatcttcgacatctggggccagggcaccatggtgacggtgtccagc

SEQ ID NO: 9686 - RNA, 432 nt, synthetic construct
  misc_feature 1..432: note = derived and/or modified sequence opt1 from anti-HIV_cap256-059-067733_VR-Chain
  source 1..432: mol_type = other RNA
caggtgcagctggtcgagagcggcgggggcgtggtgcagcccgggcgctccctccggctgagctgcaccgcctcccagttcagcttctccagctacggcatgcactgggtccgccaggccccggggaagggcctggagtgggtggcggccatctccttcgccggcaccaagaagaactacgtggacagcgtcaaggggcggttcacgatctcccgcgacaacagcaagaacaccctctacctgcagatgaactccctgcgggccgacgacaccgccctctactactgcgcgaaggacatgcgcgagtacgagtgcgaggagtgggccagcgactactacgacttcggccgggagtacccctgcaccgacccccgcggggtggtgggcacgttcgacgtctgggggcagggcaccatggtgaccgtgtccagc

SEQ ID NO: 9687 - RNA, 432 nt, synthetic construct
  misc_feature 1..432: note = derived and/or modified sequence opt1 from anti-HIV_cap256-059-067450_VR-Chain
  source 1..432: mol_type = other RNA
caggtgcagctggtcgagagcggcgggggcgtggtgcagcccgggcgctccctccggctgagctgcgccgcctcccagttcaccttcagcaactacggcatgcactgggtccgccaggcgccggggaagggcctggagtgggtggccggcatctccttcgccgggatcaagaagtactacgccgacagcgtgaagggccggttcaccatctcccgcgacaacgccaagaacacgctctacctgcagatgaacagcctgcgggcggaggacaccgccctctactactgcgccaaggacctgcgcgagtacgagtgcgaggagtgggcctccgactactacgacttcgggcgggagctgccctgccaggacccccgcggcgtcgtggggaccttcgacatctggggccagggcaccatggtgacggtcagctcc

SEQ ID NO: 9688 - RNA, 432 nt, synthetic construct
  misc_feature 1..432: note = derived and/or modified sequence opt1 from anti-HIV_cap256-059-065694_VR-Chain
  source 1..432: mol_type = other RNA
caggtgcagctggtcgagagcggcgggggcgtggtgcagcccgggcgctccctccggctgagctgcgccgcctcccagctgaccttcaacaactacggcatgcactgggtccgccagaccccggggaagggcctcgagtgggtggcgggcatcagcttcgccgggatcaacaagtactacgccgactccgtgaagggccggttcacgatcagccgcgacaactccaagaacgccctgtacctgcagatgaccagcctccgggccgaggacaccgcgctgtactactgcgtcaaggacctgcgcgagatggagtgcgaggagtgggcctccgactactacgacttcgggcgggaccagccctgccaggacccccgcggcgtggtggggaccttcgacatctggggccagggcacgatggtcaccgtgagctcc

SEQ ID NO: 9689 - RNA, 432 nt, synthetic construct
  misc_feature 1..432: note = derived and/or modified sequence opt1 from anti-HIV_cap256-059-065109_VR-Chain
  source 1..432: mol_type = other RNA
caggtgcagctggtcgagagcggcgggggcgtggtgcagcccgggaagtccctccgcctgagctgcgccgcctccggcttcaccttcaccaacaacgcgatgaactgggtccggcaggccccggggaagggcctggagtgggtggccttcgtgagctccgacggccgcaacaagaactacgccgacagcgtcaaggggcggttcacgatctcccgcgacaacagcaagaacaccgtgtacctccagatgaactccctgcgggtggaggacaccgccctgtactactgcgcgaaggacctcggcgccaacaaggacgacgagtgggccaccgactactacgacctgagcgtcgcctaccccatccccgacccccgcgcggtggtgggggccttcgacgtctggggccaggggacgatggtgaccgtgtccagc

SEQ ID NO: 9690 - RNA, 432 nt, synthetic construct
  misc_feature 1..432: note = derived and/or modified sequence opt1 from anti-HIV_cap256-059-065060_VR-Chain
  source 1..432: mol_type = other RNA
caggtgcagctggtcgagagcggcgggggcgtggtgcagcccgggacctccctccgcctgagctgcgccgcctccggcttcaccttcagcaactacgcgatggggtgggtccggcaggccccgggcaagggcctggagtgggtggccgtggtctcctacgacgggagcaagaagtcctacgccgacagcgtgaagggccgcttcacgatctcccgggacaacagccgcaacaccctctacctgcagctgaactccctccgggccgaggacaccgcgatgttctactgcgccaaggacctggggaagggcgagatcgaggagtgggccaccgactactacgactggagcaaggcctaccccatcgaggggccccgcgacgtggtcggcgcgttcgacacgtggggccaggggaccctggtgaccgtgtccagc

SEQ ID NO: 9691 - RNA, 432 nt, synthetic construct
  misc_feature 1..432: note = derived and/or modified sequence opt1 from anti-HIV_cap256-059-064001_VR-Chain
  source 1..432: mol_type = other RNA
caggtgcagctggtcgagagcggcgggggcgtggtgcagcccgggcgctccctccggctgagctgcgccgcctcccagttcaccttcagcaactacggcatgcactgggtccgccaggcgccggggaagggcctggagtgggtggccggcatctccttcgccgggaccaagaactactacgccaagagcgtgaagggccggttcacgatctcccgcgacaacagcaagaacgccctctacctgcagatgaactccctgcgggcggaggacaccgccctctactactgcgccaaggacatgcgcgagtacgagtgcgaggagtgggccagcgactactacgacttcgggcgggaccagccctgccaggacccccgcggcgtcgtggggaccttcgacatctggggccagggcaccatggtggcggtctccagc

SEQ ID NO: 9692 - RNA, 432 nt, synthetic construct
  misc_feature 1..432: note = derived and/or modified sequence opt1 from anti-HIV_cap256-059-063270_VR-Chain
  source 1..432: mol_type = other RNA
caggtgcagctggtcgagagcggcgggggcgtggtgcagcccgggcgctccctccggctgagctgcgccgcctcccagttcaccttcagcaactacggcatgcactgggtccgccaggcgccggggaagggcctggagtgggtggccgccatctccttcgccggcaccaagaagcactacgccgacagcgtgaaggggcggttcacgatctcccgcgacaacagcaagaacgcgctctacctgcagatgaactccctgcgggccgaggacaccgccctctactactgcgccaaggacctgcgcgagtacgagtgcgaggagtgggcgagcgactactacgacttcggccgggaccagccctgcctggacccccgcggggtcgtgggcatcttcgacatctgggggcagggcaccctcgtgaccgtctccagc

SEQ ID NO: 9693 - RNA, 432 nt, synthetic construct
  misc_feature 1..432: note = derived and/or modified sequence opt1 from anti-HIV_cap256-059-061357_VR-Chain
  source 1..432: mol_type = other RNA
caggtgcagctggtcgagagcggcgggggcgtggtgcagcccgggcgctccctccggctgagctgcgccgcctccggcttcaccttcagcaacttcgggttccactgggtccgccaggcgccgggcaagggcctggagtgggtggccgggatctccttcgccggcaccaagatctactacgccgacagcgtgaaggggcggttcacgatctcccgcgagaacagcaagaacatgctctacctgcagatgaactccctgcggggcgaggacaccgccgtctacttctgcgcgaaggacctccgcgagttcgagtgcgaggagtgggccagcgactactacgacttcgggcgggagttcccctgccaggacccccgcggcgtggtgggcaccttcgacgtctgggggcacggcgccgtggtgaccgtctccagc

SEQ ID NO: 9694 - RNA, 435 nt, synthetic construct
  misc_feature 1..435: note = derived and/or modified sequence opt1 from anti-HIV_cap256-059-059834_VR-Chain
  source 1..435: mol_type = other RNA
caggtgcagctggtcgagagcggcgggggcgtggtgcagcccgggcgctccctccggctgagctgcgccgcctccggcttcaccttcagcaacttcgggatgcactgggtccgccaggcgccgggcaagggcctggagtgggtggccttcgtggccttcgacgagtccgacaagtactacgccgccagcgtcaaggggcggttcaccgtgtcccgcgacaacagcaagaacacggtgtccctccagatgaacagcctgcggaccgaggacaccgcggtctactactgcgccaaggaggtgggcgacaacaaggacgacgagtggacctccccctactactacgacttcagcatcgcctaccccgtgcacgacccccgcgccgtcgtcgggggctacgacgtgtgggggcagggcacgatggtgaccgtgtccagc

SEQ ID NO: 9695 - RNA, 432 nt, synthetic construct
  misc_feature 1..432: note = derived and/or modified sequence opt1 from anti-HIV_cap256-059-059313_VR-Chain
  source 1..432: mol_type = other RNA
caggtgcacctggtcgagagcggcgggggcgtggtgcagcccgggaagtccctccgcctgagctgcgccgcctcccagttcaccttcagcaacttcggcatgcactgggtccggcaggcgccggggaagggcctggagtgggtggccggcatctccttcgccgggaccaagaagtactacgccgacagcgtgaagggccgcttcacgatctcccgggacaacagcaagaacaccctctacctgcagatgaactccgtccgcgccgaggacaccgcgctgtactactgcgccaaggacatgcgggagtacgagtgcgaggagtgggccagcgactactacgacttcgggaagccccagccctgccaggacccccgcggcgtggtggggaccttcgacatgtggggcctcggcacgctggtcaccgtgtccagc

SEQ ID NO: 9696 - RNA, 432 nt, synthetic construct
  misc_feature 1..432: note = derived and/or modified sequence opt1 from anti-HIV_cap256-059-057130_VR-Chain
  source 1..432: mol_type = other RNA
caggtgcagctggtcgagagcggcgggggcgtggtgcagcccgggcgctccctccggctgagctgcgccgcctcccagttcagcttctccagctacggcatgcactgggtccgccaggcgccggggaagggcctggagtgggtggccgccatctccttcgccggcatcaagaagcactacgccgacagcgtgaaggggcggttcaccatctcccgcgacaacagcaagaacaccctctacctgcagatgaactccctgcgggtcgaggacacggcgctctactactgcgccaaggacctgcgcgagtacgagtgcgaggagtgggccagcgactactacgacttcggccggccccagccctgccaggacccccgcggggtggtgggcacctccgacatctgggggcagggcaccatggtcaccgtgagctcc

SEQ ID NO: 9697 - RNA, 411 nt, synthetic construct
  misc_feature 1..411: note = derived and/or modified sequence opt1 from anti-HIV_cap256-059-050520_VR-Chain
  source 1..411: mol_type = other RNA
caggtgcagctggtcgagagcggcgggggcgtggtgcagcccgggcgctccctccggctgagctgcgccgcctcccagttcaccttcaaccgctacggcatgcactgggtccggcaggcgccggggaagggcctggagtgggtggccgtgatcagctacgccgactccgtcaagggccgcttcaccatcagccgggacaactccaagaacacgctctacctgcagatgaacagcctgcgcgccgaggacaccgccctctactactgcgcgaaggacctgcgggaggacgagtgcgaggagtggtggtccgactactacgacttcgggcgcgagctgccctgccgcaagagccggggcgtggccgggatcttcgacatctggggccaggggaccatggtgaccgtctccagc

SEQ ID NO: 9698 - RNA, 432 nt, synthetic construct
  misc_feature 1..432: note = derived and/or modified sequence opt1 from anti-HIV_cap256-059-049839_VR-Chain
  source 1..432: mol_type = other RNA
caggtgcagctggtcgagagcggcgggggcgtggtgcagcccgggcgctccctccggctgagctgcgccgcctccggcttcagcttctccaactacgcgatggactgggtccgccaggccccggggaagggcctggagtgggtggccgtggtcagctccgacggcaagaccaagaactacgccgacagcgtgaaggggcggttcaccatctcccgcgacaacagcaagaacacggtgtacctccagatgaactccctgcggcccgaggacaccgccgtctactactgcgcgaaggacctgggcgccaacaaggacgacgagtggaccaccgactactacgactggagcgtggcctaccccgtgcccgacccgcgcgccgtcgtgggggcgttcgacgtgtggggccaggggacgatggtcaccgtgtccagc

SEQ ID NO: 9699 - RNA, 432 nt, synthetic construct
  misc_feature 1..432: note = derived and/or modified sequence opt1 from anti-HIV_cap256-059-048503_VR-Chain
  source 1..432: mol_type = other RNA
caggtgcagctggtcgagagcggcgggggcgtggtgcagcccgggcgctccctccggctgagctgcgccgcctcccagctgagcttctccaactacggcatgcactgggtccgccaggcgccggggaagggcctcgagtgggtggccggcaccagcttcgccgggaccaagaagtactacgccgactccgtgaagggccggttcacgatcagccgcgacaactccaagaacgccctgtacctgcagatgaacagcctccgggcggaggacaccgccctgtactactgcgccaaggacctgcgcgagtacgagtgcgaggagtgggcctccgactactacgacttcgggcgggaccagccctgccaggacccccgcggcgtcgtggggaccttcgacatctggggccagggcaccatggtgacggtcagcgcg

SEQ ID NO: 9700 - RNA, 432 nt, synthetic construct
  misc_feature 1..432: note = derived and/or modified sequence opt1 from anti-HIV_cap256-059-045516_VR-Chain
  source 1..432: mol_type = other RNA
caggtgcagctggtcgagagcggcgggggcgtggtgcagcccgggcgctccctccggctgagctgcgccgcctcccagttcaccttcagcggctacgggatgcactgggtccgccaggcgccgggcaagggcctggagtgggtggccgccatctccttcgccgggaacaagcggtacttcgccgacagcgtgaagggccgcttcaccatctcccgggacaacagcaagaacaccctcttcctgcagatgaactccctgcgcgcggaggacacggccctctactactgcgcccgggacatgcgcgagtacgagtgcgaggagtgggccagcgactactacgacttcgggcggccccagccctgccaggacccccgcggcgtcgtgggggtgttcgacatctggggccagggcaccatggtcaccgtgtccagc

SEQ ID NO: 9701 - RNA, 432 nt, synthetic construct
  misc_feature 1..432: note = derived and/or modified sequence opt1 from anti-HIV_cap256-059-044188_VR-Chain
  source 1..432: mol_type = other RNA
caggtgcacctggtcgagagcggcgggggcgtggtgcagcccgggcgctccctccggctgagctgcgccgcctcccagttcaccttcagctcctacggcatgcactgggtccgccaggcgccggggaagggcctggagtgggtggccggcatcagcttcgccgggaccaacaagtactacgccgactccgtgaagggccggttcacggtcagccgcgacaactccaagaacaccctctacgtgcagatgaacagcctgcgggccgaggacaccgcgctgtactactgcgcccgcgacctccgggagtacgagtgcgaggagtgggcctccgactactacgacttcgggcgcgagcagccctgccaggacccccggggcgtggtcgggatcttcgacatctggggccccggcaccatggtgacggtgagctcc

SEQ ID NO: 9702 - RNA, 435 nt, synthetic construct
  misc_feature 1..435: note = derived and/or modified sequence opt1 from anti-HIV_cap256-059-044105_VR-Chain
  source 1..435: mol_type = other RNA
cagggccagctggtggagagcgggggcggggtcgtgcagcccggccgctccctcagcctgtcctgcgccgccagcgggttctccttcaacaactacgcgatggactgggtgcggcaggccccgggcaagggcctggagtgggtcgccgtggtgagctccgacgggaacaacaagaactacgccgacagcgtcaagggccgcttcaccatctcccgggacaacagcaagaacaccgtgtacctccagatgaactccctgcgcgccgaggacacggcgatctactactgcgccaaggacgtgggggccaacaaggacgacgagtgggccaccaactactactacgactggagcgtcgcgtaccccgtgcccgacccccgggccgtgatcggcgccttcgacgtctgggggcagggcaccatggtgaccgtgtccagc

SEQ ID NO: 9703 - RNA, 432 nt, synthetic construct
  misc_feature 1..432: note = derived and/or modified sequence opt1 from anti-HIV_cap256-059-042100_VR-Chain
  source 1..432: mol_type = other RNA
caggtgcagctggtcgagagcggcgggggcgtggtgcagcccgggcgctcccagcggctcagctgcgccgcctcccagttcaccttcagctcctacggcatgcactgggtccgccaggcgccggggaagggcctggagtgggtggccgccatcagcttcgccggcaccaacaagtactacggggactccgtgaagggccggttcacgatcagccgcgacaactccaagaacaccctgtacctccagatgaacagcctgcgggccgaggacaccgcgctgtaccactgcgcccgcgacatgcgggagtacgagtgcgaggagtgggcctccgactactacgacttcgggcgcgaccagccctgccaggacccccggggcgtcgtggggatcttcgacctctggggccagggcaccatggtgacggtcagctcc

SEQ ID NO: 9704 - RNA, 432 nt, synthetic construct
  misc_feature 1..432: note = derived and/or modified sequence opt1 from anti-HIV_cap256-059-040742_VR-Chain
  source 1..432: mol_type = other RNA
caggtgcagctggtcgagaccggcgggggcgtggggcagcccggcaagagcctccgcctgtcctgcgccgccagcgggttcaccttctccaacttcgcgatggactgggtgcggcaggccccgggcaagggcctggagtgggtcgccttcatcagctccgacgggatcaacaagaagtacggcgacttcgtgaaggggcgcttcacgatcagccgggacaactccaagaacaccctcttcctgcagatgaacagcctgcgcgccgaggacaccgccctctactactgcgcgaaggacgtgggcgactacaagtccgacgagtgggggaccgactactacgacctgagcatcgagtaccccatccaggacccccgggccgtcgtgggcgccttcgacaactggggccaggggacgatggtgatcgtctccagc

SEQ ID NO: 9705 - RNA, 432 nt, synthetic construct
  misc_feature 1..432: note = derived and/or modified sequence opt1 from anti-HIV_cap256-059-040554_VR-Chain
  source 1..432: mol_type = other RNA
caggtgcagctggtcgagagcggcgggggcgtggtgcagcccgggcgctccctccggctgagctgcgccgcctcccagttcaccttcagctcctacggcatgcactgggtccgccaggcgccggggaagggcctggagtgggtggccggcatcagcttcgccgccaccaacaagtactacgggggctccgtgaaggggcggttcacgatcagccgcgacaactccaagaacaccctctacctgcagatgaacagcctgcgggccgaggacaccgcgctctactactgcacccgcgacatgcgggagtacgagtgcgaggagtgggcctccgactactacgacttcggcaaggaccagccctgccaggacccccgcggggtcgtgggcacgctggacatctggggccaggggaccatggtgaccgtcagctcc

SEQ ID NO: 9706 - RNA, 432 nt, synthetic construct
  misc_feature 1..432: note = derived and/or modified sequence opt1 from anti-HIV_cap256-059-039660_VR-Chain
  source 1..432: mol_type = other RNA
caggtgcagctggtcgagagcggcgggggcgtggtgcagcccgggcgctccctccggctgagctgcgccgcctcccagttcagcttctccaactacggcatgcactgggtccgccaggcgccggggaagggcctggagtgggtggccagcatctccttcgccggcaccaagaagaagtacgccgacagcgtgaaggggcggttcaccatctcccgcgacaacagcaagaacaccctcttcctgcagatgaactccctgcggacggaggacgccgcgctctactactgcgccaaggacatgcgcgagttcgagtgcgaggagtgggccagcgactactacgacttcggccgggagcagccctgccaggacacccgcgacgtcgtggggatcttcgacatctggggccaggggaccatggtgacggtctccagc

SEQ ID NO: 9707 - RNA, 435 nt, synthetic construct
  misc_feature 1..435: note = derived and/or modified sequence opt1 from anti-HIV_cap256-059-039298_VR-Chain
  source 1..435: mol_type = other RNA
caggtgcagctggtcgagagcggcgggggcgtggtgcagcccgggcgctccctccggctgagctgcgccgcctccggcttcaccttcagcaagtacgggatgcactgggtccgccaggcgccgggcaagggcctggagtgggtggccttcgtggccttcgacgagtccgacaagtactacgccgccagcgcgaaggggcggttcatcatctcccgcgacaacagcaagaacaccctctccctgcagatgaacagcctgcggacggaggacaccgccgtctactactgcgccaaggaggtgggcgacaacaaggacgacgagtggacctccccctactactacgacatcagcatcgcctaccccgtgcaggacccccgcgcggtcgtcgggggctacgacgtgtgggggcagggcaccatggtgacggtgtccagc

SEQ ID NO: 9708 - RNA, 432 nt, synthetic construct
  misc_feature 1..432: note = derived and/or modified sequence opt1 from anti-HIV_cap256-059-037873_VR-Chain
  source 1..432: mol_type = other RNA
caggtgcagctggtcgagagcggcgggggcgtggtgcagcccgggcggtccctccggctgagctgcgccgcctcccagttcaccttcagcaactacggcatgcactgggtccgccaggcgccggggaagggcctggagtgggtggccgccatctccttcgccggcatcaacaagtactacgccgacagcgtgaaggggcggttcaccctctcccgcgacaacacgaagaacaccctgtacctgcagatgaacagcctccgggcggaggacaccgccctgtactactgcgcccgcgacctgcgggagtacgagtgcgaggagtgggcctccgactactacgacttcggccgcccccagccctgccaggacccccgcggggtcgtgggcaccagcgacatctgggggcagggcacgatggtgaccgtctccagc

SEQ ID NO: 9709 - RNA, 432 nt, synthetic construct
  misc_feature 1..432: note = derived and/or modified sequence opt1 from anti-HIV_cap256-059-037633_VR-Chain
  source 1..432: mol_type = other RNA
caggtgcagctggtcgagagcggcgggggcgtggtgcagcccgggcgctccctccggctgagctgcgccgcctcccagttcaccttcagcaacttcggcatgcactgggtccgccaggcgccggggaagggcctggagtgggtggccgccatctccttcgccggcatcaacaagaactacgccgacagcgtgaaggggcggttcaccatctcccgcgacaacagcaagaacacgctccacctccagctgaactccctgcgggcggaggacaccgccctgtactactgcgccaaggacctgcgcgagtacgagtgcgaggagtgggccagcgactactacgacttcggccgggaccagccctgccaggacccccgcggggtcgtgggcaccttcgacatctgggggcagggcaccatggtgacggtctccagc

SEQ ID NO: 9710 - RNA, 432 nt, synthetic construct
  misc_feature 1..432: note = derived and/or modified sequence opt1 from anti-HIV_cap256-059-036817_VR-Chain
  source 1..432: mol_type = other RNA
caggtgcagctgctcgagagcggcgggggcgtcgtgcagcccgggcgctccctgcggctgagctgcgaggcctcccagttcaccttcagcaacttcggcatgcactgggtgcgccaggccccggggaagggcctcgagtgggtcgcggccatctccttcgccggcatcaagaagaactacgccgacagcgtgaaggggcggttcaccatctcccgcgacaacagcaagaacacgctgtacctgcagatgaactccctccgggtggaggacaccgccctgtactactgcgcgaaggacctgcgcgagtacgagtgcgaggagtgggccagcgactactacgacttcggccgggagcagccctgccaggacccccgcggggtcatcggcaccttcgacatctgggggcagggcaccatggtgacggtgtccagc

SEQ ID NO: 9711 - RNA, 432 nt, synthetic construct
  misc_feature 1..432: note = derived and/or modified sequence opt1 from anti-HIV_cap256-059-032787_VR-Chain
  source 1..432: mol_type = other RNA
caggtgcagctggtcgagagcggcgggggcgtggtgcagcccgggcgctccctccggctgagctgcgccgcctccggcttcaccttcagcaagtacgcgatgcactgggtccgccaggccccggggaagggcctggagtgggtggccttcgtggccttcgacgagtccgacaagtactacgtcgacagcgtgaagggccggttcaccatctcccgcgacaacagcaagaacacgctctccctgcagatgaacagcctgcgggccgaggacaccgcggtgtactactgcgccaaggaggtccacgtgaacaaggacgacgagtgggcctccgactactacgacctcagcatcgcctaccccatccaggacccccgcgcggtggtcgggggcctggacatctgggggcagggcaccatggtgaccgtgtccagc

SEQ ID NO: 9712 - RNA, 432 nt, synthetic construct
  misc_feature 1..432: note = derived and/or modified sequence opt1 from anti-HIV_cap256-059-032427_VR-Chain
  source 1..432: mol_type = other RNA
caggtgcagctggtcgagagcggcgggggcgtggtgcagcccgggcgctccctccggctgagctgcgccgcctcccagttcaccttcagcaacttcggcatgcactgggtccgccaggcgccggggaagggcctggagtgggtggccggcatctccttccccgggaccaagaagtactacgccgacagcgtgaagggccggttcacgatctcccgcgacaacagcaagaacgccctctacctgcagatgaactccctgcgggccgaggacaccgcgctctactactgcgcccgcgacctgcgggagtacgagtgcgaggagtgggccagcgactactacgacttcgggaagccccagccctgcctggacccgcgcggcgtcgtggggaccttcgacatctggggccagggcaccatggtgacggtctccagc

SEQ ID NO: 9713 - RNA, 435 nt, synthetic construct
  misc_feature 1..435: note = derived and/or modified sequence opt1 from anti-HIV_cap256-059-029390_VR-Chain
  source 1..435: mol_type = other RNA
caggtgcagctggtcgagagcggcgggggcgtggtgcagcccgggcgctccctccggctgagctgcgccgcctccggcttcaccttcaaccagcacgggatgcactgggtccgccaggcgccggacaagggcctggagtgggtggccttcgtgggcttcgacgagagcgagaagtactacgccgactccgtcaaggggcggttcaccatcagccgcgacaactccaagaacacgctcagcctgcagatgaactccctgcggcccgaggacaccgccgtgtactactgcgccaaggaggtgggcgacaacaaggaggacgagtgggcgagcgactactactacgacctctccaacgcctaccccatccacgacccccgcgccgtcgtcgggggctacgacatctgggggcagggcaccatggtgaccgtgtgcagc

SEQ ID NO: 9714 - RNA, 435 nt, synthetic construct
  misc_feature 1..435: note = derived and/or modified sequence opt1 from anti-HIV_cap256-059-027877_VR-Chain
  source 1..435: mol_type = other RNA
caggtgcagctggtcgagagcggcgggggcgtggtgcagcccgggcgctccctgcggctgagctgctccgccagcgccttctccttcagctacttcgcgatggactgggtccgccaggccccgggcaaggggctggagtgggtggccttcgtgtccagcgacggcaacaacaagaactacgccgactccgtcaagggccggttcaccatcagccgcgacaactccaagaacaccgtgttcctccagatggacagcctgcggcccgaggacacggccgtgtactactgcgcgaaggacctcgggggcaacaaggacgacgagtggtccaccaactactactacgacatcagcatcgccgaccccgtccccgacccgcgcgccgtggccggggcgttcgacgtgtggggccaggggaccatggtcaccgtgtccagc

SEQ ID NO: 9715 - RNA, 435 nt, synthetic construct
  misc_feature 1..435: note = derived and/or modified sequence opt1 from anti-HIV_cap256-059-026640_VR-Chain
  source 1..435: mol_type = other RNA
caggtgcagctggtcgagagcggcgggggcgtggtgcagcccgggcgctccctccggctgagctgcgccgcctccggcttcagcttctccaagtacgggatgcactgggtccgccaggcgccgggcaagggcctggagtgggtggccttcgtggccttcgacgagagcgaccggtactacgccgcctccgtcaaggggcgcttcaccatcagccgggacaactccaagaacaccctcagcctgcagatgaactccctgcgcacggaggacaccgcgatctactactgcgccaaggaggtgggcgacaacaaggacgacgagtggaccagcccctactactacgacatgtccatcgcctaccccgtgcaggacccccgggccgtcgtcgggggctacgacatctgggggcagggcaccatggtgacggtgagctcc

SEQ ID NO: 9716 - RNA, 432 nt, synthetic construct
  misc_feature 1..432: note = derived and/or modified sequence opt1 from anti-HIV_cap256-059-026017_VR-Chain
  source 1..432: mol_type = other RNA
caggtgcagctggtcgagagcggcgggggcgtggtgcagcccgggcgctccctccggctgagctgcgccgcctccggcttcaccttcagcacctacgcgatgcactgggtccgccaggccccggggaagggcctggagtgggtggccctcatctcctacgacggcacgaacaagtactacgtggacagcgccaaggggcggttcaccatctcccgcgacaacagcaagaacaccctgtacctgcagatgaactccctcacccccgaggacacggccgtcttctactgcgcgaaggacctgggcgggtacaaggacgacgagtggggcaccgagtactacgacatcagcgtgtcctaccccgtgcaggacccccgggccgtcgccggggtgttcgacgtgtggggccacggcaccatggtcaccgtgagctcc

SEQ ID NO: 9717 - RNA, 432 nt, synthetic construct
  misc_feature 1..432: note = derived and/or modified sequence opt1 from anti-HIV_cap256-059-024100_VR-Chain
  source 1..432: mol_type = other RNA
tgccaggtgctggtcgagagcggcgggggcgtggtgcagcccgggcggtccctccggctgagctgcgccgcctcccagttcaccttcagctcctacggcatgcactgggtccgccaggcgccggggaagggcctggagtgggtggccgccatcagcttcgccggcaccaagaagtactacgccgactccgtgaaggggcggttcgcgatcagccgcgacacgtccaagaacgccctctacctgcagatgaacaccctgcgggccgaggacaccgccctctactactgcgcgcgcgacctgcgggagttcgagtgcgaggagtgggccagcgactactacgacttcggccgcccccagccctgccaggacccccgcggggtcgtgggctccttcgacatctgggggcagggcaccatggtgacggtcagcctg

SEQ ID NO: 9718 - RNA, 432 nt, synthetic construct
  misc_feature 1..432: note = derived and/or modified sequence opt1 from anti-HIV_cap256-059-023966_VR-Chain
  source 1..432: mol_type = other RNA
caggtgcagctggtcgagagcggcgggggcgtggtgcagcccgggcgctccctccggctgagctgcgccgcctcccagttcagcttctccagctacggcatgcactgggtccgccaggcgccggggaagggcctggagtgggtggccgccatctccttcgccggcatcaagaagcactacaccgacagcgtgaaggggcggttcaccatctcccgcgacaacagcaagaacacgctctacctgcagatgaactccctgcgggccgaggacaccgcgctctactactgcgccaaggacctgcgcggcttcgagtgcgaggagtgggccagcgactactacgacttcgggcgggaccagccctgccaggacccccgcggcgtcgtggggaccttcgacatctggggccagggcaccctggtgacggtctccagc

SEQ ID NO: 9719 - RNA, 432 nt, synthetic construct
  misc_feature 1..432: note = derived and/or modified sequence opt1 from anti-HIV_cap256-059-020534_VR-Chain
  source 1..432: mol_type = other RNA
caggtgcagctggtcgagagcggcgggggcgtggtgcagcccgggcgctccctccggctgagctgcgccgcctcccagttcaccttcagcaactacggcatgcactgggtccgccaggcgccggggaagggcctggagtgggtggccggcatgtccttcgccgggaccaacacgtactacgccgacagcgtgaagggccggttcaccatctcccgcgacaacagcaagaacaccctctacctgcagatgaactccctgcgggccgtcgacaccgcgctctactactgcgcccgcgacatgcgggagtacgagtgcgaggagtgggccagcgactactacgacttcgggcgcgagtacccctgccaggacccccggggcgtggtggggatcttcgacctgtggggccagggcacgatggtcaccgtgtccagc

SEQ ID NO: 9720 - RNA, 435 nt, synthetic construct
  misc_feature 1..435: note = derived and/or modified sequence opt1 from anti-HIV_cap256-059-019513_VR-Chain
  source 1..435: mol_type = other RNA
caggtgcagctggtcgagagcggcgggggcgtggtgcagcccgggcgctccctccggctgagctgcgccgcctccggcttcaccttcagcaacttcgcgatggggtgggtccgccaggccccgggcaagggcctggagtgggtggccgtgatctccagcgacgggaccaacaagaactacggcgactccgtcaaggggcggttcacgatcagccgcgacaactccaagaacaccctcttcctgcagatgaacagcctgcgggccgaggacacctccctctactactgcgccaaggacctgggcgggtacaagaccgacgagtgggcgacgaactactactacgacatcagcatcgcctcccccatccaggacccccgcgccgtggtgggcgccttcgacatctggggccaggggaccatggtcaccgtgaccagc

SEQ ID NO: 9721 - RNA, 432 nt, synthetic construct
  misc_feature 1..432: note = derived and/or modified sequence opt1 from anti-HIV_cap256-059-012963_VR-Chain
  source 1..432: mol_type = other RNA
caggtgcagctggtcgagagcggcgggggcgtggtgcagcccgggcgctccctccggctgagctgcgtcgcctccggcttcagcttctccagctacgggatggcctgggtgcgccaggcgccgggcaagggcctggagtgggtgaccgtcatctccttcgccggggtgaagacctactacgccgacagcgtgaagggccggttcacgatctcccgcgacaacagcaaggggaccctctacctgcagatggacggcctgcggcccgaggacaccgccctctactactgcgccaaggacctggcggagcgcgagtgcgaggagtgggcctccgactactacgacttcgggcgggagctgccctgccaggacccccgcggcgtcgtgggcaccttcgacgtgtgggggcagggcacgatggtcaccgtgagctcc

SEQ ID NO: 9722 - RNA, 435 nt, synthetic construct
  misc_feature 1..435: note = derived and/or modified sequence opt1 from anti-HIV_cap256-059-010396_VR-Chain
  source 1..435: mol_type = other RNA
caggtgcagctggtcgagagcggcgggggcgtggtgcagcccgggcgctccctccggctgagctgcgccgcctccggcttcagcttcaacaactacgcgatgaactgggtccgccaggccccggggaagggcctggagtgggtggccttcgtgtccagcgacggctccaacaagaactacgccgacagcgtcaccgggcggttcaccctctcccgcgacaacagcaagaacacggtgttcctgcagatgaactccctgcgggtggaggacaccgccgtctactactgcgcgaaggacgtgggcgccaacaaggacgacgagtggaccaccaactactactacgacatcagcatcgccgaccccgtgcccgacccccgcgccgtcatcggggcgttcgacgtgtggggccaggggacgatggtgaccgtctccagc

SEQ ID NO: 9723 - RNA, 432 nt, synthetic construct
  misc_feature 1..432: note = derived and/or modified sequence opt1 from anti-HIV_cap256-059-008136_VR-Chain
  source 1..432: mol_type = other RNA
caggtgcagctggtcgagagcggcgggggcgtggtgcagcccgggcgctccctccggctgagctgcgccgcctccggcttcaccttcaacacctacgcgatgcactgggtccgccaggccccggggaagggcctggagtgggtggccctcatcagctacgacggcacggagaagtactacgccgactccgtgaaggggcggttcaccatcagccgcgacaactcccggaacaccctgtacctgcagatgaacagcctccgcctggaggacgccgcgctgtaccagtgcgccaaggacctcggcgggtccaagagcgacgagtggggcaccgactactacgacatgtccatcagctaccccatccaggacccccgggccgtcgccggggtgttcgacatctggggccagggcacgctggtgaccgtctccagc

SEQ ID NO: 9724 - RNA, 432 nt, synthetic construct
  misc_feature 1..432: note = derived and/or modified sequence opt1 from anti-HIV_cap256-059-006147_VR-Chain
  source 1..432: mol_type = other RNA
caggtgcaggtcgtggagagcggcgggggcgtggtccagcccgggcgctccctgcggctcagctgcaccgcctccggcttcaccttcagcaacttcgccatggggtgggtgcgccaggcgccgggcaagggcctggagtgggtggccttcatctccagcgacgggtccaacaagaactacggcgacagcgtcaaggggcggttcacgatctcccgcgacaacagcaagaacaccgtgttcctgcagatgaactccctccgggtggaggacaccgccctgtactactgcgccaaggacgtcggcgactacaagagcgacgagtgggggaccgagtactacgacatctccatcagctaccccatccaggacccccgcgccatggtgggcgcgttcgacctgtggggccaggggacgatggtgaccgtctccccc

SEQ ID NO: 9725 - RNA, 432 nt, synthetic construct
  misc_feature 1..432: note = derived and/or modified sequence opt1 from anti-HIV_cap256-059-005081_VR-Chain
  source 1..432: mol_type = other RNA
caggtgcagctggtcgagagcggcgggggcgtggtgcagcccgggcgctccctccggctgagctgcgccgcctcccagttcaccttcagctcctacggcatgcactgggtccgccaggcgccggggaagggcctggagtgggtggccggcatcagcttcgccgccaccaagaagtactactccgagagcgtgaaggggcggttcacgatctcccgcgacaacagcaagaacgccctccacctccacatgaactccctgcgggcggaggacaccgccctgtactactgcgccaaggacctgcgcgagttcgagtgcgaggagtgggccagcgactactacgacttcggccgggaccagccctgccaggacccccgcggggtcgtgggcatcttcgacatgtgggggcagggcaccatggtgaccgtctccagc

SEQ ID NO: 9726 - RNA, 432 nt, synthetic construct
  misc_feature 1..432: note = derived and/or modified sequence opt1 from anti-HIV_cap256-059-005006_VR-Chain
  source 1..432: mol_type = other RNA
caggcccagctggtggagagcggcgggggcgtcgtgcagcccgccaagtccctccgcctgagctgcgcggcctccgggttcaccttcaacaagtacgccatgcactgggtgcggcaggccccgggcaaggggctggagtgggtcgccttcgtggcgttcgacgagagcgacaagtactacgccgactccgtgaagggccgcttcaccatcagccgggacaactccaagaacacgctcagcctgcagatgaacaacctgcgcgccgaggacaccgccgtctactactgcgcgaaggaggtgggcgacaacaaggacgacgagtgggcctccgactactacgacctcagcatcgcctaccccatccaggacccccgggccgtggggcgcggctacgacatctgggggcagggcaccatggtcaccgtgtccagc

SEQ ID NO: 9727 - RNA, 432 nt, synthetic construct
  misc_feature 1..432: note = derived and/or modified sequence opt1 from anti-HIV_cap256-059-004451_VR-Chain
  source 1..432: mol_type = other RNA
caggtgcacctggtcgagagcggcgggggcgtggtgcagcccgggaagtccctccgcctgagctgcaccgcctccggcttcaccttcacgaacttcgccatggactgggtccggcaggcgccggggaagggcctggagtgggtggccttcatcagctccgacggcagcaacaagtactactccgagagcgtgaaggggcgcttcaccatctcccgggacaacagcaagaacaccctctacgtccagatgaactccctgcgcaccgaggacacggccgtgtactactgcgccaaggacctgggcgggtacaaggacgacgagtggagcaccgactactacgactggtccaccgcctaccccgtgcaggacccccgggcggtcgccggcgccttcgacctctgggggcagggcaccatggtgagcgtgtccagc

SEQ ID NO: 9728 - RNA, 432 nt, synthetic construct
  misc_feature 1..432: note = derived and/or modified sequence opt1 from anti-HIV_cap256-059-003571_VR-Chain
  source 1..432: mol_type = other RNA
caggagcagctggtggagagcggcgggggcgtcgtgcagcccgggcgctccctccggctgagctgcgccgcctcccagttcaccttcggcgcgtacgggatgcactgggtgcgccaggccccgggcaagggcctggagtgggtcgccggggtgagcttcgtgggcaacaacaagtactacgccgactccgtcaaggggcggttcaccatcagccgcgacaactccaagaacacgctctacctgcagatgaacagcctgcggggcgaggacaccgccctctactactgcgcgcgcgacatgcgggagatggagtgcgaggagtgggcctccgactactacgacttcgggcgcccccagccctgccaggacccccggggcgtggtgggcatcttcgacatgtgggggcagggcaccatggtcaccgtgagctcc

SEQ ID NO: 9729 - RNA, 432 nt, synthetic construct
  misc_feature 1..432: note = derived and/or modified sequence opt1 from anti-HIV_cap256-059-003449_VR-Chain
  source 1..432: mol_type = other RNA
caggtgcagctggtcgagagcggcgggggcgtggtgcagcccgggaagtccctccgcctgagctgcgccgcctcccaggtcaccttcagctcctacggcatgcactgggtgcggcaggcgccggggaagggcctggagtgggtggccggcatcagcttcgccgggaccaagaagtactacgccgactccgtcaagggccgcttcacgatcagccgggacaactccaagaacgccctctacctgcagatgaaccgcctgcgggcgggggacaccgccctctactactgcgccaaggacctgcgcgagtacgagtgcgaggagtgggccagcgactactacgacttcggccgggagcagccctgccaggacccccgcggggtggtgggcatcttcgacatctggggcctggggaccatggtcaccgtgtccagc

SEQ ID NO: 9730 - RNA, 432 nt, synthetic construct
  misc_feature 1..432: note = derived and/or modified sequence opt1 from anti-HIV_cap256-059-002712_VR-Chain
  source 1..432: mol_type = other RNA
caggtgcagctggccgagagcggcgggggcgtcgtgcagcccgggcggtccctccggctgagctgcgccgcgtcccagttcaccttcagctcctacggcatgcactgggtgcgccaggccccggggaagggcctggagtgggtcgccgccatcagcttcgccggcaccaagaagcactacgcggactccgtgaaggggcggttcacgatcagccgcgacaactccaagaacaccctcaacctgcagatgaacagcctgcgggccgaggacaccgccctctactactgcgcccgcgacatgcgggagtacgagtgcgaggtgtgggcgtccgactactacgacttcggccgcgagcagccctgccaggacccccgcggggtcgtgggcaccttcgacatctgggggcagggcacgatggtgaccgtcagcccc

SEQ ID NO: 9731 - RNA, 432 nt, synthetic construct
  misc_feature 1..432: note = derived and/or modified sequence opt1 from anti-HIV_cap256-059-001573_VR-Chain
  source 1..432: mol_type = other RNA
caggtgcagctggtcgagagcggcgggggcgtggtgcagcccgggcgctccctccggctgagctgcgccgcctcccagttcaccttcagctcctacggcatgcactgggtccgccaggcgccggggaagggcctggagtgggtggccggcatcagctacgacgggacctccaagtactacgccgacagcgtgaagggccggttcacgatctcccgcgacaacagcaagaacaccctctacctgcagatgaactccctgcgggccgaggacaccgccctctactactgcgcgaaggacctgcgcgaggacgagtgcgaggagtggtggagcgactactacgacttcgggcgggagctgccctgccgcaagtcccggggcgtcgccgggaccttcgacatctggggccacggcacgatggtgaccgtgagctcc

SEQ ID NO: 9732 - RNA, 432 nt, synthetic construct
  misc_feature 1..432: note = derived and/or modified sequence opt1 from anti-HIV_cap256-059-001379_VR-Chain
  source 1..432: mol_type = other RNA
caggtgcgcctggtcgagagcggcgggggcgtggtgcagcccgggcggtccctccgcctgagctgcgccgcctccggcttcaccttcaacagctacccgatgcactgggtccggcaggcgcccgggaagggcctggactgggtggccctcatctcctacgacggcaccaacaagttctacgtggacagcgtcaaggggcgcttcacgatctcccgggacaacagcaagaacaccctgtacctgcagatgaactccctcaccgccgaggacaccgccatgtactactgcgccaaggacctgggcgggaacaaggacgacgagtggggcacggactactacgacatcagcgtggcgtaccccatccacgacccccgcgccgtggccgggatcttcgacgtctggggccacggcaccatggtgaccgtgtccagc

SEQ ID NO: 9733 - RNA, 432 nt, synthetic construct
  misc_feature 1..432: note = derived and/or modified sequence opt1 from anti-HIV_cap256-059-001029_VR-Chain
  source 1..432: mol_type = other RNA
caggagcagctggtgcagagcggcgggggcgtcgtgcagcccgggcgctccctccggctgagctgcgccccgtcccagttcaccttcagcgcccacggcatgcactgggtgcgccaggcgcccgggaagggcctggagtgggtcgccggcatctccttcgccgggaccaagaactactacgccgacagcgtgaagggccggttcacgatctcccgcgacaacagcaagaacaccctctacctgcagatgaactccctgcgggtggaggacaccgccctctactactgcgcgaaggacatgcgcgagatggagtgcgaggagtgggccagcgactactacgacttcgggcggcaccagccctgccaggacccccgcggcgtcgtggggatcttcgacatctggggccagggcaccatggtgacggtctccagc

SEQ ID NO: 9734 - RNA, 432 nt, synthetic construct
  misc_feature 1..432: note = derived and/or modified sequence opt1 from anti-HIV_cap256-048-165087_VR-Chain
  source 1..432: mol_type = other RNA
gaggtgaagctgctcgagagcggcgggggcctggtccagcccgggggctaccgccggctgtcctgcgccgccagcgggttcaccttctcccgctacgcgatgcactgggcccggcaggccccgggcaagggcctcgagtgggtggccgtggtcagcgacgacggggtgaagaagtactaccccgactccgtgcgcggccggttcaccatcagccgcgacaactcccggaacacggtcagcctgcagatgaactccctgcgccccgaggacaccgccgtgtactactgcgcgaaggacgtgggggccaacaaggacgacgagtgggccaccgactactacgacctcagcatcgcctaccccgtcccggacccccgggcggtggtgggcgccttcgacatctgggggcagggcaccatggtcacggtgtccagc

SEQ ID NO: 9735 - RNA, 432 nt, synthetic construct
  misc_feature 1..432: note = derived and/or modified sequence opt1 from anti-HIV_cap256-048-158861_VR-Chain
  source 1..432: mol_type = other RNA
gaggtgcagctggtcgagagcggcgggggcctcgtgcagcccgggggctccctgcgcctgagctgcgtggacttcgggttccggttctccgagtactggatgagctgggtccgccaggccccgggcaagggcctcgagtgggtggccgtgatctcctacgacgggaccaacaagtactacgcggacagcgtcaagggccggttcaccatctcccgcgacaacagcaagaacacgctgtacctgcagatgaactccctccgggccgaggacaccgccctgtactactgcgccaaggacatgcgcgagagcgagtgcgaggagtgggcctccgactactacgacttcgggaaggactacccctgccaggacccccggggcgtggtggggaccttcgacatctggggccagggcaccatggtcacggtgagctcc

SEQ ID NO: 9736 - RNA, 435 nt, synthetic construct
  misc_feature 1..435: note = derived and/or modified sequence opt1 from anti-HIV_cap256-048-158280_VR-Chain
  source 1..435: mol_type = other RNA
caggtgcacctggtcgagagcggcgggggcgtggtgcagcccgggcgctccctccggatctactgcgccgtcagcgagttcaccttccgcaactacgccatgcactgggtgcggctggcgccgggcaaggggctgcagtgggtggccgtcatctcccacgacggcatcaacgactactacgccgacagcgtgaagggccgcttcaccatctcccgggacaacagcaagaacacggtgtccctccagatgaacagcctgcgccccgaggacaccgccgtctactactgcgccaaggacctgggggcgaacaaggacgacgagtgggccaccgactactacgacctctccatcgcctaccccgtgcccgacccgaccggcccctggttcggggccttcgacatctggggccaggggacgatggtgaccgtcagctcc

SEQ ID NO: 9737 - RNA, 432 nt, synthetic construct
  misc_feature 1..432: note = derived and/or modified sequence opt1 from anti-HIV_cap256-048-157928_VR-Chain
  source 1..432: mol_type = other RNA
caggtgcagctgatggagagcggcgggggcgtcgtgcagcccgggcgctccctccggctgagctgcgccatctccggcttcaccttcagcaactactggatgtcctgggtgcgccaggccccggggaagggcctggagtgggtcgcggtgatcagctccgacggcagctccaagaactacgccgacagcgtgaaggggcggttcaccatctcccgcgacaacagcaagaacacggtctccctccagatgaacagcctgcggcccgaggacaccgccgtgtactactgcgccaaggacgtgggcgccaacaaggacgacgagtgggcgaccgactactacgacctgtccatcgcctaccccgtccccgacccgcgcgccgtggtgggggccttcgacatctggggccaggggaccatggtcacggtgagctcc

SEQ ID NO: 9738 - RNA, 432 nt, synthetic construct
  misc_feature 1..432: note = derived and/or modified sequence opt1 from anti-HIV_cap256-048-157056_VR-Chain
  source 1..432: mol_type = other RNA
caggtgcagctggtcgagagcggcgggggcgtggtgcagcccgggcgctccctccggctgagctgcgccgcctccggcttcaccctgagctcctacgcgatgcactgggtccgccaggccccggggaagggcctcgagtgggtggccttcatcagcaacgacggctccaacaagtacttcgccgacagcgtgaaggggcggttcaccatctcccgcgacaacagcaagaacacgctgtacctgcagatgaactccctccgggccgaggacaccgcggtctactactgcgccaaggacctgggcgggaacaaggacgacgagtgggccaccgactactacgacctgagcatcgcctaccccgtgcaggacccccgcgtggtcgtgggcatcttcgacatctgggggcagggcaccatggtgacggtctccagc

SEQ ID NO: 9739 - RNA, 432 nt, synthetic construct
  misc_feature 1..432: note = derived and/or modified sequence opt1 from anti-HIV_cap256-048-156422_VR-Chain
  source 1..432: mol_type = other RNA
caggtgcagctggtcgagagcggcgggaccgtggtgcagcccggccgctccctccggctgagctgcgtcgggtccggcttcagcctgtcctactacgccatccactgggtgcgccaggccccggggaagggcctcgagtgggtggcggtcatcagctacgacggctccaactactactacgccgacagcgtgaaggggcggttcaccatctcccgcgacaacagcaagaacacggtgtacctgcagatgaactccctgcggggcgtcgacaccgccgtgtactactgcgccaaggacctcgggggcggggaggtggaggagtgggccaccgactactacgactggagcatcgcgtaccccgtcgagcacccccgcgccgtggtgggcgtcttcgacatctggggccaggggaccaaggtgacggtgtccagc

SEQ ID NO: 9740 - RNA, 432 nt, synthetic construct
  misc_feature 1..432: note = derived and/or modified sequence opt1 from anti-HIV_cap256-048-152863_VR-Chain
  source 1..432: mol_type = other RNA
gaggtgcagctgctcgagagcggcgggggcctggtccagcccgggggctccctgcgcctcagctgcgccgggtccggcttcaccttcagcaagcacggcatgcactgggtgcggcaggccccggggaagggcctggagtgggtggcgttcgtcgccttcgacgagtccgacaagtactacgccgacagcgtgaaggggcgcttcaccatctcccgggacaacagcaagaacacgctgtccctccagatgaacagcctgcgcgccgaggacaccgccatgtactactgcgcgaaggaggtgggcgacaacaaggacgacgagtgggcctccgactactacgacctgagcatcgcctaccccgtccacgacccccgggccgtggtcgggggctacgacatctggggccaggggaccatggtgaccgtgtccagc

SEQ ID NO: 9741 - RNA, 432 nt, synthetic construct
  misc_feature 1..432: note = derived and/or modified sequence opt1 from anti-HIV_cap256-048-152770_VR-Chain
  source 1..432: mol_type = other RNA
caggtgcagctggtcgagagcggcgggggcgtggtgcagcccgggcggtccctccggctgagctgcgccgcctccggcttcaccttccgcagcaacgcgatgcactgggtccggcaggccccggggaagggcctggagtgggtggccgtgatctcctacgacggcagcaagacctactacgccgactccgtcaaggggcgcttcacgatcagccgggacaactccaagaacaccctctacctgcagatgaacagcctgcgcgccgaggacaccgcggtgtactactgcgccaaggacctcggcgagtacaagtccgacgagtgggccaccgactactacgacctgagcatcgcctaccccgtgcaggacccccgcggggtcgcgggcgccttcgacatctgggggcagggcacgatggtgaccgtgtccagc

SEQ ID NO: 9742 - RNA, 432 nt, synthetic construct
  misc_feature 1..432: note = derived and/or modified sequence opt1 from anti-HIV_cap256-048-150027_VR-Chain
  source 1..432: mol_type = other RNA
gaggtgcagctggtcgagagcggcgggggcctcgtgcagcccgggggctccctgcgcctgagctgcgccgtgtccgggttcaccttcagctcctacatcatgcactgggtccggcaggccccgggcaagggcctcgagtgggtggcggtgatcagctacgacgggtccaacaaggactacgccgacagcgtcaagggccgcttcaccatctcccgggacaacagcaagaacacgctgtacctgcagatgaactccctccgcgccgaggacaccgccctgtactactgcgccaaggacctgcgggagtacgagtgcgaggagtgggcgagcgactactacgacttcgggcgcgactacccctgccaggacccccggggcgtggtggggaccttcgacatctggggccagggcaccatggtcacggtgtccagc

SEQ ID NO: 9743 - RNA, 432 nt, synthetic construct
  misc_feature 1..432: note = derived and/or modified sequence opt1 from anti-HIV_cap256-048-148246_VR-Chain
  source 1..432: mol_type = other RNA
caggtgcagctggtcgagagcggcgggggcgtggtgcagcccgggcgctccctccggctgagctgcgccacctccggcttcaccttcagcacgtactccatgcactgggtccgccaggccccggggaagggcctggagtgggtggcggtgatcagctacgacggctccaacgagtactacgtcgacagcgtgaaggggcggttcaccatctcccgcgacaacagcaagaacaccctctacctgcagatgaactccctgcgggtggaggacaccgccctctactactgcgccaaggacctgggcgggaacaaggacgacgagtggggcacggactactacgacttcagcgtcgcctaccccgtgcaggacccccgcgccgtgtccgggatcttcgacgtctggggccacggcaccatggtgaccgtgagctcc

SEQ ID NO: 9744 - RNA, 432 nt, synthetic construct
  misc_feature 1..432: note = derived and/or modified sequence opt1 from anti-HIV_cap256-048-147428_VR-Chain
  source 1..432: mol_type = other RNA
caggtgcagctggtcgagagcggcgggggcgtggtgcagcccgggcgctccctccggctgagctgctccgccagcggcttcaccttctccaactacgggatgcactgggtccgccaggccccgggcaagggcctggagtgggtggcggtgatcagcttcgacgggtccaacaaggtctacgccgacagcgtgaagggccggttcaccatctcccgcgacaacagcaagaacacgctctacctggagatgaactccctgcgggccgaggacaccgccgagtactactgcgccaaggacctcggggagagcgacaaggaggagtggccctccgactactacgacttcggccgcgacttcaccggccaggtgccccgggcggtcgtggggatcttcgacatgtggggccaggggaccatggtgacggtcagctcc

SEQ ID NO: 9745 - RNA, 432 nt, synthetic construct
  misc_feature 1..432: note = derived and/or modified sequence opt1 from anti-HIV_cap256-048-146603_VR-Chain
  source 1..432: mol_type = other RNA
gaggtgcagctggtcgagagcggcgggggcctcgtgcagcccgggcgctccctgcggctgagctgcgccgcctccggcttcaccttcgacgactacgcgatccactgggtgcgccaggccccggggaagggcctcgagtgggtcgccctgatcagctacgacggcaccgacaagtactacgccgactccgtgaaggggcggttcacgatcagccgcgacaactccaagaacaccctgtacctccagatgaacagcctgcgggtggaggacaccgccgtctaccactgcgcgaaggacctgggcgggaccaagtccgacgagtgggccacggactactacgacctcagcatcgcctaccccatccaggaccccggcgccgtggtgggggtcttcgacatctggggccagggcaccatggtgaccgtgtccagc

SEQ ID NO: 9746 - RNA, 432 nt, synthetic construct
  misc_feature 1..432: note = derived and/or modified sequence opt1 from anti-HIV_cap256-048-145735_VR-Chain
  source 1..432: mol_type = other RNA
caggtgcagctggtccagagcggcgggggcgtggtgcagcccgggcgctccctccggctgagctgcggcgcctccgggttcaccttcagcaactacgccatgcactgggtccgccaggcgccgggcaagggcctggactgggtggccgtgatctcctacgacgggaccaacgagaaccacgccgacagcgtcaagggccggttcacgatctcccgcgacaacagcaagaacaccgtgtacctccagatgaactccctgcgggccgaggacaccgccgtgtactactgcgcgaaggacgtcgggggcagcaaggacgacgagtgggccaccgactactacgacctgtccatcgcctaccccgtgcccgacccccgcgccgtggtcggggcgttcgacatctggggccagggcacgatggtgaccgtgagctcc

SEQ ID NO: 9747 - RNA, 432 nt, synthetic construct
  misc_feature 1..432: note = derived and/or modified sequence opt1 from anti-HIV_cap256-048-145116_VR-Chain
  source 1..432: mol_type = other RNA
caggtgcacctggtcgagagcggcgggggcgtggtgcagcccgggggctccctccggctgagctgcgccgcctccgggttcaccttcagcaactacggcatgcactgggtccggcaggcgccgggcaaggggctggagtgggtggccgccatctccttcgccggcaccaacaagtactacgccgacagcgtgaaggggcgcttcacgatctcccgggacaacagcaagaacgcgctctacctgcagatgaactccctgcgcgccgaggacaccgccctctactactgcgccaaggacctgcgggagagcgagtgcgaggagtgggcgtccgactactacgacttcggccgcgactacccctgccaggacccccgcggggtcgtgggcaccctggacatctggggccaggggaccatggtgacggtcagctcc

SEQ ID NO: 9748 - RNA, 432 nt, synthetic construct
  misc_feature 1..432: note = derived and/or modified sequence opt1 from anti-HIV_cap256-048-144077_VR-Chain
  source 1..432: mol_type = other RNA
caggtgaagctggtcgagagcggcgggggcgtggtgcagcccgggcgctccctccggctgagctgcgccgcctccggcttcaccctgagctcctacgcgatgcactgggtccgccaggccccggggaagggcctcgagtgggtggccgtgatcagctacgacggctccaaccggtacaccgccgacagcgtcaaggggcgcttcacgatctcccgggacaacagcaagaacaccctgaacctgcagatgaactccctccgccccgaggacaccgccgtgtactactgcgcgaaggacgtgggcgccaacaaggacgacgagtgggccaccgactactacgacctgagcatcgcctaccccgtccccgacccgcgggcggtggtgggggccttcgacatctggggccaggggacgaccgtcaccgtgtccagc

SEQ ID NO: 9749 - RNA, 432 nt, synthetic construct
  misc_feature 1..432: note = derived and/or modified sequence opt1 from anti-HIV_cap256-048-142876_VR-Chain
  source 1..432: mol_type = other RNA
caggtgcagctggtcgagagcggcgggggcgtggtgcagcccgggggctccctccgcctgagctgcgtcgcctccgggttcaccttcagcacctacggcatgcactgggtgcggcaggccccgggcaaggggctggagtgggtggcgttcatgcgcttcgacggctccaaccggtactacggggacagcgtcaagggccgcttcacgatctcccgggacaacagcaagaacaccctctacctgcagatgatctccctgcgcgccgaggacaccgccgtgtaccactgcgccaaggacctcgggggcaacaagcccgacgagtgggccaccgactactacgacctgagcatcgcgtaccccgtgcaggacccccgggccgtcgtgggcgtgttcgacatctgggggcagggcacgatcatcaccgtctccagc

SEQ ID NO: 9750 - RNA, 432 nt, synthetic construct
  misc_feature 1..432: note = derived and/or modified sequence opt1 from anti-HIV_cap256-048-140582_VR-Chain
  source 1..432: mol_type = other RNA
caggtgcagctggtcgagagcggcgggggcgtggtgcagcccgggcgctccctccggctgagctgcgccgcctccggcttcagcttctccaactacgcgatggactgggtccgccaggccccggggaagggcctggagtgggtggccttcgtgagctccgacggcagcaacaagaactacgccgactccgtcaaggggcggttcaccatcagccgcgacaactccaagaacaccgtgtacctccagatgaacagcctgcgggtggaggacacggccgtctactactgcgcgaaggacctgggcgccaacaaggacgacgagtgggccaccgactactacgacctctccgtggcctaccccgtgcccgacccccgcgcggtcgtgggggccttcgacgtgtggggccaggggaccatggtcaccgtgagctcc

SEQ ID NO: 9751 - RNA, 432 nt, synthetic construct
  misc_feature 1..432: note = derived and/or modified sequence opt1 from anti-HIV_cap256-048-139355_VR-Chain
  source 1..432: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccatcatcagctacgacggctccaacaagtactacgccgacagcgtgaaggggcggttcaccatctcccgcgacaacagcaagggcacgctctacctgcagatggacgggccccggcccgaggacaccgccctgtactactgcgcgaaggacctcggcgagcgcgagtgcgaggagtgggcctccgactactacgacttcgggcgggacttcccctgccaggacccgcgcggcgtcgtgggcaccttcgacatctgggggcagggcaccatggtgacggtcagctcc

SEQ ID NO: 9752 - RNA, 432 nt, synthetic construct
  misc_feature 1..432: note = derived and/or modified sequence opt1 from anti-HIV_cap256-048-139151_VR-Chain
  source 1..432: mol_type = other RNA
caggtgcagctggtcgagagcggcgggggcgtggtgcagcccgggaagtccctccgcctgagctgcgccgcctccggcttcaccttcaacacctacgggatgcactgggtccggcaggcgccgggcaagggcctggagtgggtggccgtgatcagctacgacgggtccatccagaagtacgccgacagcgtcaagggccgcttcacgatctcccgggacaacagcaagaacaccctctacctgcagatgaactccctgagcgtggaggacaccgccgtgtactactgcgccaaggacctcgggaagaacaaggacgacgagtgggcgaccgactactacgacatctccatcgcctaccccgtccccgacccccgcgccgtggtgggcgtcttcgacatctgggggcagggcacggtggtgaccgtcagctcc

SEQ ID NO: 9753 - RNA, 432 nt, synthetic construct
  misc_feature 1..432: note = derived and/or modified sequence opt1 from anti-HIV_cap256-048-137672_VR-Chain
  source 1..432: mol_type = other RNA
gaggtgcagctggtcgagagcggcgggggcgtggcccgccccgggggctccctccggctgagctgcgccgcgtccgggttcatcttcacccactacgccatggactgggtgcgccaggccccgggcaagggcctggagtgggtcgccgtgatcagctccgacgggagctccaagaactacgccgacagcgtgaagggccggttcaccatctcccgcgacaacagcaagaacacggtctccctccagatgaacagcctgcggcccgaggacaccgcggtgtactactgcgccaaggacgtgggggccaacaaggacgacgagtgggccaccgactactacgacctgtccatcgcgtaccccgtccccgacccgcgcgccgtggtgggcgccttcgacatctgggggcagggcaccatggtcacggtgagctcc

SEQ ID NO: 9754 - RNA, 432 nt, synthetic construct
  misc_feature 1..432: note = derived and/or modified sequence opt1 from anti-HIV_cap256-048-137506_VR-Chain
  source 1..432: mol_type = other RNA
caggtgcgcctggtcgacagcggcgggggcgtggtgcagcccgggggctccctccggctgagctgcgccgcctccgggttcaccttcagcacctacggcatgcactgggtccgccaggcgccgggcaaggggctggagtgggtggccttcatccggtccgacggcagcaacaagtactacgccgactccgtgcaggggcgcttcagcatctcccgggacaacagcaagaacacgctctacctgcagatgaactccctgcgcgccgaggacaccgccgtctactactgcgcgaaggacctcggcgagagcgacaaggaggagtggccctccgactactacgacttcgggcgggacttcaccggccaggacccccgcgccgtggtgggcgtcttcgacatctgggggcagggcaccacggtgatcgtgagctcc

SEQ ID NO: 9755 - RNA, 432 nt, synthetic construct
  misc_feature 1..432: note = derived and/or modified sequence opt1 from anti-HIV_cap256-048-137270_VR-Chain
  source 1..432: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccgtgatgagccccgacggctccaaccggtactacaccgacagcgtcaaggggcgcttcacgatctcccgggacaacagcaagaacaccctctccctgcagatgaacagcctgcgccccgaggacaccgccgtgtactactgcgccaaggacgtgggcgcgaacaaggacgacgagtgggccaccgactactacgacctctccatcgcctaccccgtcccggacccccgggccgtggtgggggcgttcgacatctggggccaggggacgatggtcaccgtgagctcc

SEQ ID NO: 9756 - RNA, 432 nt, synthetic construct
  misc_feature 1..432: note = derived and/or modified sequence opt1 from anti-HIV_cap256-048-135447_VR-Chain
  source 1..432: mol_type = other RNA
gaggtgcagctggtcgagagcggcggggccgtggtgcagcccggccgctccctccggctgagctgcaccgcctccgggttcagcttcacctcctacacgatccactgggtccgccaggcgccgggcaaggggctggagtgggtggccttcatcagctacgacggcaccgagaagaagtacaccgactccgtgaagggccggttcaccatcagccgcgacaactccaagaacacgctcagcctgcagatgaactccctgcggcccgaggacaccgccgtctactactgcgccaaggacctcggggccagcaaggacgacgagtgggcgaccgactactacgacttctccatcgcctaccccgtgcaggacccccgcgccgtggtcggcgccttcgacatctgggggcagggcaccatggtgacggtgagctcc

SEQ ID NO: 9757 - RNA, 432 nt, synthetic construct
  misc_feature 1..432: note = derived and/or modified sequence opt1 from anti-HIV_cap256-048-131966_VR-Chain
  source 1..432: mol_type = other RNA
caggagcagctggtggagagcggcgggggcgtcgtgcagcccgggcgctccctccggctgagctgcgccgcctccggcttcaccttcagcaactacgcgatgcactgggtgcgccaggccccggggaagggcctggagtgggtcgccgccatgtcccacgacggcagcgacaagtactacgccgactccgtgaaggggcggttcaccatcagccgcgacaactccaagaacacgctctacatgcagatgaacagcctgcgggcggaggacaccgccgtgtactactgcgccaaggaccagggcgagtccgagaaggaggagtgggccagcgactactacgacttcgggcgcgactaccccggccaggacccccggcgcgtcgtggcgaccttcgccatctgggggcagggcaccatggtgacggtctccagc

SEQ ID NO: 9758 - RNA, 432 nt, synthetic construct
  misc_feature 1..432: note = derived and/or modified sequence opt1 from anti-HIV_cap256-048-131008_VR-Chain
  source 1..432: mol_type = other RNA
gaggtgcgcctggtcgagagcggcgggggcctcgtgaagcccgggggctccctgcggctgagctgcgccgcctccgggttcaccgtgagctccaactacatgagctgggtccgccaggcgccgggcaagggcctcgagtgggtggccgccatctccttcgccgggaccaacaagtactacgccgacagcgtgaagggccggttcacgatctcccgcgacaacagcaagaacgcgctgtacctgcagatgaactccctccgggccgaggacaccgccctgtactactgcgccaaggacctgcgcgagagcgagtgcgaggagtgggcgtccgactactacgacttcgggcgggactacccctgccaggacccccgcggcgtcgtggggaccctcgacatctggggccagggcaccatggtgacggtcagctcc

SEQ ID NO: 9759 - RNA, 432 nt, synthetic construct
  misc_feature 1..432: note = derived and/or modified sequence opt1 from anti-HIV_cap256-048-129369_VR-Chain
  source 1..432: mol_type = other RNA
caggtgcagctggtcgagagcggcgggggcgtggtgcagcccgggcgctccctccggctgagctgcgccgcctccggcttcaccttcagcaactacgtcatgcactgggtgcgccaggcgccggggaagggcctggagtgggtggccctcgtctccttcgacggcagcaacaagtactacgccgactccgtgaaggggcggttcaccatcagccgcgacaactccaagaacacggtgtacctgcagatgaacagcctgcggggcgtcgacaccgccgtgtactactgcgccaaggacctcgggggcggggaggtggaggagtgggcgaccgactactacgactggtccatcgcctaccccgtcgagcacccccgcgccgtggtgggcgtcttcgacatctggggccaggggaccaaggtgacggtgagctcc

SEQ ID NO: 9760 - RNA, 432 nt, synthetic construct
  misc_feature 1..432: note = derived and/or modified sequence opt1 from anti-HIV_cap256-048-128476_VR-Chain
  source 1..432: mol_type = other RNA
gaggtgcaggtcctggagagcggcgggggcctcgtgcagcccgggggctccctgcgcctggcctgcgccgcgagcgggttctccttcagctcctacggcatgcactgggtgcggcaggccccgggcaaggggctcgagtgggtcagcttcatccgctacgacggcgccaacaagtaccacgccgactccgtgaaggggcggttcatcatcagccgcgacgactccaagaacaccgtgagcctgcagatgaactccctgcggcccgaggacaccgccgtctactactgcgcgaaggacctcggcgccaacaaggacgacgagtgggccacggactactacgacctgagcatcgcctaccccgtgcccgacccgcgcgcggtggtcggggccttcgacatctggggccagggcaccatggtgaccgtgtccagc

SEQ ID NO: 9761 - RNA, 432 nt, synthetic construct
  misc_feature 1..432: note = derived and/or modified sequence opt1 from anti-HIV_cap256-048-128270_VR-Chain
  source 1..432: mol_type = other RNA
caggtgcagctggtcgagagcggcgggggcgtggtgcagcccgggcgctccctccggctgagctgcaccgcctccggcttcaccttccgcagctacgccatgcactgggtccggcaggcgccggggaagggcctggagtgggtggccctcatctcctacgacggcagcaacaagtactacgccgactccgtgaaggggcgcttcacgatcagccgggacaactccaagaacaccctgtacctgcagatgaacagcctcacctccgaggacaccgccgtctactactgcgccaaggacctgggcgggagcaagacggacgagtggggcaccgactactacgagttctggaacgcgtaccccgtgcaggacccccgcgtggtcgtgggggccttcgacatctggggccacggcaccatggtgaccgtctccagc

SEQ ID NO: 9762 - RNA, 432 nt, synthetic construct
  misc_feature 1..432: note = derived and/or modified sequence opt1 from anti-HIV_cap256-048-126220_VR-Chain
  source 1..432: mol_type = other RNA
caggtgcagctggtcgagagcggcgggggcgtggtgcagcccgggcgctccctccggctgagctgcgccgcctccggcttcatcttcagcccgtacgggatccactgggtccgccaggcgcccggcaagggcctggagtgggtggccctcatctcccacgacgggagcaagaagtactacgccgactccgtgaagggccggttcaccatcagccgcgacaacttcaaggacaccctgtacctgcagatgaactccctccgcggggtcgacacggccgtgtactactgcgccaaggacctgggcgggggcgaggtggaggagtgggcgaccgactactacgactggagcaccgcctaccccgtcgagcacccccgggccgtggtgggcgtcttcgacatctgggggcagggcaccaaggtgacggtgtccagc

SEQ ID NO: 9763 - RNA, 432 nt, synthetic construct
  misc_feature 1..432: note = derived and/or modified sequence opt1 from anti-HIV_cap256-048-125713_VR-Chain
  source 1..432: mol_type = other RNA
gaggtgcagctggtcgagagcggcgggggcctcgtgcagcccgggggctccctgcgcctgagctgcgaggcctccgggttcagcttctccacctacgagctcaactgggtgcggcaggccccgggcaagggcctggagtgggtcgcggtgatcagctacgacgggtccaactactactacgccgacagcgtgaagggccgcttcaccatctcccgggacaacagcaagaacacgctgtacctccagatgaactccctgcgcgccgaggacaccgccgtctactactgcgccaaggacgtgggggcgaacaaggacgacgagtgggccaccgactactacgacctgagcatcgcctaccccgtgcccgacccccgggccgtcgtgggcgcgttcgacatctgggggcagggcaccatggtgacggtctccagc

SEQ ID NO: 9764 - RNA, 432 nt, synthetic construct
  misc_feature 1..432: note = derived and/or modified sequence opt1 from anti-HIV_cap256-048-123934_VR-Chain
  source 1..432: mol_type = other RNA
caggtgcagctggtcgagagcggcgggggcgtggtgcagcccgggcgctccctccggctgagctgcgccgcctccggcttcaccttcagctcctacgggatggcgtgggtccgccaggccccgggcaagggcctggagtgggtgaccgccatcagcttcgccgggacgaacaagtactacgccgactccgtgaagggccggttcaccatcagccgcgacaactccaaggacaccctctacctgcagatggacgggctgcggcccgaggacaccgcgctctactactgcgccaaggacctgggcgagcgcgagtgcgaggagtgggccagcgactactacgacttcgggcgggacttccccggccaggaccagcgcgccgtcgcgggcgtgttcgacatgtgggggcagggcacgatggtgaccgtctccagc

SEQ ID NO: 9765 - RNA, 432 nt, synthetic construct
  misc_feature 1..432: note = derived and/or modified sequence opt1 from anti-HIV_cap256-048-122673_VR-Chain
  source 1..432: mol_type = other RNA
gaggtgcaggtcgtggagagcggcgggggcctggtgaagcccgggggctccctccgcctgagctgcgccgcctccgggttcaccttcagctcccacgtcatgaactgggtgcggcaggcgccgggcaagggcctggagtgggtgagctccatcagcgggggctccagctccaaggactacgccgacagcgtcaaggggcgcttcaccatctcccgggacaacagcaagaacacgctctccctgcagatgaacagcctgcgccccgaggacaccgccgtgtactactgcgccaaggacgtgggcgccaacaaggacgacgagtgggcgaccgactactacgacctctccatcgcctaccccgtccccgacccgcgggccgtggtgggggccttcgacatctggggccagggcaccatggtcacggtgagctcc

SEQ ID NO: 9766 - RNA, 432 nt, synthetic construct
  misc_feature 1..432: note = derived and/or modified sequence opt1 from anti-HIV_cap256-048-122208_VR-Chain
  source 1..432: mol_type = other RNA
cgcgtgcaggtcgtggagagcggcgggggcgtggtcaagcccgggggctccctgcggctcagctgcggggcctccggcttcaccttcagcaacgcctggctgtcctgggtgcgccaggcgccgggcaaggggctggagtgggtggccgtcatcagctccgacggcagctccaagaactacgccgacagcgtgaaggggcggttcaccatctcccgcgacaacagcaagaacacggtgtccctccagatgaacagcctgcggcccgaggacaccgccgtctactactgcgccaaggacgtgggcgcgaacaaggacgacgagtgggccaccgactactacgacctgtccatcgcctaccccgtgcccgacccgcgcgccgtcgtgggggcgttcgacatctggggccagggcaccatggtgacggtcagctcc

SEQ ID NO: 9767 - RNA, 432 nt, synthetic construct
  misc_feature 1..432: note = derived and/or modified sequence opt1 from anti-HIV_cap256-048-121552_VR-Chain
  source 1..432: mol_type = other RNA
caggtgcagctggtcgagagcggcgggggcgtggtgcagcccgggggctccctccgcctgagctgcgccgcctccgggttcaccttcagctcctacgcgatgcactgggtccggcaggccccgggcaagggcctgaagtgggtggccgacatcagctacgacgcctccagcaagtactacgccgactccgtgaaggggcgcttcaccatcagccgggacaactccaagaacacgctctacctggagatgaacagcctgcgccccgaggacaccgcggtctactactgcgccaaggacctcggcgagcgggagtgcgaggagtgggcctccgactactacgacttcgggcgcgacttcccctgccaggacccccggggcgtggtggggaccttcgacatctggggccagggcaccatggtcacggtgagctcc

SEQ ID NO: 9768 - RNA, 432 nt, synthetic construct
  misc_feature 1..432: note = derived and/or modified sequence opt1 from anti-HIV_cap256-048-120643_VR-Chain
  source 1..432: mol_type = other RNA
caggtgcagctggtcgagagcggcgggggcgtggtgcagcccgggcgctccctccggctgagctgcgccgcctccggcttcaccctgagcgcgtacaccatgcactgggtccgccaggccccggggaagggcctcgagtgggtgtccgtgatcagcttcgccggcaacaacaagtactacgccgactccgtcaaggggcggttcacgatcagccgcgagaactccaagaacatgctgtacctgcagatgaacagcctccggggcgaggacaccgccgtgtactactgcgcgaaggacctgcgcgagttcgagtgcgaggagtgggcctccgactactacgacttcgggcgggactacccctgccaggacccccgcggcgtggtcgggaccttcgacgtgtggggccacggcagcctggtgaccgtctccagc

SEQ ID NO: 9769 - RNA, 432 nt, synthetic construct
  misc_feature 1..432: note = derived and/or modified sequence opt1 from anti-HIV_cap256-048-118458_VR-Chain
  source 1..432: mol_type = other RNA
caggtgcagctggtcgagagcggcgggggcgtggtgcagcccgggcggtccctccggctgagctgcgccgcctccggcttcaccttcagcacctccgggatgcactgggtccgccaggcgccgggcaagggcctggagtgggtggccttcatcagctccgaccggagcaacaagttctacgccgactccgtgaaggggcgcttcagcatctcccgggacaacagcaagtacacgctctacctgcagatgaactccctgcgcgccgacgacaccgccgtctacttctgcgcgaaggacctcggcgtgaacaagaacgacgagtgggccaccgactactacgacctgagcgtggcctaccccgtccaggacccccgcggggtggccggcatcttcgacatctgggggcagggcaccatggtgacggtctccagc

SEQ ID NO: 9770 - RNA, 432 nt, synthetic construct
  misc_feature 1..432: note = derived and/or modified sequence opt1 from anti-HIV_cap256-048-118112_VR-Chain
  source 1..432: mol_type = other RNA
caggagcagctggtggagagcggcgggggcgtcgtgcagcccgggcgctccctccggctgagctgcgccgcctcccagttcaccttcagcaactacggcatgcactgggtgcgccaggcgccggggaagggcctggtctgggtggccggcatctccttcgccgggaccaacaagtactacgccgccagcgtgaagggccggttcacgatctcccgcgacaacagcaagaacaccctctacctgcagatgaactccctgcgggcggaggacaccgccctctactactgcgccaaggacatgcgcgagtacgagtgcgaggagtgggccagcgactactacgacttcgggcgggactacccctgccaggacccccgcggcgtcgtggggaccttcgacatctggggccagggcacgatggtgaccgtctccagc

SEQ ID NO: 9771 - RNA, 432 nt, synthetic construct
  misc_feature 1..432: note = derived and/or modified sequence opt1 from anti-HIV_cap256-048-116469_VR-Chain
  source 1..432: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccatcatcagctacgacggctccaacaagtactacgccgacagcgtgaaggggcggttcaccatctcccgcgacaaccccaagaacacgctctacctgcagatgaacagcctgcgggccgaggacaccggcctctactactgcgcgaaggacatgggggagtccgagaaggaggagtgggccagcgactactacgacttcggccgcgactaccccgggcaggagccccgggccatggtcggcaccttcgacatctggggccaggggaccatggtgacggtgtccagc

SEQ ID NO: 9772 - RNA, 432 nt, synthetic construct
  misc_feature 1..432: note = derived and/or modified sequence opt1 from anti-HIV_cap256-048-113917_VR-Chain
  source 1..432: mol_type = other RNA
gaggtgcagctggtcgagagcggcgggggcctcgtgcagcccgggggctccctgcgcctgagctgcgccgcctccgggctcaccgtgagcgacacctacatgaactggctgcggcaggcgccgggcaagggcctggagtgggtcgccgtggtgtccagcgacgggtccaacaagaactacgccgacagcgtcaagggccgcttcacgatctcccgggacaacagcaagaacaccgtgtacctccagatgaactccctgcgcgccgaggacaccgccgtgtactactgcgcgaaggacctgggggccaacaaggacgacgagtgggccaccgactactacgacctcagcgtcgcctaccccgtgcccgacccccgggcggtggtcggcgccttcgacgtgtgggggcagggcacgatggtgaccgtctccagc

SEQ ID NO: 9773 - RNA, 432 nt, synthetic construct
  misc_feature 1..432: note = derived and/or modified sequence opt1 from anti-HIV_cap256-048-112368_VR-Chain
  source 1..432: mol_type = other RNA
caggtgcagctggtcgagagcggcgggggcgtggtgcagcccgggcgctccctccggctgagctgcgccgcctccggcttcaccttcagccgcaacgcgatgcactgggtccggcaggccccggggaagggcctggagtgggtggccgtgatctcctacgacggcagcaacaagtactacgccgactccgtcaaggggcgcttcaccatcagccgggacaactccaagaacacgctctacctgcagatgaacagcctgcgcgccgaggacaccgcggtgtactactgcgccaaggacctcggcgggggcgaggtggaggagtgggccaccgactactacgactggtccaccgcctaccccgtcgagcacccccgggcggtggtgggggtcttcgacatctggggccagggcacgaaggtgaccgtgagctcc

SEQ ID NO: 9774 - RNA, 432 nt, synthetic construct
  misc_feature 1..432: note = derived and/or modified sequence opt1 from anti-HIV_cap256-048-112047_VR-Chain
  source 1..432: mol_type = other RNA
gaggtgcagctggtcgagagcggcgggggcctcgtgcagcccgggggctccctgcgcctgagctgcgccgcctccgggctcaccgtgagcggctactacatgtcctgggtccggcaggcgccgggcaaggggctggagtggctggccttcatccacttcgacggcagcaagatccactacgccgggtccgtgaagggccgcatcaccgtgagccgggacaactccaagaacacgctcgacctgcagatgaacagcctgcgcgccgaggacaccgccgtctactactgcgcgaaggacgtgggggactccaagagcgacgagtgggccaccgactactacgacctctccgtggcctaccccgtccccgacccccgggccgtggtgggcgcgttcgacatctggggccaggggaccatggtcacggtgagctcc

SEQ ID NO: 9775 - RNA, 432 nt, synthetic construct
  misc_feature 1..432: note = derived and/or modified sequence opt1 from anti-HIV_cap256-048-112029_VR-Chain
  source 1..432: mol_type = other RNA
caggtgcagctggtcgagagcggcgggggcgtggtgcagcccgggcgctccctccggctgagctgcgccgcctcccagttcaccttcagctcctacggcatgcactgggtccgccaggcgccggggaagggcctggagtgggtggccggcatcagcttcgccgggatcaagaagtactacgccgactccgtgaagggccggttcaccatcagccgcgacaactccaagaacacgctctacctgcagatgaacagcctgcgcggggaggacaccgccctctactactgcgcgaaggacctgcgggagtacgagtgcgaggagtgggcctccgactactacgacttcggccgggactacccctgccaggacccccgcggggtcgtgggcatcttcgacatctggggccaggggaccatggtgaccgtcagctcc

SEQ ID NO: 9776 - RNA, 432 nt, synthetic construct
  misc_feature 1..432: note = derived and/or modified sequence opt1 from anti-HIV_cap256-048-110957_VR-Chain
  source 1..432: mol_type = other RNA
caggtgcgcctggtcgagagcggcgggggcgtggtgcggtccgggcgcagcctccggctgtcctgcgccgccagcggcttcaccttctccaacttcgcgctgcactgggtccgccaggcccccgggaagggcctcgagtgggtggccgtgatcagctacgacggcaactccaagttctacgccgacagcgtcaaggggcggttcaccatctccacggacaacagcaagaacaccctgtacctgcagatgaactccctcaccgccgaggacaccgcggtgtactactgcgccaaggacctgggcgggaacaaggacgacgagtggggcacggactactacgacttcagcgtggcctacccggtccaggacccccgcgccgtgtccgggatcttcgacgtgtggggccacggcaccatggtcaccgtgagctcc

SEQ ID NO: 9777 - RNA, 432 nt, synthetic construct
  misc_feature 1..432: note = derived and/or modified sequence opt1 from anti-HIV_cap256-048-110526_VR-Chain
  source 1..432: mol_type = other RNA
caggtgcagctggtcgagagcggcgggggcgtggtgcagcccgggcgctccctccggctgagctgcgccgcctccggcttcaccttcagcaacttcgggttccactgggtccgccaggcgccgggcaagggcctggagtgggtggccgccatctccttcgccgggaacaacaagtactacgccgacagcgtgaagggccggttcaccatctcccgcgagaacagcaagaacatcctctacctgcagatgaactccctgcgcggggaggacacggcggtctactactgcgccaaggacctccgggagttcgagtgcgaggagtgggccagcgactactacgactggtccaccgcctaccccgtggagcacccccgggcggtggtcggcgtgttcgacatctgggggcagggcaccaaggtgaccgtcagctcc

SEQ ID NO: 9778 - RNA, 432 nt, synthetic construct
  misc_feature 1..432: note = derived and/or modified sequence opt1 from anti-HIV_cap256-048-109336_VR-Chain
  source 1..432: mol_type = other RNA
gaggtgcagctggtcgagagcggcgggggcctcgtgcagcccgggggctcccagcgcctgagctgcgccgcctccgggctgaccgtgaacagcaactacatgacctgggtccggcaggcgccgggcaagggcctcgagtgggtggccatcatctccagcgacgggtccggccagtactacgccgacagcgtgaaggggcgcttcacgatctcccgggacaacagcaagaacaccctgtccctgcagatgaacagcctccgccccgaggacaccgccgtctactactgcgccaaggacctgggcgcgtccaaggacgacgagtgggccaccgactactacgacttcagcatcgcctaccccgtgcaggacccccgggccgtggtcggggcgttcgacatctggggccagggcacgatggtgaccgtgtccagc

SEQ ID NO: 9779 - RNA, 432 nt, synthetic construct
  misc_feature 1..432: note = derived and/or modified sequence opt1 from anti-HIV_cap256-048-108152_VR-Chain
  source 1..432: mol_type = other RNA
caggcccagctggtggagagcggcgggggcgtcgtgcagcccgggcgctccctcgtgctgagctccgtcgccagcggcttctccttcagcacctacgcgatgcactgggtgcggcaggccccggggaagggcctggagtgggtggccgtcatctcctacgacggcgggaacaagtactacgccgacagcgtgaagggccgcttctccatcagccgggacaactccaagaacaccgtgtacctccagatcaacagcctgcgcgccgaggacacggcggtctactactgcgccaaggacctgggggccaacaaggacgacgagtgggccaccgactactacgacctctccgtggcgtaccccgtgcccgacccccgggccgtcgtgggcgccttcgacgtgtgggggcagggcaccatggtcaccgtgagctcc

SEQ ID NO: 9780 - RNA, 432 nt, synthetic construct
  misc_feature 1..432: note = derived and/or modified sequence opt1 from anti-HIV_cap256-048-107799_VR-Chain
  source 1..432: mol_type = other RNA
gaggtgcaggtcgtggagagcggcgggggcgtggtccagcccgggcgctccctgcggctcagctgcgccgcctccggcttcaccttcagcaactacgcgatggactgggtgcgccaggccccggggaagggcctggagtgggtggccttcgtctccagcgacggctccaacaagaactacgccgacagcgtgaaggggcggttcaccatctcccgcgacaacagcaagaacacgctgtccctccagatgaacagcctgcgggccgaggacaccgcggtgtactactgcgccaaggaggtcggcgagaacaaggacgacgagtgggcctccgactactacgacctgagcatcgcctaccccatccacgacccccgcgcggtggtcgggggcttcgacatctgggggcagggcaccatggtgaccgtgtccagc

SEQ ID NO: 9781 - RNA, 432 nt, synthetic construct
  misc_feature 1..432: note = derived and/or modified sequence opt1 from anti-HIV_cap256-048-107384_VR-Chain
  source 1..432: mol_type = other RNA
gaggtgcgcctggtcgagagcggcggggccctcgtgaagcccggcacctccctgcggctgagctgcgccgcgtccgggttcaccttcacgcactacgccatggactgggtgcgccaggccccgggcaaggggctcgagtgggtcgccatcatcagctccgacggcagcaccaagaactacgccgactccgtgaagggccggttcaccatcagccgcgacaactccaagaacaccctgagcctgcagatgaactccctccggcccgaggacacggcggtgtactactgcgccaaggacgtcggggccaacaaggacgacgagtgggccaccgactactacgacctgagcatcgcgtaccccgtgcccgacccgcgcgccgtggtcggcgccttcgacatctgggggcagggcaccatggtgaccgtgtccagc

SEQ ID NO: 9782 - RNA, 432 nt, synthetic construct
  misc_feature 1..432: note = derived and/or modified sequence opt1 from anti-HIV_cap256-048-106530_VR-Chain
  source 1..432: mol_type = other RNA
gaggtgcagctgctcgagagcggcgggggcctggtccagcccgggggctccctgcgcctcagctgcgccgcctccgggttcaccttcagctcctacgcgatggactgggtgcggcaggccccgggcaagggcctggagtgggtggccgtcatcagctccgacgggagcaacaagaactacgccgactccgtgaagggccgcttcaccatcagccgggacaactccaagaacacgctgtacctccagatgagctccctgcgccccgaggacaccgccgtgtactactgcgcgaaggacgtcggggacagcaagtccgacgagtgggccaccgactactacgacttcagcatcgcctaccccatccaggacccccgggccgtggtgggcgcgttcgacatctgggggcagggcaccatggtcacggtgtccagc

SEQ ID NO: 9783 - RNA, 432 nt, synthetic construct
  misc_feature 1..432: note = derived and/or modified sequence opt1 from anti-HIV_cap256-048-106464_VR-Chain
  source 1..432: mol_type = other RNA
gaggtgcagatggtccagagcggcgggggcctggtgcagcccgggggctccctccgcctgagctgcgccgccttcgggttcaccttcaccaaccacgcgatggactgggtgcggcaggtcccgggcaagggcctggagtgggtggccttcatctccagcgacgggtccaacaagaactacgccgacagcgtgaagggccgcttcacgatctcccgggacaacagcaagaacaccgtctacctccagatgtccagcctgcgccccgaggacaccgccgtgtactactgcgccaaggacgtgggggactccaagagcgacgagtgggcgaccgactactacgacctgtccgtcgcctaccccgtgcccgacccgcgggccgtggtcggcgccttcgacatctgggggcagggcacgatggtgaccgtgagctcc

SEQ ID NO: 9784 - RNA, 432 nt, synthetic construct
  misc_feature 1..432: note = derived and/or modified sequence opt1 from anti-HIV_cap256-048-106411_VR-Chain
  source 1..432: mol_type = other RNA
caggtgcagctggtcgagagcggcgggggcgtggtgcagcccgggcgctccctccggctgagctgcgccgcctccggcttcaccttcagctactccgggatgcactgggtccgccaggcgccgggcaagggcatggagtgggtggccgtgatcagctacgacgggtccaacaagtactacgccgacagcgtcaagggccggttcaccatctcccgcgacaacagcaagaacacgctgtacctccagatgaactccctgcgggtggaggacaccgccgtgtaccactgcgccaaggacctcgggggcaccaagagcgacgagtgggcgaccgactactacgacctgtccatcgcctaccccatccaggaccccggggccgtcgtgggcgtgttcgacatctggggccaggggacgatggtcaccgtgagctcc

SEQ ID NO: 9785 - RNA, 432 nt, synthetic construct
  misc_feature 1..432: note = derived and/or modified sequence opt1 from anti-HIV_cap256-048-106306_VR-Chain
  source 1..432: mol_type = other RNA
gaggtgcagctggtcgagagcggcgggggcctcgtgcagcccgggggctccctgcgcctgagctgcgaggcctccgggttcaccttcaacaactacggcatggtgtgggtccggcaggccccgggcaaggggctcgagtgggtggcgatcatcagctacgacggcaccgagaagtactacgtggactccgtcaaggggcgcttcacgatcagccgggacaactccaagaacaccctgagcctgcagatgaactccctccgcgccgaggacaccgccgtgtactactgcgccaaggaggtgggcgagaacaaggacgacgagtgggccagcgactactacgacctgtccatcgcgtaccccatccacgacccccgggccgtcgtcgggggcttcgacatctggggccaggggaccatggtgacggtgagctcc

SEQ ID NO: 9786 - RNA, 432 nt, synthetic construct
  misc_feature 1..432: note = derived and/or modified sequence opt1 from anti-HIV_cap256-048-104496_VR-Chain
  source 1..432: mol_type = other RNA
caggtgcagctggtcgagagcggcgggggcctcgtgaagcccgggggctccctgcgcctgagctgcgccgcctccgggttcaccttcagctcctacggcatgcactgggtgcggcaggcgccgggcaaggggctcgagtgggtcgccttcgtgagctccgacggcaacaacaagaactacgccgacagcgtgaaggggcgcttcaccatctcccgggacaacagcaagaacacggtctacctgcagatgaactccctgcgcgtggaggacaccgccgtgtactactgcgccaaggacctcggcgcgaacaaggacgacgagtgggccaccgactactacgacctgagcgtcgcctaccccgtgcccgacccccgggccgtggtcggggcgttcgacgtgtggggccagggcaccatggtgacggtctccagc

SEQ ID NO: 9787 - RNA, 432 nt, synthetic construct
  misc_feature 1..432: note = derived and/or modified sequence opt1 from anti-HIV_cap256-048-103074_VR-Chain
  source 1..432: mol_type = other RNA
caggtgcacctggtcgagagcggcgccggggtggtgcagcccggcgggtccctccgcctgagctgcgccgtctccggcttcaccttcaacagctacgggatgcactgggtgcggcaggcgccgggcaagggcctggagtgggtggccgtcatctcctacgacgggagcgacaagtactacgccgactccgtgaagggccgcttcaccatcagccgggactccagcaagaacacgctctacctgcagatgaactccctgcgcgtggaggacaccgccgtctactactgcgccaaggacctcggggcgaacaaggacgacgagtgggccaccgactactacgacctgagcgtggcctaccccgtgcccgacccccgggccgtcgtgggcgcgttcgacgtgtgggggcagggcaccatggtcacggtgtccagc

SEQ ID NO: 9788 - RNA, 432 nt, synthetic construct
  misc_feature 1..432: note = derived and/or modified sequence opt1 from anti-HIV_cap256-048-100832_VR-Chain
  source 1..432: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccgtggtcagctccgacgggaccaacaagaactacggcgacagcgtgaaggggcggttcacgatctcccgcgacaacagccggaacaccgtgtacctccagatgtccagcctgcgccccgaggacaccgccgtctactactgcgccaaggacgtgggcgacaccaagtccgacgagtgggccacggactactacgacttcagcatcgcgtaccccgtgcaggacccccgggccgtcgtgggggccttcgacatctggggccagggcaccatggtgaccgtctccagc

SEQ ID NO: 9789 - RNA, 432 nt, synthetic construct
  misc_feature 1..432: note = derived and/or modified sequence opt1 from anti-HIV_cap256-048-100188_VR-Chain
  source 1..432: mol_type = other RNA
caggtgcacctggtcgagagcggcgggggcgtggtgcagcccgggcgctccctccggatctactgcgccgtcagcgagttcaccttccgcaactacgccatgcactgggtgcggctggcgccgggcaaggggctgcagtgggtggccgtcatctcctacaacggcggcaagaagtactacgccgacagcgtgaaggggcgcttcaccatctcccgggacaacagcaagaacgccctctacctgcagatgaactccctgcgcgccgaggacacgggcctctactactgcgcgaaggacctgcgggagttcgagtgcgaggagtgggccagcgactactacgacttcgggcgcgagtacccctgccaggacccccggggcgtggtcgggaccttcgacatctggggccagggcaccatggtgaccgtgtccagc

SEQ ID NO: 9790 - RNA, 432 nt, synthetic construct
  misc_feature 1..432: note = derived and/or modified sequence opt1 from anti-HIV_cap256-048-099645_VR-Chain
  source 1..432: mol_type = other RNA
caggtgcagctggtcgagagcggcgggggcgtggtgcagcccgggcggtccctccggctgagctgcgccgcctccggcttcaccttcagccgctacgcgctgcactgggtccggcaggccccggggaagggcctcgagtgggtggccgtgatctcctacgacggcagctccaagtactacgccgacagcgtcaaggggcgcttctccatcagccgggacaactccaagtacaccctgtacctgcagatgaacagcctccgcgccgacgacacggcggtgtacttctgcgccaaggacctgggcgtgaacaagaacgacgagtgggccaccgactactacgacctgtccgtcgcctaccccgtgcaggacccccgcggggtggcgggcatcttcgacatctgggggcagggcaccatggtcaccgtgagctcc

SEQ ID NO: 9791 - RNA, 432 nt, synthetic construct
  misc_feature 1..432: note = derived and/or modified sequence opt1 from anti-HIV_cap256-048-098137_VR-Chain
  source 1..432: mol_type = other RNA
caggtgcagctggtcgagagcggcgggggcgtggtgcagcccgggcgctccctccggctgagctgcgccgcctccggcttcaccctgcgcaactacgcgatgcactgggtccggcaggccccggggaagggcctcgagtgggtggccgtgatcagctccgacggcaacaacaagtactacgccgacagcgtcaaggggcgcttcaccgtgtcccgggacaacagcaaggacacgctgtacctgcagatgaactccctccgccccgaggacaccgccctgtactactgcgcgaaggacctgggcgagcgggagtgcgaggagtgggccagcaactactacgacttcgggcgcgactacccctgccaggacccccggggcgtggtcgggaccttcgacatctggggccagggcaccatggtgacggtgtccagc

SEQ ID NO: 9792 - RNA, 432 nt, synthetic construct
  misc_feature 1..432: note = derived and/or modified sequence opt1 from anti-HIV_cap256-048-097878_VR-Chain
  source 1..432: mol_type = other RNA
caggtgcagctgctcgagagcggcgggggcgtcgtgcagcccgggaagtccctgcggctgagctgcgccgcctccggcttcaccttcaacacctacgggatgcactgggtgcggcaggcgccgggcaagggcctccagtgggtcgccgtgatcagctacgacgggacgatccagaagtacgccgactccgtgaagggccgcttcaccatcagccgggagaactccaagaacatgctgtacctgcagatgaacagcctccgcggggaggacaccgccgtctactactgcgccaaggacctgcgggagttcgagtgcgaggagtgggcgtccgactactacgacttcggccgcgactacccctgccaggacccccgcggggtggtgggcaccttcgacgtctggggccacgggagcctggtgacggtgtccagc

SEQ ID NO: 9793 - RNA, 432 nt, synthetic construct
  misc_feature 1..432: note = derived and/or modified sequence opt1 from anti-HIV_cap256-048-097510_VR-Chain
  source 1..432: mol_type = other RNA
caggtgcagctggtcgagagcggcgggggcgtggtgcagcccgggcgctccctctggctgagctgcgccgcctccgagttcaccctgcggagctacggcatgcactgggtccgccaggcgccggggaagggcctcgagtgggtggccttcgtggccttcgacgagtccgacaagtactacgccgacagcgtcaagggccggttcaccatctcccgcgacaacagcaagaacacgctgtccctgcagatgaacagcctccgggccgaggacaccgcggtgtactactgcgccaaggaggtgggggacaacaaggacgacgagtgggcctccgactactacgacctgagcatcgcctaccccgtccacgacccccgcgcggtggtgggcgggttcgacatctggggccaggggaccatggtcaccgtgtccagc

SEQ ID NO: 9794 - RNA, 432 nt, synthetic construct
  misc_feature 1..432: note = derived and/or modified sequence opt1 from anti-HIV_cap256-048-097313_VR-Chain
  source 1..432: mol_type = other RNA
caggtgcagctggtcgagagcggcgggggcctcgtgcagcccgggggcgccctgcgcctgtcctgcctcgtgagcgggttcaccttcgacgactacgccctgcactgggtccggcaggcgccgggcaagggccccgagtgggtggccgtgctgtccagcgacgggtcctacaagtactacaccgagagcgtccagggccgcttcacgatctcccgggacaacagcaagaacaccgtgtacctccagatgaactccctgcgcggggtggacaccgccgtctactactgcgccaaggacctgggcgggggcgaggtggaggagtgggccaccgactactacgactggagcatcgcgtaccccgtggagcacccccgggccgtcgtgggcgtgttcgacatctgggggcagggcacgaaggtcaccgtgtccagc

SEQ ID NO: 9795 - RNA, 432 nt, synthetic construct
  misc_feature 1..432: note = derived and/or modified sequence opt1 from anti-HIV_cap256-048-096626_VR-Chain
  source 1..432: mol_type = other RNA
gaggtgcagctggtcgagagcggcgggggcctcgtgcagcccggggagtccctgcgcctgagctgcgccggctccgggttcaccttcagctcctactggatgagctgggtgcggcaggccccgggcaagggcctcgagtggatggcgctgatctcctacgacgggagcaacaagtactacgtcgactccgtgaagggccgcttcaccatcagccgggacaactccaagaacacgctgtacctccagatgaacagcctgcgcgccgaggacaccgccgtgtactactgcgccaaggacctcgggggcaacaaggacgacgagtgggccaccgactactacgacctgtccatcgcgtaccccgtccaggacccccgggtggtggtcgggatcttcgacatctggggccagggcaccatggtgacggtgagctcc

SEQ ID NO: 9796 - RNA, 432 nt, synthetic construct
  misc_feature 1..432: note = derived and/or modified sequence opt1 from anti-HIV_cap256-048-096483_VR-Chain
  source 1..432: mol_type = other RNA
gaggtgcagctggtcgagagcggcgggggcctcgtgcagcccgggcgctccctgcggctgagctgcgccgcctccggcttcagcttcgaggactacgcgatgcactgggtgcgccaggccccggggaagggcctcgagtgggtcgccggcatctccttcgccgggaccaagaagtactacgccgacagcgtgaagggccggttcaccatctcccgcgacaacagcaagaacgcgctgtacctgcagatgaactccctccgggccgaggacacggccctgtactactgcgccaaggacctgcgcgagtacgagtgcgaggagtgggcgagcgactactacgacttcgggcgggactacccctgccaggacccccgcggcgtggtcgggaccttcgacatctggggccagggcaccatggtgaccgtgtccagc

SEQ ID NO: 9797 - RNA, 432 nt, synthetic construct
  misc_feature 1..432: note = derived and/or modified sequence opt1 from anti-HIV_cap256-048-095691_VR-Chain
  source 1..432: mol_type = other RNA
caggtgcagctggtcgagagcggcgggggcgtggtgcagcccgggcgctccctccggctgagctgcgccgcctccggcttcaccttcagctcctacgggatggcgtgggtccgccaggccccgggcaagggcctggagtgggtgaccgccatcagcttcgccgggacgaacaagtactacgccgactccgtgaagggccggttcaccatcagccgcgacaactccaaggacaccctctacctgcagatggacgggctgcggcccgaggacaccgcgctctactactgcgccaaggacctgggcgagcgcgagtgcgaggagtgggccagcaactactacgacttcgggcgggactacccctgccaggacccccgcggcgtcgtgggcacgttcgacatctgggggcagggcaccatggtgaccgtctccagc

SEQ ID NO: 9798 - RNA, 432 nt, synthetic construct
  misc_feature 1..432: note = derived and/or modified sequence opt1 from anti-HIV_cap256-048-095525_VR-Chain
  source 1..432: mol_type = other RNA
caggtgcagctggtccagagcggcgggtccgtggtgcagcccggcaagagcctccgcctgtcctgcgccgccagcgggttcaccttctccagcttcggcatgcactgggtccggcagaccccggggaagggcctggagtgggtggcggtgatctcctacgacggcagcgagaagtcctacgccgacagcgtcaaggggcgcttcacgatctcccgggacaacagcaagaacaccctctacctgcagatgaactccctgcgcgccgaggacaccgccgtgtactactgcgccaaggacctcggcgggaccaaggacgacgagtgggcgacggactactacgacatcagcatcgcctaccccgtgcaggacccccgggccgtcgccggcgcgttcgacatctgggggcagggcaccatggtgaccgtgtccagc

SEQ ID NO: 9799 - RNA, 432 nt, synthetic construct
  misc_feature 1..432: note = derived and/or modified sequence opt1 from anti-HIV_cap256-048-094783_VR-Chain
  source 1..432: mol_type = other RNA
gaggtgcagctggtcgagagcggcgggggcctcgtgaagcccgggggctccctgcgcctgagctgcgccgcctccgggatcaccttcagcacctacgagatgaactgggtgcggcaggcgccgggcaagggcatggagtgggtcgccgtgatctcctacgacgggagcaacaagtactacgccgactccgtgaagggccgcttcacgatcagccgggacaactccaagaacaccgtctacctccagatgaacagcctgcgcggggtggacaccgccgtgtactactgcgccaaggacctgggcgggggcgaggtcgaggagtgggcgaccgactactacgactggtccatcgcctaccccgtggagcacccccgggccgtggtcggcgtgttcgacatctgggggcagggcacgaaggtgaccgtcagctcc

SEQ ID NO: 9800 - RNA, 432 nt, synthetic construct
  misc_feature 1..432: note = derived and/or modified sequence opt1 from anti-HIV_cap256-048-094356_VR-Chain
  source 1..432: mol_type = other RNA
caggtgcagctggtcgagagcggcgggggcgtggtgcagcccgggcgctccctccggctgagctgcgccgcctccggcttcatcttcacccactacgcgatggactgggtccgccaggccccggggaagggcctggagtgggtggccgtgatcagctccgacggcagctccaagaactacgccgacagcgtcaaggggcggttcaccatctcccgcgacaacagcaagaacacggtgtccctccagatgaacagcctgcggcccgaggacaccgccgtgtactactgcgcgaaggacgtcggcgacaacaagtccgacgagtgggccaccgactactacgacttcagcatcgcctaccccgtgcccgacccgcgcgccgtggtcggggcgttcgacctgtggggccaggggaccatggtgacggtgtccagc

SEQ ID NO: 9801 - RNA, 432 nt, synthetic construct
  misc_feature 1..432: note = derived and/or modified sequence opt1 from anti-HIV_cap256-048-090756_VR-Chain
  source 1..432: mol_type = other RNA
caggtgcagctggtcgagagcggcgggggcgtggtgcgccccgggcggtccctccgcctgagctgcgccgtctccggcttcaccttcagcaactacgccatccactgggtgcggcaggcgccggggaagggcctggagtgggtggccgtcatctcctacgacggcagcgacaagtactacgccgactccgtgaaggggcgcttcaccatcagccgggagaactccaagaacatgctctacctgcagatgaacagcctgcgcggcgaggacacggccgtgtactactgcgccaaggacctccgggagttcgagtgcgaggagtgggcgtccgactactacgacttcgggcgcgactacccctgccaggacccccggggcgtcgtggggaccttcgacgtgtggggccacggcagcctggtcaccgtgtccagc

SEQ ID NO: 9802 - RNA, 432 nt, synthetic construct
  misc_feature 1..432: note = derived and/or modified sequence opt1 from anti-HIV_cap256-048-089065_VR-Chain
  source 1..432: mol_type = other RNA
caggtgcagctggtcgagagcggcgggggcgtggtgcagcccgggcgctccctccggctgagctgcgccgcctccggcttcaccttcagcacctacgcgatgcactgggtccgccaggccccggggaagggcctggagtgggtggccctcatctcctacgacggcacgaacaagtactacgtggacagcgtcaaggggcggttcaccatctcccgcgacaacagcaagaacaccctgtacctgcagatgaactccctcaccgccgaggacacggccgtgtactactgcgcgaaggacctgggcgggaacaaggacgacgagtggggcaccgactactacgacttcagcgtggcctaccccgtccaggacccccgggccgtgtccgggatcttcgacgtgtggggccacggcaccatggtcaccgtgagctcc

SEQ ID NO: 9803 - RNA, 432 nt, synthetic construct
  misc_feature 1..432: note = derived and/or modified sequence opt1 from anti-HIV_cap256-048-084986_VR-Chain
  source 1..432: mol_type = other RNA
caggtgcagctggtcgagagcggcgggggcgtggtgcagcccgggcgctccctccggctgagctgcgccgcctccggcttcaccttcagcgactacgcgatgcactgggtccgccaggccccggggaagggcctggagtgggtggccctcatctcctacgacggcagcaacaagtactacgccgactccgtgaaggggcggttcaccatcagccgcgacaactccaagaacacgctgtacctgcagatgagctccctcaccgccgaggacaccgcggtctactactgcgccaaggacctgggcgggaacaagaacgacgagtgggccaccgactactacgacctgagcatcgcctaccccatccacgacccccgggcggtgctcggcgccttcgacgtgtgggggcagggcacgatgctgaccgtctccagc

SEQ ID NO: 9804 - RNA, 432 nt, synthetic construct
  misc_feature 1..432: note = derived and/or modified sequence opt1 from anti-HIV_cap256-048-083355_VR-Chain
  source 1..432: mol_type = other RNA
caggtgcagctggtcgagagcggcgggggcgtggtgcagcccgggcgctccctccggctgagctgcgccgtctccggcttcatcttcagctcctacgccatgcgctgggtgcggcaggcgccggggaagggcctggagtgggtggccgtcatcagctacgacggctccaagaccaactacgccgacagcgtgaaggggcgcttcaccatctcccgggacaacagcaagaacacgctctacctgcagatgaactccctgaccagcgaggacaccgccgtgtactactgcgccaaggacctcggcgggtccaagaccgacgagtggggcacggactactacgagttctggaacgcgtaccccgtccaggacccccgcgtggtggtcggggccttcgacatctggggccacggcaccatggtgaccgtgagctcc

SEQ ID NO: 9805 - RNA, 432 nt, synthetic construct
  misc_feature 1..432: note = derived and/or modified sequence opt1 from anti-HIV_cap256-048-082462_VR-Chain
  source 1..432: mol_type = other RNA
caggtgcacctggtcgagagcggcgggggcgtggtgcagcccgggaagtccctccgcctgagctgcaccgcctcccggttcatcttccgcaactacgccatggactgggtccggcaggcgccgggcaaggggctggagtgggtggccgtgatcagctacgacggcgtcaaggagcactacgccgagtccgtgaagggccgcttcaccatcagccgggacaactccaagaacacggtgtacctccagatgaacagcctgcgcgtcgaggacaccgccgtgtactactgcgccaaggacctgggggcgaacaaggacgacgagtgggccaccgactactacgacctctccgtggcctaccccgtccccgacccccgggccgtggtgggcgcgttcgacgtctgggggcagggcaccatggtgacggtgagctcc

SEQ ID NO: 9806 - RNA, 432 nt, synthetic construct
  misc_feature 1..432: note = derived and/or modified sequence opt1 from anti-HIV_cap256-048-082246_VR-Chain
  source 1..432: mol_type = other RNA
caggtgcacctggtcgagagcggcgggggcgtggtgcagcccgggcgctccctccggatcagctgcgccgcctccggcttcaccttcagcaagaacgcgatgcactgggtccgccaggccccggggaagggcctggagtgggtggccttcgtggccttcgacgagtccgacaagtactacgccgacagcgtcaagggccggttcaccatctcccgcgacaacagcaagaacatcctgtccctccagatgaacagcctgcgggcggaggacacggccgtgtactactgcgccaaggaggtggacgagtacaaggacgacgagtgggcctccgactactacgacctgagcatcgcgtaccccgtccgcgacccccgggccgtggtcgggggcttcgacatctgggggcagggcaccatggtgaccgtgtccgcc

SEQ ID NO: 9807 - RNA, 432 nt, synthetic construct
  misc_feature 1..432: note = derived and/or modified sequence opt1 from anti-HIV_cap256-048-080752_VR-Chain
  source 1..432: mol_type = other RNA
caggtgcagctggtcgagagcggcgggggcgtggtgcagcccgggggctccctccgcctgagctgcgccgcctccgggttcaccttcagcaactacggcatgcactgggtccggcaggcgccgggcaaggggctggagtgggtggccttcatccgctacgacggcgacatcacctactacgtggactccgtcaaggggcggttcacgatcagccgcgacaactccaagaacgccctctacctgcagatgaacagcctgcgggccgaggacaccgccctctactactgcgcgaaggacctgcgcgagtacgagtgcgaggagtgggcctccgactactacgacttcggccgggagtacccctgccaggacccccgcggggtggtgggcaccttcgacatctggggccaggggaccatggtcacggtgagctcc

SEQ ID NO: 9808 - RNA, 435 nt, synthetic construct
  misc_feature 1..435: note = derived and/or modified sequence opt1 from anti-HIV_cap256-048-078409_VR-Chain
  source 1..435: mol_type = other RNA
caggtgcagctggtcgagagcggcgggggcgtggtgcagcccgggcgctccctccggctgagctgcgccgcctccggcttcaccttcaacaactacgcgatggactgggtccgccaggccccggggaagggcctggagtgggtggccctcatcagctacgacggctccaacaagtactacgccgagagcgtgaaggggcggttcaccatctcccgcgacaacagcaagaacacgctgtacctgcagatgaactccctccgggccgaggacaccgcggtctactactgcgccaaggacgtgggcgagaagcagagcatgatgcgctgggccaccgactactacgacctgtccatcgcctaccccgtgcccgacccccgggcggtcgtgggggccttcgacctgtggggccgcgggaccatggtgacggtcagctcc

SEQ ID NO: 9809 - RNA, 432 nt, synthetic construct
  misc_feature 1..432: note = derived and/or modified sequence opt1 from anti-HIV_cap256-048-078273_VR-Chain
  source 1..432: mol_type = other RNA
gaggtgcagctggtcgagagcggcgggggcctcgtgcagcccgggggctccctgcgcctgagctgcgccgcctccgggttcaccgtgagctccaactacatgagctgggtccggcaggcgccgggcaagggcctcgagtgggtggccgtgatctccagcgacgggtccaacaagaactacgccgacagcgtcaagggccgcttcaccatctcccgggacaacagcaagaacacgctgttcctgcagatgaactccctccgccccgaggacaccgccgtgtacttctgcgccaaggacctgggggcgaacaaggacgacgagtgggccaccgactactacgacctgagcatcgcctaccccgtgcacgacccccgggccgtcgtgggcatcttcgacctctgggggcagggcaccatggtgacggtctccagc

SEQ ID NO: 9810 - RNA, 432 nt, synthetic construct
  misc_feature 1..432: note = derived and/or modified sequence opt1 from anti-HIV_cap256-048-078062_VR-Chain
  source 1..432: mol_type = other RNA
gacgtgtacctggtcgagagcggcgggggcctcgtgcagcccgggggctccctgcgcctgagctgcaccgcctccgggatcaccttcagcacgtacgagatgaactgggtgcggcaggccccgggcaagggcctcgagtgggtcgcgttcgtggccttcgacgggtccgacaagtactacgccgacagcgtgaagggccgcttcgtcatctcccgggacaacagcaagaacaccctgtccctgcagatgaacagcctccgcgccgaggacaccgccgtgtactactgcgcgaaggaggtgggggaggacaaggacgacgagtgggcctccgactactacgacctgagcatcgcctaccccgtccacgacccccgggccgtggtgggcgggttcgacatctggggccagggcaccatggtcacggtgtccagc

SEQ ID NO: 9811 - RNA, 432 nt, synthetic construct
  misc_feature 1..432: note = derived and/or modified sequence opt1 from anti-HIV_cap256-048-077798_VR-Chain
  source 1..432: mol_type = other RNA
caggtgcagctggtcgagagcggcgggggcgtggtgcagcccgggcgctccctccggctgagctgcgccgcctccggcttcaccttcagcaactacgggatgcactgggtccgccagaccccgggcaagggcctggagtgggtggcggtgatctcctacgacgggagcaacaagttctacgccgactccgtcaagggccggttcacgatcagccgcgacaactccaagaacaccctctacctgcagatgaacagcctgcgggtggaggacaccgccgtgtaccactgcgccaaggacctcgggggctccaagagcgacgagtgggccaccgactactacgactggtccatcgcgtaccccgtccacgacccccgcgccgtggtgggggtcttcgacatctggggccagggcacgctggtgaccgtgagctcc

SEQ ID NO: 9812 - RNA, 432 nt, synthetic construct
  misc_feature 1..432: note = derived and/or modified sequence opt1 from anti-HIV_cap256-048-073853_VR-Chain
  source 1..432: mol_type = other RNA
gaggtgcagctggtcgagagcggcgggggcctcgtgaagcccgggggctccctgcggctgagctgcgccgcctccgggttcaccttcagcgacgcgtggatgaactgggtgcggcaggccccgggcaagggcctcgagtgggtcgccgggatctccttcgccggcaccaacaagtactacgccgacagcgtgaaggggcgcttcacgatctcccgggacaacagcaagaacaccctgtacctgcagatgaactccctccgcgcggaggacaccgccctgtactactgcgccaaggacatgcgggagtacgagtgcgaggagtgggccagcgactactacgacttcggccgcgactacccctgccaggacccccgcggggtggtcggcaccttcgacatctggggccaggggacgatggtgaccgtgtccagc

SEQ ID NO: 9813 - RNA, 435 nt, synthetic construct
  misc_feature 1..435: note = derived and/or modified sequence opt1 from anti-HIV_cap256-048-071661_VR-Chain
  source 1..435: mol_type = other RNA
caggtgcagctggtcgagagcggcgggggcgtggtgcagcccgggcgctccctcggcctgagctgcgaggtctccgggttcaccttcagcgactacttcatgtcctggatccggcaggccccgggcaagggcctggagtgggtggccgtgatcagccacgacgggaacaacaagtactaccccgactccgtccagggccgcttcaccatcagccgggagaactccaagaacacgctctacctgcagatgaacagcctgaagcccgaggacaccgcggtgtacttctgcgccaaggacctcgggggcgagtccgaggtggaggagtgggccagcgactactacgacttcgggcgcgacatccccggcccggacccccggggcgtcgtggggaccctggacatctggggccacgggaccatggtgacggtctccagc

SEQ ID NO: 9814 - RNA, 432 nt, synthetic construct
  misc_feature 1..432: note = derived and/or modified sequence opt1 from anti-HIV_cap256-048-071360_VR-Chain
  source 1..432: mol_type = other RNA
caggtgcagctggtcgagagcggcgggggcgtggtgcagcccgggcgctccctccggctgagctgcgccgcctccggcttcaccctgaccaactacgcgatggactgggtccgccaggccccggggaagggcctcgagtgggtggccgtgatcagctccgacggcagcaacaagaactacgaggactccgtcaaggggcggttcacgatcagccgcgacaactccaagaacaccctgtacctgcagatgagctccctccggcccgaggacaccgccgtgtactactgcgccaaggacgtgggcgacaacaagagcgacgagtgggcgaccgactactacgacttctccatcgcctaccccgtccccgacccgcgcgccgtggtgggggccttcgacctgtggggccaggggacgatggtcaccgtgagctcc

SEQ ID NO: 9815 - RNA, 432 nt, synthetic construct
  misc_feature 1..432: note = derived and/or modified sequence opt1 from anti-HIV_cap256-048-070955_VR-Chain
  source 1..432: mol_type = other RNA
gaggtgcagctggtcgagagcggcgggggcctcgtgcagcccgggggctccgtgcgcctgagctgcgccgtctccgggttcaccttcagctcctactggatgagctgggtgcggcaggccccgggcaagggcctggagtgggtggcggtcatctccgacagcgggtccaacaagtactacgccgacagcgtgaagggccgcttcaccatctcccgggacaacagcaagaacacgctctacctgcagatgaactccctgcgcgccgaggacaccgccgtgtacttctgcgccaaggacctcgggggccgggagaccgaggagtgggcgagcgactactacgacttcgggcgcgacttccccggccaggaccagcgggccgtcgccggcgtgttcgacatgtgggggcagggcaccatggtgacggtctccagc

SEQ ID NO: 9816 - RNA, 432 nt, synthetic construct
  misc_feature 1..432: note = derived and/or modified sequence opt1 from anti-HIV_cap256-048-070061_VR-Chain
  source 1..432: mol_type = other RNA
gaggtgcagctgctcgagagcggcgggggcctggtccagcccgggggctccctgcgcctcagctgcgccgcctccgggttcaccttcagctcctacgcgatgcactgggtgcggcaggccccgggcaagggcctggagtgggtggccgtcaccagctacgacgggtccaacaagtactacgccgacagcgtgaagggccgcttcacgatctcccgggacaacagcaagaacaccctgtacatgcagatgaactccctccgcgccgaggacaccgcggtgtactactgcgccaaggaccagggggagagcgagaaggaggagtgggcctccgactactacgacttcggccgggactaccccgggcgcgacccccggcgcgtcgtggccaccttcgcgatctggggccagggcacgatggtgaccgtcagctcc

SEQ ID NO: 9817 - RNA, 432 nt, synthetic construct
  misc_feature 1..432: note = derived and/or modified sequence opt1 from anti-HIV_cap256-048-069669_VR-Chain
  source 1..432: mol_type = other RNA
caggtgcagctggtcgagagcggcgggggcgtggtgcagcccgggcgctccctccggctgagctgcgccgtctccggcttcaccttcagcaagttcccgatgcactgggtgcgccaggcccccgggaagggcctggagtgggtggcggtcatctcctacgacggcaacaagaagtactacgtggacagcgccaaggggcggttcaccatctcccgcgacaacagccggaagacgctctacctgcagatgaccggcctgcgccccgaggacaccgccgtgtactactgcgccaaggacctcgggggcggggagtgcgagacctgggcctccgactactacgacttcggcaaggactacccctgcctggacccgcgggacgtcgtgggcacgttcgacatctgggggcagggcaccctggtgaccgtcagctcc

SEQ ID NO: 9818 - RNA, 432 nt, synthetic construct
  misc_feature 1..432: note = derived and/or modified sequence opt1 from anti-HIV_cap256-048-069205_VR-Chain
  source 1..432: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggtggtcatcagcaacgacggcaacaacaagtactacgccgactccgtgaaggggcggttcaccatcagccgcgacaactccaagaacacggtgtacctccagatgaacagcctgcgggccgaggacaccgccgtctactactgcgcgaaggacgtgggcgacaccaagaaggacgagtgggccaccgactactacgacctgtccatcgcctaccccgtgcaggacccccaggccgtcgtgggggcgttcgacatctggggccaggggacgatggtgaccgtcagctcc

SEQ ID NO: 9819 - RNA, 432 nt, synthetic construct
  misc_feature 1..432: note = derived and/or modified sequence opt1 from anti-HIV_cap256-048-068882_VR-Chain
  source 1..432: mol_type = other RNA
caggtgcagctggtcgagagcggcgggggcgtggtgcagcccgggcgctccctccggctgagctgcgccgcctccggcttcaccttcagcacctacgcgatgcactgggtccgccaggccccggggaagggcctggagtgggtggccctcatctcctacgacggcacggacaagtactacgccgacagcgtgaaggggcggttcaccatctcccgcgacaacagcaagaacaccgtctacctgcagatgaactccctgcggggcgtggacaccgccgtgtactactgcgcgaaggacctcgggggcggggaggtcgaggagtgggccacggactactacgactggagcaccgcctaccccgtggagcacccccgcgccgtggtcggcgtgttcgacatctggggccaggggaccaaggtgaccgtctccagc

SEQ ID NO: 9820 - RNA, 432 nt, synthetic construct
  misc_feature 1..432: note = derived and/or modified sequence opt1 from anti-HIV_cap256-048-067764_VR-Chain
  source 1..432: mol_type = other RNA
gaggtgcagctggtccagagcggcgggggcctcgtgaagcccgggggctccctgcgcctgagctgcgccgcctccgggttcaccttcagcacctactccatgaactgggtgcggcaggcgccgggcaagggcctcgagtgggtcgccgtgatcagctccgacgggagctccaagaactacgccgacagcgtgaagggccgcttcacgatctcccgggacaacagcaagaacaccgtctccctgcagatgaacagcctgcgccccgaggacaccgccgtgtactactgcgccaaggacgtgggggcgaacaaggacgacgagtgggccaccgactactacgacctctccatcgcctaccccgtccccgacccgcgggccgtggtgggcgcgttcgacatctgggggcagggcacgatggtcaccgtgagctcc

SEQ ID NO: 9821 - RNA, 432 nt, synthetic construct
  misc_feature 1..432: note = derived and/or modified sequence opt1 from anti-HIV_cap256-048-066845_VR-Chain
  source 1..432: mol_type = other RNA
caggtgctgctcgtcgagagcggcgggggcgtggtgcagcccgggggctccctgaccctgagctgcgccgcctccgggttcaccttcagcaactacggcatgcactgggtccgccaggcgccgggcaaggggctcgagtgggtggccttcatccggtacgacggcaacaacaagtactacgccgactccgtgaaggggcgcttcacgatcagccgggacaactccaaggacaccctgtacctgcagatggacggcctccgccccgaggacaccgccctgtactactgcgccaaggacctgggggagcgggagtgcgaggagtgggcgagcaactactacgacttcggccgcgactacccctgccaggacccccggggcgtcgtggggaccttcgacatctggggccaggggacgatggtgaccgtctccagc

SEQ ID NO: 9822 - RNA, 432 nt, synthetic construct
  misc_feature 1..432: note = derived and/or modified sequence opt1 from anti-HIV_cap256-048-065226_VR-Chain
  source 1..432: mol_type = other RNA
gaggtgcagctggtcgagagcggcgggggcctcgtgaagcccgggggctccctgcgcctgagctgcgtggcctccgggttcaccttcagcaactacggcatgcactgggtccggcaggccccgggcaaggggctcgtgtgggtggcgggcatctccttcgccgggaccaacaagtactacgccgccagcgtcaagggccgcttcacgatctcccgggacaacagcaagaacaccctgtacctgcagatgaactccctccgcgccgaggacaccgcgctgtactactgcgccaaggacatgcgggagtacgagtgcgaggagtgggccagcgactactacgacttcgggcgcgactacccctgccaggacccccggggcgtggtgggcaccttcgacatctgggggcagggcacgatggtcaccgtgtccagc

SEQ ID NO: 9823 - RNA, 432 nt, synthetic construct
  misc_feature 1..432: note = derived and/or modified sequence opt1 from anti-HIV_cap256-048-063717_VR-Chain
  source 1..432: mol_type = other RNA
caggtgcagctggtcgagagcggcgggggcgtggtgcagcccgggcgctccctccggctgagctgcgccgcctccggcttcagcttctccaaccacgcgatggactgggtccgccaggccccggggaagggcctggagtgggtggccgtgatcagctccgacggcagcgacaagatctacgccgagtccgtcaaggggcggttcaccatcagccgcgacaactccaagaacaccctctacctgcagatgaacagcctgcgggtggaggacacggccgtgtacttctgcgcgaaggacctcggcgccaacaaggacgacgagtgggccaccgactactacgacctgtccatcgcctaccccgtccccgacccccgcgcggtggtgggggccttcgacatctggggccaggggaccatggtcagcgtgtccagc

SEQ ID NO: 9824 - RNA, 432 nt, synthetic construct
  misc_feature 1..432: note = derived and/or modified sequence opt1 from anti-HIV_cap256-048-063150_VR-Chain
  source 1..432: mol_type = other RNA
gaggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggcccacatccggtacgacggcagcaacaagtactacatcgactccgtgcaggggcgcttcaccatcagccgggacaaccccaagaacacgctctacctgcagatgaactccctgcgcaccgaggacaccgccgtctactactgcgccaaggacctcggcgggggcgaggtggaggagtgggcgaccgactactacgactggagcatcgcctaccccgtggagcacccccgggccgtcgtgggggtgttcgacatctggggccagggcacgaaggtcaccgtgtccagc

SEQ ID NO: 9825 - RNA, 432 nt, synthetic construct
  misc_feature 1..432: note = derived and/or modified sequence opt1 from anti-HIV_cap256-048-062431_VR-Chain
  source 1..432: mol_type = other RNA
caggtgcagctggtcgagagcggcgggggcgtggtgcagcccgggcgctccctccggctgagctgcgccgcctccggcttcaccttcagcaacttcgcgatggactgggtccgccaggccccggggaagggcctggagtgggtggccgtgatctccagcgacggctccaagaagaactacggggacagcgtcaagggccggttcaccatctcccgcgacaacagcaagaacacgctgttcctgcagatgaactccctgcggcccgaggacaccgccctctactactgcgccaaggacctcgggggctacaagagcgacgagtgggcgaccgactactacgacctgtccatcgcctaccccgtgcaggacccccgcccgtggctcgagctgctgtacatctgggggcagggcgccatggtgaccgtcagctcc

SEQ ID NO: 9826 - RNA, 432 nt, synthetic construct
  misc_feature 1..432: note = derived and/or modified sequence opt1 from anti-HIV_cap256-048-060745_VR-Chain
  source 1..432: mol_type = other RNA
caggtgcagctggtcgagagcggcgggtccgtggtgcagcccggccgcagcctccggctgacctgcaccgcctccgggttcacgttcagccactacgccatggactgggtccgccaggcgccgggcaaggggctggagtgggtggccgtgatctccagcgacgccaccaacaagaactacgccgactccgtcaagggccggttcaccatcagccgcgacaactccaagaacaccgtgtacctccagatggacagcctgcgggccgaggacacggcggtgtactactgcgccaaggacgtcggcgactacaaggacgacgagtgggccaccgactactacgacttctccatcgcctaccccgtgcccgacccccgcgcggtggtcggggccttcgacttctggggccaggggaccatggtgaccgtgagctcc

SEQ ID NO: 9827 - RNA, 432 nt, synthetic construct
  misc_feature 1..432: note = derived and/or modified sequence opt1 from anti-HIV_cap256-048-060420_VR-Chain
  source 1..432: mol_type = other RNA
caggtgcagctggtcgagagcggcgggggcgtggtgcagcccgggcgctccctccggctgagctgcgccgcctccggcttcaccttcagctcctacgggatggcgtgggtccgccaggccccgggcaagggcctggagtgggtgaccgtgatcagcttcgccggggtcaagaagtactacgccgactccgtgaagggccggttcacgatcagccgcgacaactccaaggggaccctctacctgcagatgaacagcctgcgggccgaggacaccgcggtgtactactgcgccaaggacgtcggcgacaccaagaaggacgagtgggccacggactactacgacctctccatcgcctaccccgtgcaggacccccaggcggtggtcggggccttcgacatctggggccagggcaccatggtgaccgtgagctcc

SEQ ID NO: 9828 - RNA, 435 nt, synthetic construct
  misc_feature 1..435: note = derived and/or modified sequence opt1 from anti-HIV_cap256-048-060014_VR-Chain
  source 1..435: mol_type = other RNA
caggtgcagctggtcgagagcggcgggggcgtggtgcagcccgggcgctccctgcggctgagctgcgccgcctccggcttcaccttcagcaactacgggatgcactgggtccgccaggcgccgggcaagggcctggagtgggtggccctcatctcccacgacgggagcaacaagaacttcgccgactccgtgaagggccggttcaccatcagccgcgacaactccaagaacacgctgtacctgcagatgaacagcctccggaccgaggacaccgccatctactactgcgccaaggacctcgggggcgagtccgagatcgaggagtggcccagcgactactacgacttcgggcgcgactaccccgtccccgacccgcggggcgtggtgggcaccttcgacttctgggggcagggcacgatggtcaccgtgtccagc

SEQ ID NO: 9829 - RNA, 432 nt, synthetic construct
  misc_feature 1..432: note = derived and/or modified sequence opt1 from anti-HIV_cap256-048-059747_VR-Chain
  source 1..432: mol_type = other RNA
caggtgcagctggtcgagagcggcgggggcgtggtgcagcccgggcgctccctccggctgagctgcgccgcctccggcttcaccttcacccactacgcgatggactgggtccgccaggccccggggaagggcctggagtgggtggccgtgatcagctccgacggcagctccaaggactacgccgacagcgtcaaggggcggttcacgatctcccgcgacaacagcaagaacaccctctccctgcagatgaacagcctgcggcccgaggacaccgccgtgtactactgcgcgaaggacctcggcgcctccaaggacgacgagtgggccaccgactactacgacctgagcatcgcctaccccgtgcacgacccccgcgcggtcgtcgggggcttcgacatctgggggcagggcacgatggtgaccgtgtccagc

SEQ ID NO: 9830 - RNA, 432 nt, synthetic construct
  misc_feature 1..432: note = derived and/or modified sequence opt1 from anti-HIV_cap256-048-058393_VR-Chain
  source 1..432: mol_type = other RNA
caggtgcagctggtcgagagcggcgggggcgtggtgcagcccgggggctccctccgcctgagctgcgccgcctccgggttcaccttcaacacctacggcatgcactgggtccggcaggcgccgggcaaggggctggagtgggtgacgttcatccgctacgacggcagcaacgagtactacgccgactccgtgaaggggcggttcaccatcagccgcgacaactccaagaacaccctctacctgcagatgaacagcctgtccgtcgaggacaccgccgtgtactactgcgccaaggacctcggcaagaacaaggacgacgagtgggccacggactactacgacatcagcatcgcgtaccccgtgcccgacccccgggccgtcgtgggggtgttcgacatctggggccagggcaccgtcgtgaccgtgtccagc

SEQ ID NO: 9831 - RNA, 432 nt, synthetic construct
  misc_feature 1..432: note = derived and/or modified sequence opt1 from anti-HIV_cap256-048-058159_VR-Chain
  source 1..432: mol_type = other RNA
caggtgcagctggtcgagagcggcgggggcgtggtgcagcccgggcgctccctccggctgagctgcgccgcctccggcttcaccttcagctcctacccgatgcactgggtccgccaggcgcccgggaagggcctggagtgggtggccgtgatcagcttcgccggcaccaacaagtactacgcccactccgtcaaggggcggttcacgatcagccgcgacaactccaagaacaccctctacctgcagatgaacagcctgcgggccgaggacaccgcgctctactactgcgcccgcgacctgcgggagtccgagtgcgaggagtgggccagcgactactacgacttcggccgcgagtacccctgccaggacccccgcggggtggtgggcaccttcgacatctgggggcggggcacgatggtcaccgtgtccagc

SEQ ID NO: 9832 - RNA, 432 nt, synthetic construct
  misc_feature 1..432: note = derived and/or modified sequence opt1 from anti-HIV_cap256-048-057127_VR-Chain
  source 1..432: mol_type = other RNA
gacgtgtacctggtcgagagcggcgggggcctcgtgcagcccgggggctccctgcgcctgagctgcgtggcctccgggatcaccttcagctcctacggcatgcactgggtccggcaggccccgggcaaggggctcgagtgggcggccttcatccgctacgacggccggaacaagtactacgccgacagcgtgaaggggcgcttcaccatctcccgggacaacagcaagaacacgctgtccctgcagatgaacaacctccgcgccgaggacaccgccgtgtactactgcgcgaaggaggtcggcgacaacaaggacgacgagtgggccagcgactactacgacctgtccatcgcctaccccgtgcaggacccccgggccgtggtcgggggctacgacatctggggccaggggaccatggtgaccgtgagctcc

SEQ ID NO: 9833 - RNA, 432 nt, synthetic construct
  misc_feature 1..432: note = derived and/or modified sequence opt1 from anti-HIV_cap256-048-056251_VR-Chain
  source 1..432: mol_type = other RNA
gaggtgcagctggtcgagagcggcgggggcctcgtgcagcccgggcggtccctgcggctgagctgcgccggctccgggttcaccttcagcaacttcggcttccactgggtgcgccaggccccgggcaaggggctcgagtgggtcgcggccatctccttcgccggctacaacaagtactacgccgacagcgtgaaggggcggttcaccatctcccgcgagaacagcaacaacatgctgtacctgcagatgtccagcctccgggccgaggacacggcggtgtactactgcgccaaggacctgcgcgagtccgagtgcgaggagtgggccagcgactactacgacttcggcaaggactacccctgccaggacccccgcggggtcgtgggcaccttcgacgtgtggggccacgggtccctggtcaccgtgagctcc

SEQ ID NO: 9834 - RNA, 432 nt, synthetic construct
  misc_feature 1..432: note = derived and/or modified sequence opt1 from anti-HIV_cap256-048-055421_VR-Chain
  source 1..432: mol_type = other RNA
caggtgcagctggtcgagagcggcgggggcgtggtgcagcccgcccgctccctccggctgagctgcgccgcgtccgggttcatcttcagcacctacggcatgcactgggtccgccaggccccggggaagggcctggagtgggtggccgtgatctccagcgacggctccagcaaggactacgccgactccgtcaaggggcggttcaccatcagccgcgacaactccaagaacacgctcagcctgcagatgaactccctgcggcccgaggacaccgccgtgtactactgcgcgaaggacctcggcgccagcaaggacgacgagtgggccaccgactactacgacttctccatcgcctaccccgtgcaggacccccgcgcggtcgtgggggccttcgacatctggggccaggggaccatggtgacggtcagctcc

SEQ ID NO: 9835 - RNA, 432 nt, synthetic construct
  misc_feature 1..432: note = derived and/or modified sequence opt1 from anti-HIV_cap256-048-054989_VR-Chain
  source 1..432: mol_type = other RNA
caggtgcagctggtcgagagcggcgggggcgtggtgcagcccgggggctccctgcgcctgagctgcgccgcctccgggttcaccttcagcaccaacggcatgcactgggtccggcaggcgccgggcaaggggctggagtgggtggccttcatccgctacgacggctccaacaagtactacgccgacagcgtgaaggggcggttcacgatctcccgcgacaacagcaagaacaccgtctacctccagatgaactccctgcggggcgtggacaccgccgtgtactactgcgccaaggacctcgggggcggcgaggtcgaggagtgggcgaccgactactacgactggagcatcgcctaccccgtggagcacccccgcgccgtggtcggggtgttcgacatctggggccaggggacgaaggtgaccgtctccagc

SEQ ID NO: 9836 - RNA, 435 nt, synthetic construct
  misc_feature 1..435: note = derived and/or modified sequence opt1 from anti-HIV_cap256-048-054759_VR-Chain
  source 1..435: mol_type = other RNA
caggtgcagctggtcgagagcggcgggggcgtggtgcagcccgggcgctccctccggctgagctgcgccgcctccggcttcagcttctccaagaacgggatgcactgggtccgccaggcgccgggcaagggcctggagtgggtggccttcgtggccttcgacgagagcgacaagtactacgccgactccgtcaaggggcggttcaccatcagccgcgacaactccaagaacaccctcagcctgcagatgaactccctgcgggtggaggacacggccgtgtactactgcgcgaaggaggtcggcgagaacaaggacgacgagtgggccgcccccgactactacgacttcagcatcgcctaccccgtgcaggacccccgcgcggtggtcgggggcttcgacatctgggggcagggcaccatggtgaccgtgtccagc

SEQ ID NO: 9837 - RNA, 432 nt, synthetic construct
  misc_feature 1..432: note = derived and/or modified sequence opt1 from anti-HIV_cap256-048-052573_VR-Chain
  source 1..432: mol_type = other RNA
caggtgaagctggtcgagagcggcgggggcgtggtgcagcccgggcgctccctccggctgagctgcgccgcctccggcttcagcttctccaactacgcgatggactgggtccgccaggccccggggaagggcctggagtgggtggccgtggtcagctccgacggcagcaacaagaactacgccgactccgtgaaggggcggttcaccatcagccgcgacaactccaagaacaccgtgtacctccagatgaacagcctgcgggccgaggacacggcggtctactactgcgccaaggacctgggcgccaacaaggacgacgagtgggccaccgactactacgactggtccatcgcgtaccccgtgcacgacccccgcgccgtggtcggggtgttcgacatctggggccaggggaccctcgtgaccgtcagctcc

SEQ ID NO: 9838 - RNA, 432 nt, synthetic construct
  misc_feature 1..432: note = derived and/or modified sequence opt1 from anti-HIV_cap256-048-051477_VR-Chain
  source 1..432: mol_type = other RNA
caggagcagctggtggagagcggcgggggcgtcgtgcagcccgggcgctccctccggctgagctgcgccgcctccggcttcaccttcagcaactacgcgatgcactgggtgcgccaggccccggggaagggcctggagtgggtcgccgccatgtcccacgacggcagcgacaagtactacgccgactccgtgaaggggcggttcaccatcagccgcgacaactccaagaacacgctctacatgcagatgaacagcctgcgggcggaggacaccgccgtgtactactgcgccaaggaccagggcgagtccgagaaggaggagtgggccagcgactactacgacctgtccatcgcgtaccccatccaggacccccgcgccatggtcggggccttcgacatctggggccaggggaccatggtgaccgtgagctcc

SEQ ID NO: 9839 - RNA, 432 nt, synthetic construct
  misc_feature 1..432: note = derived and/or modified sequence opt1 from anti-HIV_cap256-048-051299_VR-Chain
  source 1..432: mol_type = other RNA
caggtgcagctggtcgagagcggcgggggcgtggtgcagcccgggcgctccctccggctgagctgcgccgcctccggcttcaccttcagcaccttcgggatgcactgggtccgccaggcgccgggcaagggcctggagtgggtggccctcatctcccacgacgggaacaacaagtactacgccgacagcctgaagggccggttcacgatctcccgcgagaacagcaagaacaccctgttcctccagatgaactccctgcgggccgaggacaccagcgtgtactactgcgccaaggacctgggggactccgagtgcgaggagtgggcgagcgactactacgacttcggcaaggactacccctgcctccacccccgcggggtcgtgggcaccttcgacttctggggccacgggacgatggtgaccgtctccagc

SEQ ID NO: 9840 - RNA, 432 nt, synthetic construct
  misc_feature 1..432: note = derived and/or modified sequence opt1 from anti-HIV_cap256-048-050815_VR-Chain
  source 1..432: mol_type = other RNA
caggtgcagctggtcgagagcggcgggggcgtggtgcagcccgggggctccctccgcctgagctgcgtcgtgtccgggttcaccttcagctcctacggcatgcactgggtgcggcaggccccgggcaaggggctggagtgggtcagcttcatccgcttcgacggcaactacgagtactacgtggactccgtgaaggggcggttcaccatcagccgcgacaactccaagaacacggtctacctccagatggacagcctgcgggccgaggacaccgcggtgtactactgcgccaaggacgtgggcgactacaaggacgacgagtgggccaccgactactacgacttctccatcgcctaccccgtccccgacccccgcgccgtggtgggggcgttcgacttctggggccagggcaccatggtcacggtgagctcc

SEQ ID NO: 9841 - RNA, 432 nt, synthetic construct
  misc_feature 1..432: note = derived and/or modified sequence opt1 from anti-HIV_cap256-048-049884_VR-Chain
  source 1..432: mol_type = other RNA
caggtgcagctggtcgagagcggcgggggcgtggtgcagcccgggcgctccctccggctgagctgcgccgcctccggcttcagcttcaacacctacgcgatgcactgggtccgccaggccccggggaagggcctggagtggatggccctcatctcctacgacggcagcaacaagtactacgtggactccgtgaaggggcggttcaccatcagccgcgacaactccaagaacacgctgtacctgcagatgaacagcctccgggccgaggacaccgccgtctactactgcgcgaaggacctgggcgggaacaaggacgacgagtgggccaccgactactacgacctgtccatcgcctaccccgtgcaggacccccgcgtggtcgtgggcatcttcgacatctgggggcagggcaccatggtgacggtcagctcc

SEQ ID NO: 9842 - RNA, 432 nt, synthetic construct
  misc_feature 1..432: note = derived and/or modified sequence opt1 from anti-HIV_cap256-048-049170_VR-Chain
  source 1..432: mol_type = other RNA
caggtgcagctggtcgagagcggcgggggcgtggtgcagcccgggcgctccctccggctgagctgcgccgcctccggcttcatcttcagctcctacgggatgcactgggtccgccaggcgccgggcaagggcctggagtgggtggccgtgatcagcggggacggcaccaagaaggacttcgccgactccgtcaaggggcggttcaccatcagcaaggacaactccaagaacatggtgagcctccagatgaactccctgcgcgccgaggacgccgcggtgtactactgcgccaaggacctgggcgagagcgacaacgaggagtggccctccgactactacgacttcgggcgggacttcacgggccagaacccccgcgccgtcgtgggcaccttcgacctctgggggcagggcaccatggtgaccgtcagctcc

SEQ ID NO: 9843 - RNA, 435 nt, synthetic construct
  misc_feature 1..435: note = derived and/or modified sequence opt1 from anti-HIV_cap256-048-048531_VR-Chain
  source 1..435: mol_type = other RNA
caggtgcagctggtcgagagcggcgggggcgtggtgcagcccgggcgctccctgcggctgagctgcgccgcctccggcttcaccttcagctcctacgggctgcactgggtccgccaggcgccgggcaagggcctcgagtgggtggccttcatcagctacgacgggaacaacaagcactacgtggactccgtcaagggccggttcaccatcagccgcgacaactccaagaacacgctgtacctgcagatgaacagcctccgggccgaggacaccgccgtgtactactgcgccaaggacctcgggggcgagtccgagatcgaggagtgggcgaccgactactacgacttcagcatcgcctaccccgtgaaggagtcccgcggggtcgtgggcatcttcgacatgtggggccaggggaccatggtgacggtcagctcc

SEQ ID NO: 9844 - RNA, 432 nt, synthetic construct
  misc_feature 1..432: note = derived and/or modified sequence opt1 from anti-HIV_cap256-048-048259_VR-Chain
  source 1..432: mol_type = other RNA
caggtgcagctggtcgagagcggcgggggcgtggtgcagcccgggcgctccctccggctgagctgcgccgcctccggcttcaccttcagcacgtgcgcgatgcactgggtccgccaggccccggggaagggcctggagtgggtggccgtgatctcctacgacggcagcaacaagtactacgtcgactccgtgaaggggcggttcaccatcagccgcgacaactccaagaacaccctctacctgcagatgaacagcctgcgggccgaggacaccgccgtgtactactgcgcgaaggaggtcgacatcaacaaggaggacgagtgggcctccgactactacgacttcagcatcgcctaccccgtgcaggacccccgcgccgtggtcggcgggttcgacatctggggccaggggaccatggtgacggtgtccagc

SEQ ID NO: 9845 - RNA, 432 nt, synthetic construct
  misc_feature 1..432: note = derived and/or modified sequence opt1 from anti-HIV_cap256-048-047313_VR-Chain
  source 1..432: mol_type = other RNA
caggtgcagctggtcgagagcggcgggggcgtggtgcagcccgggcgctccctccggctgagctgcgccgcctccggcttcaccttcagcaccttcgggatgcactgggtccgccaggcgccgggcaagggcctggagtgggtggccgtgatctcccacgacgggaacaacaagtactacgccgacagcgtcaagggccggttcacgatctcccgcgacaacagcaagaacaccgtgtacctccagatgaactccctgcgggccgaggacaccgccgtgtactactgcgcgaaggacctgggggccaacaaggacgacgagtgggccaccgactactacgacctcagcgtcgcctaccccgtgcccgacccccgcgcggtggtcggcgccttcgacgtgtgggggcagggcacgatggtgaccgtctccagc

SEQ ID NO: 9846 - RNA, 432 nt, synthetic construct
  misc_feature 1..432: note = derived and/or modified sequence opt1 from anti-HIV_cap256-048-046596_VR-Chain
  source 1..432: mol_type = other RNA
caggtgcagctggtcgagagcggcgggggcgtggtgcagcccgggggctccctccgcctgagctgcgccgcctccgggttcaccttcagctcctacggcatgcactgggtccggcaggcgccgggcaaggggctggagtgggtggccttcatgcgcttcgacggcagcaaccggtactacggggactccgtgaagggccgcttcaccatcagccgggacaactccaagaacacgctctacctgcagatgaacagcctgcgcaccgaggacgccgccctctactactgcgccaaggacatgcgggagttcgagtgcgaggagtgggcgtccgactactacgacttcgggcgcgactacccctgccaggacccccggggcgtcgtgggcatcttcgacatctgggggcagggcaccatggtgaccgtcagctcc

SEQ ID NO: 9847 - RNA, 432 nt, synthetic construct
  misc_feature 1..432: note = derived and/or modified sequence opt1 from anti-HIV_cap256-048-044781_VR-Chain
  source 1..432: mol_type = other RNA
caggtgcagctggtcgagagcggcgggggcgtggtgcagcccgggcgctccctccggctgagctgcgccgcctccggcttcaccttcaccagctacgcgatccactgggtccgccaggccccggggaagggcctggagtgggtggccgtgatctcctacgacggcagcaagaagaactacgccgactccgtcaaggggcggttcacgatcagccgcgacaactccaagaacaccctctacgtgcagatgaacagcctgcgggccgaggacaccgcggtgtactactgcgccaaggaggtcggcgaggacaaggacgacgagtgggcctccgactactacgacctgagcatcgcctaccccgtgcacgacccccgcgcggtggtcgggggcttcgacatctgggggcagggcaccatggtgacggtgtccagc

SEQ ID NO: 9848 - RNA, 432 nt, synthetic construct
  misc_feature 1..432: note = derived and/or modified sequence opt1 from anti-HIV_cap256-048-042599_VR-Chain
  source 1..432: mol_type = other RNA
caggtgcagctggtcgagagcggcgggggcgtggtgcagcccgggcgctccctccggctgagctgcgccgcctccggcttcaccttcagcaactacgggatgcactgggtccgccagaccccgggcaagggcctggagtgggtggcggtgatctcctacgacgggagcaacaagttctacgccgactccgtcaagggccggttcacgatcagccgcgacaactccaagaacaccctctacctgcagatgagctccctgcgggccgacgacaccgccgtgtactactgcgccaaggaggtgggggaggacaaggacgacgagtgggcgagcgactactacgacctctccatcgcctaccccgtccacgacccccgcgccgtggtgggcgggttcgacatctggggccagggcaccatggtcacggtgagctcc

SEQ ID NO: 9849 - RNA, 432 nt, synthetic construct
  misc_feature 1..432: note = derived and/or modified sequence opt1 from anti-HIV_cap256-048-041276_VR-Chain
  source 1..432: mol_type = other RNA
caggtgcagctggtcgagagcggcgggggcgtggtgcagcccgggcgctccctccggctgagctgcgccgcctcccgcttcaccttcagctcctacgcgatgcactgggtccggcaggccccgggcaaggggctggagtgggtggccatcatcagctacgacggctccaacaagtactacgccgacagcgtgaagggccgcttcaccatctcccgggacaacagcaagaacacgctgttcctgcagatgaactccctgcgcgccgaggacaccgcgctctactactgcgccaaggacctcgggggctacaagagcgacgagtgggccaccgactactacgacctgtccatcgcctaccccatccaggacccccgggcggtcgtgggggccttcgacatctggggccaggggaccatggtgacggtcagctcc

SEQ ID NO: 9850 - RNA, 432 nt, synthetic construct
  misc_feature 1..432: note = derived and/or modified sequence opt1 from anti-HIV_cap256-048-040200_VR-Chain
  source 1..432: mol_type = other RNA
caggtgcagctggtcgagagcggcgggggcgtggtgcagcccgggcgctccctgcggctgagctgcgtcgcctccggcttcaccttcagctccttcgggatgcactgggtgcgccaggccccgggcaagggcctggagtgggtggcggtcatcagccacgacgggcacaacaagtactacgccgactccctcaagggccggttcaccgtgagccgcgagaactccaagaacacgctgttcctgcagatgaacagcctccgggccgaggacacctccgtgtactactgcgccaaggacctcgggggcggggagtgcgaggagtgggccagcgactactacgacttcggccgcgactacccctgcctgacgccccggggcgtcgtggggaccttcgacatctggggccacgggaccaccgtgaccgtctccagc

SEQ ID NO: 9851 - RNA, 432 nt, synthetic construct
  misc_feature 1..432: note = derived and/or modified sequence opt1 from anti-HIV_cap256-048-039061_VR-Chain
  source 1..432: mol_type = other RNA
gaggtgcagctgctcggcagcgggggcgggctggtccagcccggcgggtccctgcgcctgacctgcgccgtgagcggcttcaccttctccagcttcgccatgtcctgggtgcggcaggcgccgggcaaggggctcgagtgggtcgccctgatcagctacgacggcacggacaagtactacgccgactccgtgaaggggcgcttcaccatcagccgggacaactccaagaacaccctctacctgcagatgaacagcctgcgcgtggaggacaccgccatctaccactgcgccaaggacctcggcgggacgaagtccgacgagtgggcgaccgactactacgacctgagcatcgcctaccccatccaggaccccggcgccgtcgtgggcgtgttcgacatctgggggcagggcaccatggtcaccgtgtccagc

SEQ ID NO: 9852 - RNA, 432 nt, synthetic construct
  misc_feature 1..432: note = derived and/or modified sequence opt1 from anti-HIV_cap256-048-038515_VR-Chain
  source 1..432: mol_type = other RNA
caggtgcagctggtcgagagcggcgggggcgtggtgcagcccgggcgctccctccggctgagctgcgccgcctccggcttcaccttcagcacctacgcgatgcactgggtccgccaggccccggggaagggcctggagtgggtggtggtcatctcctacgacggcagcaacaagtactacgccgactccgtgaaggggcggttcacgatcagccgcgacaactccaagaacaccctcttcctgcagatgaacagcctgcgggccgaggacaccgccctctactactgcgcgaaggacgtgggcgagtacaagtccgacgagtgggccaccgactactacgacctgagcatcgcctaccccatccaggacccccgcgccatggtcggggcgttcgacatctggggccaggggacgatggtgaccgtgtccagc

SEQ ID NO: 9853 - RNA, 432 nt, synthetic construct
  misc_feature 1..432: note = derived and/or modified sequence opt1 from anti-HIV_cap256-048-038255_VR-Chain
  source 1..432: mol_type = other RNA
caggtgcagctggtcgagagcggcgggggcgtggtgcagcccgggcgctccctccggctgagctgcgccgcctccggcttcaccctgagctcctacgcgatgcactgggtccgccaggccccggggaagggcctcgagtgggtggccgtgatcagctacgacggctccaacaagtactacgccgacagcgtcaaggggcggttcaccatctcccgcgacaacagcaagaacgccctgtacctgcagatgaactccctccgggcggaggacacggccctgtactactgcgccaaggacctgcgcgagtacgagtgcgaggagtgggccagcgactactacgacttcggccgggactacccctgccaggacccccgcggggtggtgggcaccttcgacatctgggggcagggcaccatggtcaccgtgtccagc

SEQ ID NO: 9854 - RNA, 432 nt, synthetic construct
  misc_feature 1..432: note = derived and/or modified sequence opt1 from anti-HIV_cap256-048-038177_VR-Chain
  source 1..432: mol_type = other RNA
caggtgcagctggtcgagagcggcgggggcgtggtgcagcccgggcgctccctgcggctgagctgcgccgcctccggcttcaccttcaacacctacgggatccactgggtccgccaggcgccgggcaagggcctggagtgggtggccctcatcagctacgacgggacggacaagtactacgccgactccgtgaagggccggttcaccatcagccgcgacaactccaagaacaccctgtacctgcagatgaacagcctccgggtcgaggacaccgccatctaccactgcgccaaggacctcgggggcacgaagtccgacgagtgggcgaccgactactacgacctgagcatcgcctaccccatccaggaccccggggccgtggtgggcgtcttcgacatctggggccaggggaccatggtgaccgtgtccagc

SEQ ID NO: 9855 - RNA, 432 nt, synthetic construct
  misc_feature 1..432: note = derived and/or modified sequence opt1 from anti-HIV_cap256-048-035513_VR-Chain
  source 1..432: mol_type = other RNA
caggtgcagctggtcgagagcggcgggggcgtggtgcagcccgggcgctccctccggctgagctgcgccgcctccggcttcaccttcagctcctacgggatggcgtgggtccgccaggccccgggcaagggcctggagtgggtgaccgtgatcagcttcgccggggtcaagaagtactacgccgactccgtgaagggccggttcacgatcagccgcgacaactccaaggggaccctctacctgcagatggacggcctgcggcccgaggacaccgccctctactactgcgcgaaggacctgggggagcgcgagtgcgaggagtgggccagcgactactacgacttcggccgggacttcccctgccaggacccccgcggcgtggtcgggaccttcgacatctggggccaggggacgatggtgaccgtgtccagc

SEQ ID NO: 9856 - RNA, 432 nt, synthetic construct
  misc_feature 1..432: note = derived and/or modified sequence opt1 from anti-HIV_cap256-048-034112_VR-Chain
  source 1..432: mol_type = other RNA
cagatgcagctggtggagagcggcgggggcgtcgtgcagcccgggcgctccctgcggctgagctgcgccgcctccggcttcaccttcaacagctacgcgatgcactgggtgcgccaggccccggggaagggcctggagtgggtcgccgtgatctcctacgacggcagcaacaagtactacgccgactccgtgaaggggcggttcaccatcagccgcgacaactccaagaacacggtctacctccagatgaacagcctgcggggcgtggacaccgccgtgtactactgcgcgaaggacctcgggggcggggaggtcgaggagtgggccaccgactactacgactggtccatcgcctaccccgtggagcacccccgcgccgtggtcggcgtgttcgacatctggggccaggggaccaaggtgacggtcagctcc

SEQ ID NO: 9857 - RNA, 432 nt, synthetic construct
  misc_feature 1..432: note = derived and/or modified sequence opt1 from anti-HIV_cap256-048-033983_VR-Chain
  source 1..432: mol_type = other RNA
caggtgcagctggtcgagagcggcgggggcgtggtgcagcccggggagtccctccgcctgagctgcgccgcctccggcttcaccctgagctcccacgggatccactgggtccggcaggcgccgggcaagggcctcgagtgggtggccttcatcagctccgacgggagcaacaagaactacggcgactccgtgaaggggcgcttcaccatcagccgggacaactccaagaacacgctgttcctgcagatgaacagcctccgcgccgaggacaccgccctgtactactgcgccaaggacgtcggcgagtacaagtccgacgagtgggcgaccgactactacgacctgagcatcgcctaccccatccaggacccccgggccatggtgggggccttcgacatctggggccagggcaccatggtgacggtctccagc

SEQ ID NO: 9858 - RNA, 432 nt, synthetic construct
  misc_feature 1..432: note = derived and/or modified sequence opt1 from anti-HIV_cap256-048-032688_VR-Chain
  source 1..432: mol_type = other RNA
caggtgcagctggtcgagagcggcgggggcgtggtgcagcccgggcgctccctccggctgagctgcgccgcctccggcttcatcttcaacagctacgggatgcactgggtccgccaggcgccgggcaagggcctggagtgggtggccgtggtccacggggacggcgggaacaagtactacgccgactccgtgaagggccggttcaccatcagccgcgacaactccaagaacaccctctacctggagatgaacagcctgcgggccgaggacacggccgagtactactgcgcgaaggacctcggggagtccgacaaggaggagtggcccagcgactactacgacttcggccgcgacttcaccggccaggtgccccgggccgtcgtgggggccttcgacatctggggccaggggaccatggtgaccgtctccagc

SEQ ID NO: 9859 - RNA, 432 nt, synthetic construct
  misc_feature 1..432: note = derived and/or modified sequence opt1 from anti-HIV_cap256-048-031092_VR-Chain
  source 1..432: mol_type = other RNA
caggtgcagctggtcgagagcggcgggggcgtggtgcagcccgggcgctccctccggctgagctgcgccgcctccggcttcagcttctacaacttcgcgatggactgggtccgccaggccccggggaagggcctggagtgggtggccgtgatctccagcgacggcgggaacaagaactacgtcgactccgtgaagggccggttcaccatcagccgcgacaactccaagaacaccctctacctgcagatgaacagcctgcgggccgaggacacggccgtgtactactgcgcgaaggacctcgggggcaccaaggacgacgagtgggccaccgactactacgacatctccatcgcctaccccgtccaggacccccgcgccgtggcgggggccttcgacatctggggccagggcaccatggtgacggtcagctcc

SEQ ID NO: 9860 - RNA, 435 nt, synthetic construct
  misc_feature 1..435: note = derived and/or modified sequence opt1 from anti-HIV_cap256-048-030464_VR-Chain
  source 1..435: mol_type = other RNA
caggtgcagctggtcgagagcggcgggggcctcgtgaagcccgggggctccctgcgcctgagctgcgaggcctccgggttcagcttcaccaactactacatgtcctggatccggcaggccccgggcaagggcctcgagtgggtggcggtcatcagcttcaacgggcgcaacaagtactacgccgacttcgtgaagggccggttcaccatctcccgcgacaacagcaagaacacgctgtccctgcagatgaacagcctccgggtggaggacaccgccgtctactactgcgccaaggaggtgggggagaacaaggacgacgagtgggccgcgcccgactactacgacttctccatcgcctaccccgtgcaggacccccgcgccgtcgtgggcgggttcgacatctggggccagggcaccatggtgaccgtcagctcc

SEQ ID NO: 9861 - RNA, 432 nt, synthetic construct
  misc_feature 1..432: note = derived and/or modified sequence opt1 from anti-HIV_cap256-048-030289_VR-Chain
  source 1..432: mol_type = other RNA
caggtgcagctggtcgagagcggcgggggcgtggtgcagcccgggggctccctccgcctgagctgcgccgcctccgggttcaccttcagctcctacggcatgcactgggtccggcaggcgccgggcaaggggctggagtgggtggccttcatccgctacgacggcagcaacaagtactacgccgactccgtgaaggggcggttcaccatcagccgcgacaactccaagaacacggtctacctccagatgaacagcctgcgggtggaggacaccgccgtgtactactgcgccaaggacctgggcgcgaacaaggacgacgagtgggccaccgactactacgacctctccgtcgcctaccccgtgcccgacccccgcgccgtggtcggggcgttcgacgtgtggggccagggcaccatggtgacggtcagctcc

SEQ ID NO: 9862 - RNA, 432 nt, synthetic construct
  misc_feature 1..432: note = derived and/or modified sequence opt1 from anti-HIV_cap256-048-030261_VR-Chain
  source 1..432: mol_type = other RNA
caggtgcagctggtcgagagcggcgggggcgtggtgcagcccgggggctccctccgcctgagctgcgccgcctccgggttcaccttcagcaccttcggcatgcactgggtccggcaggcgccgggcaaggggctggagtgggtggccgtgatctcccacgacggcagcaacaagtactacgccgactccctcaaggggcgcttcacgatcagccgggagaactccaagaacaccctgtacctgcagatgaacagcctccgcctggaggacaccgccgtctaccactgcgccaaggacctgggcgggtccaagagcgacgagtgggcgaccgactactacgacctctccgtggcctaccccgtgcaggacccccgggccgtcgtgggcgtgttcgacatctggggccaggggacgatggtcaccgtgagctcc

SEQ ID NO: 9863 - RNA, 432 nt, synthetic construct
  misc_feature 1..432: note = derived and/or modified sequence opt1 from anti-HIV_cap256-048-029362_VR-Chain
  source 1..432: mol_type = other RNA
caggtgcagctggtcgagagcggcgggggcgtggtgcagcccgggcgctccctccggctgagctgcgccgcctcccagttcaccttcagctcctacggcatgcactgggtccgccaggcgccggggaagggcctggagtgggtggccggcatcagcttcgccgggaccaacaagtactacgccgactccgtgaagggccggttcacgatcagccgcgacaactccaagaacaccctctacctgcagatgaacagcctgcggaccgaggacgccgcgctctactactgcgccaaggacatgcgcgagttcgagtgcgaggagtgggcctccgactactacgacttcgggcgggactacccctgccaggacccccgcggcgtcgtggggatcttcgacatctggggccagggcaccatggtgacggtcagctcc

SEQ ID NO: 9864 - RNA, 432 nt, synthetic construct
  misc_feature 1..432: note = derived and/or modified sequence opt1 from anti-HIV_cap256-048-027638_VR-Chain
  source 1..432: mol_type = other RNA
caggtgcagctggtcgagagcggcgggggcgtggtgcagcccgggcgctccctccggctgagctgcgtcgcctccggcttcatcttcagctcctacgggatccactgggtgcgccaggccccgggcaagggcctggagtgggtggcggtcatcagcggggacggcaccaacaagtactgcgccgactccgtgaaggggcggttcaccatcagccgcgacaactccaagaacacggtgttcctccagatgaacagcctgcgggccgaggacaccgccgtcttctactgcgccaaggacctgggcgagtccgacaaggaggagtggcccagcgactactacgacttcgggcgcgacttcaccggccaggtgccccgggcggtggtcggcgccttcgacatctgggggcagggcaccatggtgacggtgtccagc

SEQ ID NO: 9865 - RNA, 432 nt, synthetic construct
  misc_feature 1..432: note = derived and/or modified sequence opt1 from anti-HIV_cap256-048-027613_VR-Chain
  source 1..432: mol_type = other RNA
gtgcagcagctggtcgagagcggcggggacgtggtgcagcccggcacctccctccgcctgagctgcgaggcctccgggctgatcctcagcggctacgggctgcactgggtccggcaggccccgggcaagggcatggagtgggtggcggtgatctcctacgacgggagcaacaagtactacgccgactccgtcaagggccgcttcaccatcagccgggacaactccaagaacacggtgtacctgcagatgaacagcctccgcggggtggacaccgccgtctactactgcgccaaggacctgggcgggggcgaggtggaggagtgggccaccgactactacgactggtccaccgcgtaccccgtggagcacccccgggccgtcgtgggcgtgttcgacatctgggggcagggcacgaaggtcaccgtgagctcc

SEQ ID NO: 9866 - RNA, 432 nt, synthetic construct
  misc_feature 1..432: note = derived and/or modified sequence opt1 from anti-HIV_cap256-048-026627_VR-Chain
  source 1..432: mol_type = other RNA
caggtgcagctgctcggcagcgggggcgggtccgtccagcccggcgggagcctgcgcctgacctgcgccgtgtccggcttcaccttcagctccttcgccatgagctgggtgcggcaggcgccgggcaaggggctcgagtgggtcgccttcatctccagcgacggcacgaacaagaactacggggactccgtgaagggccgcttcaccatcagccgggacaactccaagaacaccctgttcctgcagatgaacagcctccgcgccgaggacaccgccctgtactactgcgccaaggacctcgggggctacaagtccgacgagtgggcgacggactactacgacctgagcatcgcctaccccatccaggacccccgggccgtggtcggcgccttcgacatctgggggcagggcaccatggtgaccgtgtccagc

SEQ ID NO: 9867 - RNA, 432 nt, synthetic construct
  misc_feature 1..432: note = derived and/or modified sequence opt1 from anti-HIV_cap256-048-026239_VR-Chain
  source 1..432: mol_type = other RNA
cagatgcagctggtggagagcggcgggggcgtcgtgcagcccgggcgctccctccggctgagctgcgccgcctccggcttcaccttcaacagctacgcgatgcactgggtgcgccaggccccggggaagggcctggagtgggtcgccgtgatctcctacgacggcagcaacaagtactacgccgactccgtgaaggggcggttcaccatcagccgcgacaactccaagaacacgctctacctgcagatgaacagcctgcggaccgaggacgccgcgctctactactgcgccaaggacatgcgcgagttcgagtgcgaggagtgggcctccgactactacgacttcggccgggactacccctgccaggacccccgcggggtcgtgggcatcttcgacatctgggggcagggcaccatggtgaccgtcagctcc

SEQ ID NO: 9868 - RNA, 432 nt, synthetic construct
  misc_feature 1..432: note = derived and/or modified sequence opt1 from anti-HIV_cap256-048-025518_VR-Chain
  source 1..432: mol_type = other RNA
caggtgcagctggtcgagagcggcgggggcgtggtgcagcccgggcgctccctccggctgagctgcgccgtctccggcttcaccttcagccagcacgccatgcactgggtgcgccaggcgccggggaagggcctggagtgggtgaccctcatctccaacgacggcacggagaagttctacgccgacagcgtcaaggggcggttcaccatctcccgcgacaacagcaagaacaccctgtacctgcagatgaactccctcagcgtggaggacaccgccgtgtactactgcgccaaggacctgggcaagaacaaggacgacgagtgggccacggactactacgacatctccatcgcgtaccccgtccccgacccccgggccgtggtgggggtcttcgacatctggggccaggggaccgtggtgaccgtcagctcc

SEQ ID NO: 9869 - RNA, 432 nt, synthetic construct
  misc_feature 1..432: note = derived and/or modified sequence opt1 from anti-HIV_cap256-048-024854_VR-Chain
  source 1..432: mol_type = other RNA
caggtgcagctggtcgagagcggcgggggcgtggtgcagcccgggcgctccctgaccctgagctgcgccgcctccggcttcaccttcaacaactacgacatgcactgggtccggcaggcgccggggaagggcctggagtgggtggccttcacgcgctacgacggcagcaaccagtactacgccgactccgtgaccgggcggttcaccatcagccgcgacaactccaagaacaccgtctacctccagatgaacagcctgcggggcgtggacacggccgtgtactactgcgccaaggacctcgggggcggggaggtcgaggagtgggcgaccgactactacgactggtccatcgcctaccccgtggagcacccccgcgccgtggtcggcgtgttcgacatctggggccaggggaccaaggtgaccgtcagctcc

SEQ ID NO: 9870 - RNA, 432 nt, synthetic construct
  misc_feature 1..432: note = derived and/or modified sequence opt1 from anti-HIV_cap256-048-024537_VR-Chain
  source 1..432: mol_type = other RNA
caggtgcagctggtcgagagcggcggggccgtggtgcagcccggccgctccctccggctgagctgcgtcgcctccgggttcaccttcagctcctacgcgatgcactgggtgcgccaggccccgggcaaggggctggactgggtggccctcatcagctacgacggctccaacaagtacttcgccgacagcgtcaagggccggttcgccatctcccgcgacaacagcaagaacaccctgtacctgcagatgaactccctccggcccgaggacacggcggtgtactactgcgccaaggacctcgggggcggggagtgcgagacctgggccagcgactactacgacttcggcaaggactacccctgcctggacccccgcgacgtggtcgggaccttcgacatctgggtgcagggcaccctggtgacggtctccagc

SEQ ID NO: 9871 - RNA, 432 nt, synthetic construct
  misc_feature 1..432: note = derived and/or modified sequence opt1 from anti-HIV_cap256-048-021781_VR-Chain
  source 1..432: mol_type = other RNA
caggtgcacctggtcgagagcggcgggggcctcgtgaagcccgggggctccctgcgcctgagctgcgaggcctccgggttcagcttctccaactacgccatggactgggtgcggcaggcgccgggcaagggcctcgagtgggtcgccttcgtgagctccgacgggagcaacaagaactacgccgactccgtgaagggccgcttcaccatcagccgggacaactccaagaacaccgtctacctgcagatgaacagcctgcgcgtggaggacacggccgtgtactactgcgccaaggacctcggggcgaacaaggacgacgagtgggccaccgactactacgacctgtccgtcgcctaccccgtgcccgacccccgggccgtggtcggcgcgttcgacgtgtgggggcagggcaccatggtgaccgtcagctcc

SEQ ID NO: 9872 - RNA, 432 nt, synthetic construct
  misc_feature 1..432: note = derived and/or modified sequence opt1 from anti-HIV_cap256-048-021758_VR-Chain
  source 1..432: mol_type = other RNA
caggtgcagctggtcgagagcggcgggggcgtggtgcagcccgggcgctccctccggctgagctgcgccgcctccggcttcaccttcagccgctacgggatgcactgggtccggcaggcgccgggcaagggcctggagtgggtggccgtgatctcctacgacgggagcaaggagtactacgccgactccgtcaagggccgcttcaccatcagccgggacaactccaaggacacgctctacctgcagatgagctccctgcgcgtggaggacaccgccgtgtactactgcgccaaggacgtcggggcgaacaaggacgacgagtgggccaccgactactacgacctcagcatcgcctaccccgtgcccgacccccgggccgtggtcggcgcgttcgacatctgggggcagggcaccatggtgacggtgtccagc

SEQ ID NO: 9873 - RNA, 432 nt, synthetic construct
  misc_feature 1..432: note = derived and/or modified sequence opt1 from anti-HIV_cap256-048-020988_VR-Chain
  source 1..432: mol_type = other RNA
caggtgcagctggtcgagagcggcgggggcgtggtgcagcccgggcgctccctccggctgagctgcgaggcctccgccttcaccttcagctcctacggcatgcactgggtccgccaggcgccggggaagggcctggagtgggtgaccttcatcagctactccggcaacaacaagtactacgccgacagcgtgaaggggcggttcacggtctcccgcgacaacagcaagaacaccctctacctgcagatgaactccctgaccagcgaggacaccgccgtgtactactgcgccaaggacctcggcgggtccaagacggacgagtggggcaccgactactacgagttctggaacgcctaccccgtgcaggacccccgggtcgtggtgggggcgttcgacatctggggccacggcaccatggtcaccgtgagctcc

SEQ ID NO: 9874 - RNA, 435 nt, synthetic construct
  misc_feature 1..435: note = derived and/or modified sequence opt1 from anti-HIV_cap256-048-020663_VR-Chain
  source 1..435: mol_type = other RNA
caggtgcagctggtcgagagcggcgggggcgtggtgcagcccgggatgtccctccgcctgagctgcgccgcctccggcttcaccttcagcaacttcgggatgcactgggtccggcaggcgccgggcaagggcctggagtgggtggccgtgatctcccacgacgggaacaacaagtactaccccgacagcgtccagggccgcttcaccatctcccgggagaacagcaagaacacgctctacctgcagatgaactccctgaagcccgaggacaccgccgtgtacttctgcgccaaggacctcgggggcgagagcgaggtggaggagtgggcctccgactactacgacttcgggcgcgacatccccggcccggacccccggggcgtcgtggggaccctggacatctggggccacgggaccatggtgacggtcagctcc

SEQ ID NO: 9875 - RNA, 432 nt, synthetic construct
  misc_feature 1..432: note = derived and/or modified sequence opt1 from anti-HIV_cap256-048-020590_VR-Chain
  source 1..432: mol_type = other RNA
caggtgcagctggtcgagagcggcgggggcgtggtgcagcccgggggcgtcccgcgcctggcctgcgccgcgtccgggttcaccttcagctcctacgccatgcactgggtgcggcaggcccccggcaagggcctggagtgggtgaccgtcatcagctacgacgggtccaacaagtactacgccgacagcgtgaagggccgcttcacgatctcccgggacaacagcaagaacaccctgtacctccagatgaactccctgcgcgccgaggacaccgcggtgtactactgcgccaaggacctcgggggcaccaaggacgacgagtgggccacggactactacgacatcagcatcgcctaccccgtccaggacccccgggcggtggccggggccttcgacatctggggccagggcaccatggtgaccgtctccagc

SEQ ID NO: 9876 - RNA, 432 nt, synthetic construct
  misc_feature 1..432: note = derived and/or modified sequence opt1 from anti-HIV_cap256-048-019765_VR-Chain
  source 1..432: mol_type = other RNA
caggtgcagctggtcgagagcggcgggggcgtggtgcagcccgggcgctccctccggctgagctgcgccgcctccggcttcatcttcaccaactacgcgatggactgggtccgccaggccccggggaagggcctggagtgggtggccgtgatcagctccgacggcagcaacaagaactacgccgactccgtcaaggggcggttcaccatcagccgcgacaactccaagaacacggtgagcctccagatgaactccctgcgggccgaggacaccgcggtgtactactgcgccaaggacctgggcgacagcaagaaggacgagtgggccaccgactactacgacctctccatcgcctaccccgtccccgacccccgcgcggtggtgggggccttcgacatctggggccaggggaccatggtcacggtgagctcc

SEQ ID NO: 9877 - RNA, 432 nt, synthetic construct
  misc_feature 1..432: note = derived and/or modified sequence opt1 from anti-HIV_cap256-048-019254_VR-Chain
  source 1..432: mol_type = other RNA
caggtgcagctggtcgagagcggcgggggcgtggtgcagcccgggcgctccctccggctgagctgcgccgcctccggcttcaccagctccacctacgcgatgcactgggtccgccaggccccggggaagggcctggagtgggtggccctcatcagctacgacggcacggacaagtactacgccgactccgtgaaggggcggttcaccatcagccgcgacaactccaagaacaccctgtacctgcagatgaacagcctccgggtcgaggacaccgccgtgtaccactgcgcgaaggacctgggcgggaacaagcccgacgagtgggccacggactactacgacctgtccatcgcctaccccgtgcaggacccccgcgccgtcgtgggcgtgttcgacatctgggggcagggcaccatcatcaccgtcagctcc

SEQ ID NO: 9878 - RNA, 432 nt, synthetic construct
  misc_feature 1..432: note = derived and/or modified sequence opt1 from anti-HIV_cap256-048-018073_VR-Chain
  source 1..432: mol_type = other RNA
caggtgcagctggtcgagagcggcgggggcgtggtgcagcccgggcggtccctccggctgagctgcgccgcctccggcttcagcctgtccagctacgcgatggactgggtccgccaggccccggggaagggcctcgagtgggtggccgtgatctccagcgacggcaccaacaagtactacgccgactccgtcaaggggcggttcaccatcacgcgcgacaacagcaagaacaccctgtacctgcagatgaactccctccgggtggaggacaccgccctgtactactgcgcgaaggacatgggcgagagcgagaaggaggagtgggcctccgactactacgacttcgggcgcgacatccccggccaggacccccgcggggaggtgggcagcttcgacatctggggccaggggaccatggtcacggtgtccagc

SEQ ID NO: 9879 - RNA, 432 nt, synthetic construct
  misc_feature 1..432: note = derived and/or modified sequence opt1 from anti-HIV_cap256-048-016775_VR-Chain
  source 1..432: mol_type = other RNA
gaggtgcagctggtcgagttcggcgggggcctcgtgcagcccgggcggagcctgcggctgtcctgcgccgccagcgcgttcaccttctcccactacggcatccactgggtgcgccaggccccggggaagggcctcgagtgggtcgccgtgatcagccacgacggctccaccaaggactacgccgacagcgtgaaggggcggttcacgatctcccgcgacaacagcaagaacaccatgtacctgcagatgaactccctgcgggccgaggacaccgcggtctactactgcgcccgcgacctcggcgagagcgagaccgaggagtgggccacggactactacgacttctccatcgcctaccccgtgcagaacccccgcggggtgatcggcgtcctggacatctgggggctgggcaccatggtgaccgtgagctcc

SEQ ID NO: 9880 - RNA, 432 nt, synthetic construct
  misc_feature 1..432: note = derived and/or modified sequence opt1 from anti-HIV_cap256-048-016069_VR-Chain
  source 1..432: mol_type = other RNA
caggtgcagctggtcgagagcggcgggggcgtggtgcagcccgggcgctccctccggctgagctgcgccgcctccggcttcaccttcagcaagtacgcgatgcactgggtccgccaggccccggggaagggcctggagtgggtggccttcgtggccttcgacgagtccgccaagttctacgcggacagcgtcaagggccggttcaccatctcccgcgacaacagcaagaacacgctctccctgcagatgaacagcctgcgggccgaggacaccgccgtgtactactgcgccaaggaggtgggggagaacaaggacgacgagtgggcgtccgactactacgacctcagcatcgcctaccccgtccacgacccccgcgccgtggtgggcgggttcgacgtctggggccaggggaccatggtgaccgtgtccagc

SEQ ID NO: 9881 - RNA, 432 nt, synthetic construct
  misc_feature 1..432: note = derived and/or modified sequence opt1 from anti-HIV_cap256-048-015867_VR-Chain
  source 1..432: mol_type = other RNA
caggtgcagctggtcgagagcggcgggggcgtggtgcagcccgggcgctccctccggctgagctgctccgccagcggcttctccttcaccaactacgccatggactgggtccgccaggcgccggggaagggcctggagtgggtggccgtgatcagctccgacggcagcaacaagaactacgccgactccgtcaaggggcggttcaccatcagccgcgacaactccaagaacaccctcttcctgcagatgaacagcctgcggcccgaggacacggccgtgtacttctgcgccaaggacctcggcgcgaacaaggacgacgagtgggccaccgactactacgacctgtccatcgcctaccccgtgcacgacccccgcgccgtcgtggggatcttcgacctgtggggccaggggaccatggtgacggtcagctcc

SEQ ID NO: 9882 - RNA, 432 nt, synthetic construct
  misc_feature 1..432: note = derived and/or modified sequence opt1 from anti-HIV_cap256-048-015673_VR-Chain
  source 1..432: mol_type = other RNA
caggtgcacctggtcgagagcggcgggggcgtggtgcagcccgggcgctccctccggctgagctgcgccgcctccggcttcaccttcagcaacttcgcgatggggtgggtccgccaggccccgggcaagggcctggagtgggtggccttcatctccagcgacgggaccaacaagaactacggcgactccgtgaaggggcggttcacgatcagccgcgacaactccaagaacaccctcttcctgcagatgaacagcctgcgggccgaggacaccgccctctactactgcgcgaaggacctgggcgggtacaagtccgacgagtgggccaccgactactacgacctgagcatcgcctaccccatccaggacccccgcgccgtcgtgggcgcgttcgacatctggggccaggggacgatggtgaccgtctccagc

SEQ ID NO: 9883 - RNA, 432 nt, synthetic construct
  misc_feature 1..432: note = derived and/or modified sequence opt1 from anti-HIV_cap256-048-015156_VR-Chain
  source 1..432: mol_type = other RNA
caggtgcagctggtcgagagcggcgggggcgtggtgcagcccgggcgctccctccggctgagctgcgccgcctccggcttcaccttcagcgtctacgcgctgcactgggtgcgccagaccccggggaagggcctcgagtgggtggccctgatctcctacgacggcacgaacaagtactacgtcgacagcgtgaaggggcggttcaccatctcccgcgacaacagcaagaacaccctgtacctccagatgaactccctgaccgccgaggacacggccgtgtactactgcgccaaggacctgggcgggagcaagaacgacgagtgggcgaccgactactacgacctctccatcgcctaccccatccaggacccccgggccgtcgccggcatcttcgacgtgtgggggcgcggcaccatggtgaccgtcagctcc

SEQ ID NO: 9884 - RNA, 432 nt, synthetic construct
  misc_feature 1..432: note = derived and/or modified sequence opt1 from anti-HIV_cap256-048-014521_VR-Chain
  source 1..432: mol_type = other RNA
gaggtgcagctggtcgagagcggcgggggcctcgtgcagcccgggcgctccctgcggctgagctgcgccgcctccggcttcatcttcagctcctacgggatccactgggtgcgccagggcccgggcaaggggctcgagtgggtcgcgctgatcagcggcgacgggaacaacaagtactacgccgactccgtgcagggccggttcagcatctcccgcgacaacagcaagaacaccctgtacctccagatgaactccctgcgggccgaggacaccgccgtgtactactgcgccaaggacctgggggagagcgacaaggaggagtggccctccgactactacgacttcggccgcgacttcacgggccaggacccccgggcggtcgtgggggtgttcgacatctggggccaggggaccaccgtcatcgtgagctcc

SEQ ID NO: 9885 - RNA, 432 nt, synthetic construct
  misc_feature 1..432: note = derived and/or modified sequence opt1 from anti-HIV_cap256-048-014475_VR-Chain
  source 1..432: mol_type = other RNA
caggtgcagctggtcgagagcggcgggggcgtggtgcagcccgggcgctccctccggctgagctgcgccgcctccggcttcaccttcaacaccttcgggatgcactgggtccgccaggcgccgggcaagggcctggagtgggtggccgtgatcagccacgacgggaacaacaagtactacgccgactccctcaagggccggttcacgatcagccgcgagaactccaagaacaccctgttcctgcagatgaacagcctccgggccgaggacacctccgtctactactgcgccaaggacctggggcacggcgagtgcgaggagtgggcgagcgactactacgacttcgggaaggactacccctgcctgacgccccgcggcgtggccggcaccttcgacatctgggggcacggcaccaccgtgaccgtctccagc

SEQ ID NO: 9886 - RNA, 432 nt, synthetic construct
  misc_feature 1..432: note = derived and/or modified sequence opt1 from anti-HIV_cap256-048-013798_VR-Chain
  source 1..432: mol_type = other RNA
caggtgcagctggtcgagagcggcgggggcgtggtgcagcccgggcgctccctccggctgagctgcgccgcctccggcttcaccttcaacaactacgggacccactgggtccgccaggcgccgggcaagggcctggagtgggtggccgtgatcagcgactccgggagcaacaagtactacgccgactccgtcaagggccggttcacgatcagccgcgacaactccaagaacaccctctacctgcagatgaacagcctgcgggccgaggacaccgccgtgtacttctgcgcgaaggacctcgggggccgcgagaccgaggagtgggcctccgactactacgacttcgggcgggacttccccggccaggaccagcgcgccgtggccggcgtcttcgacatgtgggggcagggcacgatggtgaccgtgagctcc

SEQ ID NO: 9887 - RNA, 432 nt, synthetic construct
  misc_feature 1..432: note = derived and/or modified sequence opt1 from anti-HIV_cap256-048-013271_VR-Chain
  source 1..432: mol_type = other RNA
gaggtgcagctggtcgagagcggcgggggcgtggtgcgccccgggggctccctccggctgagctgcgccgcctccgggttcatcttcagctcctacggcatccactgggtccgccaggcgccgggcaaggggctggagtgggtggccgtgatcagcggcgacgggaccaacaagtactgcgccgactccgtcaagggccggttcaccatcagccgcgacaactccaagaacacgctctacctgcagatcaacagcctgcgggtggaggacaccgccgtgtactactgcgccaaggacctcgggaagaacaaggacgacgagtgggcgaccgactactacgacctgtccatcgcctaccccgtccccgacccccgcgccgtggtgggcgtcttcgacatctggggccaggggaccgtggtgacggtcagctcc

SEQ ID NO: 9888 - RNA, 432 nt, synthetic construct
  misc_feature 1..432: note = derived and/or modified sequence opt1 from anti-HIV_cap256-048-013180_VR-Chain
  source 1..432: mol_type = other RNA
caggtgcagctggtcgagagcggcgggggcgtggtgcagcccgggcgctccctccggctgagctgcgccgcctccggcttcaccttcagcaagaacgggatgcactgggtccgccaggcgccgggcaagggcctggagtgggtggccttcgtggccttcgacgggtccgacaagtactacgccgacagcgtcaagggccggttcgtgatctcccgcgacaacagcaagaacaccctctccctgcagatgaacagcctgcgggccgaggacacggcggtgtactactgcgccaaggaggtcggggaggacaaggacgacgagtgggcctccgactactacgacctcagcatcgcctaccccgtgcacgacccccgcgcggtggtcggcgggttcgacatctggggccagggcaccatggtgaccgtgtccagc

SEQ ID NO: 9889 - RNA, 432 nt, synthetic construct
  misc_feature 1..432: note = derived and/or modified sequence opt1 from anti-HIV_cap256-048-012148_VR-Chain
  source 1..432: mol_type = other RNA
caggtgcagctggtcgagagcggcgggggcgtggtgcagcccgggcgctccctccggctgagctgcgccgcctccggcttcaccttcacccactacgcgatggactgggtccgccaggccccggggaagggcctggagtgggtggccgtgatcagctccgacggcagctccaagaactacgccgacagcgtccgggggcgcttcacgatctcccgggacaacagcaagaacaccctctccctgctgatgaacggcctccgccccgaggacaccgccgtgtactactgcgcgaaggacgtgggggacgtcaagaacgacgagtgggccaccgactactacgacctgagcatcgcctaccccgtgcaggacccccgggccgtggtcggcgcgttcgacttctgggggcagggcacgatggtgaccgtgtccgcc

SEQ ID NO: 9890 - RNA, 432 nt, synthetic construct
  misc_feature 1..432: note = derived and/or modified sequence opt1 from anti-HIV_cap256-048-011870_VR-Chain
  source 1..432: mol_type = other RNA
caggtgcagctggtcgagagcggcgggggcgtggtgcagcccgggcgctccctccggctgagctgcgccgtctccggcttcaccttcagcttctacgggatgcactgggtgcgccaggccccgggcaagggcctggagtgggtggcggtcatctcctacgacgggaacaacaagtactacgtggacagcgtgaagggccggttcatcatctcccgcgacaacagcaagaacaccctctacctgcagatgaactccctgcgggtcgaggacacggccgtgtactactgcgcccgcgacctcggggagcgggagaacgaggagtgggccaccgactactacgacttcagcatcgcctaccccatcgagggcccccgcggggtggtcggcgtgttcgacatctggggccgggggaccatggtgaccgtctccagc

SEQ ID NO: 9891 - RNA, 432 nt, synthetic construct
  misc_feature 1..432: note = derived and/or modified sequence opt1 from anti-HIV_cap256-048-011530_VR-Chain
  source 1..432: mol_type = other RNA
caggtgcacctggtcgagagcggcgggggcgtggtgcagcccgggcgctccctccggctgagctgcgccgcctccggcttcagcttccgcaactacgcgatggactgggtccggcaggccccggggaagggcctggagtgggtggccgtgatctccagcgacggctccgacaagcactacgccgacagcgtccgcgggcggttcaccatctcccgcgacaacagcaagaacaccctctacctgcagatgaactccctgcgggtggaggacacggccgtgtactactgcgcgaaggacctcggcgccaacaagaacgacgagtgggccaccgactactacgacttcagcatcgcctaccccgtccccgacccccgcgcggtggtgggggccttcgacatctggggccaggggaccatggtcaccgtgtccagc

SEQ ID NO: 9892 - RNA, 432 nt, synthetic construct
  misc_feature 1..432: note = derived and/or modified sequence opt1 from anti-HIV_cap256-048-010968_VR-Chain
  source 1..432: mol_type = other RNA
caggtgcagctggtcgagagcggcgggggcgtggtgcagcccgggcgctccctccggctgagctgcgccgcctccggcttcatcttcagctcctacgggatgcactgggtccgccaggcgccgggcaagggcctggagtgggtggccctcatcagcggggacggctccaacaagtactacgccgacagcgtgaaggggcggttcaccatctcccgcgacaacagcaagaacaccctgtacctgcagatgaactccctccgggccgaggacagcgccctgtacttctgcgcgaaggacctgggcgagtccgacaaggaggagtggcccagcgactactacgacttcgggcgcgacttcacgggccaggtcccccgggccgtggtgggcatcttcgacatgtgggggcagggcaccatggtcaccgtgtccagc

SEQ ID NO: 9893 - RNA, 426 nt, synthetic construct
  misc_feature 1..426: note = derived and/or modified sequence opt1 from anti-HIV_cap256-048-010224_VR-Chain
  source 1..426: mol_type = other RNA
gaggtgcacctggtcgagagcggcggggacctcgtgcagcccggcgggtccctgcgcctgagctgcgtggtctccgagttcaccttcagctcctacggcatgcactgggtgcggcaggccccggggaagggcctcgagtgggtggccttcatccgctacgacggcagcaacaagtactacgcggactccgtcaaggggcggttcaccatcagccgcgacaactccaaggtgtacctggagatgaacagcctgcgggccgaggacacggccgtgtactactgcgccaaggaggtcggcgagaacaaggacgacgagtgggcctccgactactacgacctcagcatcgcgtaccccatccacgacccccgcgccgtggtcgggggcttcgacatctgggggcagggcaccatggtgaccgtgtccagc

SEQ ID NO: 9894 - RNA, 432 nt, synthetic construct
  misc_feature 1..432: note = derived and/or modified sequence opt1 from anti-HIV_cap256-048-009749_VR-Chain
  source 1..432: mol_type = other RNA
caggtgcagctggtcgagagcggcgggggcgtggtgcagcccgggcgctccctccggctgagctgcggcgcctccgggttcaccttcagctcctacgccatgcactgggtccgccaggcgccgggccggggcctggagtgggtggccttcaccagctccgacgggagcaacaagaactacggcgactccgtgaaggggcgcttcacgatcagccgggacaactccaagaacaccctcttcctgcagatgaacagcctgcgcgccgaggacaccgccctctactactgcgccaaggacgtcggcgagtacaagtccgacgagtgggcgaccgactactacgacctgagcatcgcctaccccatccaggacccccgggccatggtgggggccttcgacatctggggccagggcacgatggtgaccgtctccagc

SEQ ID NO: 9895 - RNA, 432 nt, synthetic construct
  misc_feature 1..432: note = derived and/or modified sequence opt1 from anti-HIV_cap256-048-009623_VR-Chain
  source 1..432: mol_type = other RNA
caggtgcagctggtcgagagcggcgggggcgtggtgcagcccgggcgctccctccggctgagctgcgccgcctccggcttcagcttctccaagtacgggatgcactgggtccgccaggcgccgggcaagggcctggagtgggtggccttcgtggccttcgacgagggggacaagtactacgtcgacagcgtgaagggccggttcaccatctcccgcgacaacagcaagaacaccctctccctgcagatgaacagcctgcgggccgaggacacggccgtgtactactgcgcgaaggaggtcggggagaacaaggacgacgagtgggcctccgactactacgacctcagcatcgcctaccccatccacgacccccgcgccgtggtgggcgggttcgacatctggggccagggcaccatggtcaccgtgtccagc

SEQ ID NO: 9896 - RNA, 432 nt, synthetic construct
  misc_feature 1..432: note = derived and/or modified sequence opt1 from anti-HIV_cap256-048-008234_VR-Chain
  source 1..432: mol_type = other RNA
caggtgcagctggtcgagagcggcgggggcgtggtgcagcccgggcgctccctccggctgagctgcgccgcctccggcttcaccttcaccaactacgcgatggactgggtccgccaggccccggggaagggcctggagtgggtggccgtgatcagctccgacggcagcaacaagaactacgccgactccgtcaaggggcggttcacgatcagccgcgacaactccaagaacaccgtgtacctccagatgagctccctgcggcccgaggacaccgccgtgtactactgcgcgaaggacgtcggcgacaccaagagcgacgagtgggccacggactactacgacctgtccatcgcctaccccgtgcaggacccccgcgccgtggtcggggcgttcgacatctggggccaggggaccatggtgaccgtgagctcc

SEQ ID NO: 9897 - RNA, 432 nt, synthetic construct
  misc_feature 1..432: note = derived and/or modified sequence opt1 from anti-HIV_cap256-048-008149_VR-Chain
  source 1..432: mol_type = other RNA
caggtgcagctggtcgagagcggcgggggcgtggtgcagcccgggcgctccctccggctgagctgcgccgcctccggcttcaccttcagcgtctacaccatgcactgggtgcgccaggcgccggggaagggcctggagtgggtggccgtcatctcctacgacggccggaacaagtactacgccgacagcgtgaaggggcgcttcacgatctcccgggacaacagcaagaacaccgtgtacctccagatgaactccctgcgcgtcgaggacaccgccgtgtactactgcgccaaggacctgggcgcgaacaaggacgacgagtgggccaccgactactacgacctcagcgtggcctaccccgtccccgacccccgggccgtggtgggggcgttcgacgtctggggccaggggacgatggtgaccgtgtccagc

SEQ ID NO: 9898 - RNA, 432 nt, synthetic construct
  misc_feature 1..432: note = derived and/or modified sequence opt1 from anti-HIV_cap256-048-007301_VR-Chain
  source 1..432: mol_type = other RNA
caggtgcagctggtcgagagcggcgggggcgtggtgcagcccgggcgctccctccggctgagctgcgccgcctccggcttcagcttcaactactacgcgatggactgggtccgccaggccccggggaagggcctggagtgggtggccgtgatctccagcgacggccggaacaagaactacgccgactccgtcaaggggcgcttcaccatcagccgggacaactccaagaacaccctctacctgcagatgaacagcctgtccgtggaggacacggccgtgtactactgcgcgaaggacctcggcaagaacaaggacgacgagtgggccaccgactactacgacatcagcatcgcctaccccgtccccgacccccgcgccgtggtgggggtcttcgacatctggggccaggggaccgtggtgaccgtctccagc

SEQ ID NO: 9899 - RNA, 432 nt, synthetic construct
  misc_feature 1..432: note = derived and/or modified sequence opt1 from anti-HIV_cap256-048-007174_VR-Chain
  source 1..432: mol_type = other RNA
caggtgcagctggtcgagagcggcgggggcgtggtgcagcccgggcgctccctccggctgagctgcgccgcctccggcttcaccttcaacagctacgggatggcctgggtccgccaggccccgggcaagggcctggagtgggtggccctcatctcctacgacgggagcaacaagtactacgccgactccgtgcggggccgcttcaccatcagccgggacaactccaaggacacgctgtacctgcagatggacgggctccgccccgaggacaccgccctgtactactgcgcgaaggacctgggcgagagcgagtgcgaggagtgggcctccgactactacgacttcgggcgggactacccctgcctcgcgccccgcggcgtcccgggcaccttcgacatctgggggcagggcaccatggtgacggtgagctcc

SEQ ID NO: 9900 - RNA, 432 nt, synthetic construct
  misc_feature 1..432: note = derived and/or modified sequence opt1 from anti-HIV_cap256-048-007079_VR-Chain
  source 1..432: mol_type = other RNA
caggtgcagctggccgagagcggcgggggcgtcgtgcagcccgggcgctccctccggctgagctgcgccgcgtccggcttcaccttcagcatctacgggatgcactgggtgcgccaggccccgggcaagggcctggagtgggtcgccttcatcctctccgacgggaccgacaagtacagcgccgactccgtgaagggccggttcacgatcagccgcgacaactccaagaacaccctgtacctgcagatgaacagcctccgggccgaggacaccgcggtgtactactgcgccaaggacctggggaaggccaaggacgacgagtgggccaccgactactacgacttctccatcgcgtaccccgtccacgacccccgcggcgtggccgggatcttcgacatctggggccagggcacgatggtgaccgtcagctcc

SEQ ID NO: 9901 - RNA, 432 nt, synthetic construct
  misc_feature 1..432: note = derived and/or modified sequence opt1 from anti-HIV_cap256-048-007033_VR-Chain
  source 1..432: mol_type = other RNA
caggtgcagctggtcgagagcggcgggggcgtggtgcagcccgggcgctccctccggctgagctgcgccgcctccggcttcaccttcagcaacttcgggttccactgggtccgccaggcgccgggcaagggcctggagtgggtggccgccatctccttcgccgggaacaacaagtactacgccgacagcgtgaagggccggttcaccatctcccgcgagaacagcaagaacatcctctacctgcagatgaactccctgcgcggggaggacacggcggtctactactgcgccaaggacctccgggagttcgagtgcgaggagtgggccagcgactactacgacttcggccgggactacccctgccaggacccccgcggggtggtgggcaccttcgacgtctggggccacgggtccctggtgaccgtgagctcc

SEQ ID NO: 9902 - RNA, 432 nt, synthetic construct
  misc_feature 1..432: note = derived and/or modified sequence opt1 from anti-HIV_cap256-048-006128_VR-Chain
  source 1..432: mol_type = other RNA
caggtgcagctggtcgagagcggcgggggcgtggtgcagcccgggcgctccctccggctgagctgcgccgcctccggcttcaccttcagcacctacgcgatgcactgggtccgccaggccccggggaagggcctggagtgggtggccctcatctcctacgacggcacggacaagtactacgccgacagcgtgaaggggcggttcaccatctcccgcgacaacagcaagaacaccctgtacctgcagatgaactccctccgggtcgaggacaccgccgtgtaccactgcgcgaaggacctgggcgggagcaagtccgacgagtgggccacggactactacgactggagcatcgcctaccccgtgcacgacccccgcgccgtcgtgggcgtgttcgacatctgggggcagggcaccctggtcaccgtgtccagc

SEQ ID NO: 9903 - RNA, 432 nt, synthetic construct
  misc_feature 1..432: note = derived and/or modified sequence opt1 from anti-HIV_cap256-048-005999_VR-Chain
  source 1..432: mol_type = other RNA
caggtgcagctggtcgagagcggcgggggcgtggtgcagcccgggcgctccctccggctgagctgcgccgcctccggcttcaccttcacccacttcgcgatggactgggtccgccaggccccggggaagggcctggagtgggtggccgtgatcagctccgacggcagctccaagaactacgccgacagcgtcaaggggcggttcacgatctcccgcgacaacagcaagaacaccgtgtccctccagatgaacagcctgcggcccgaggacaccgccgtgtactactgcgcgaaggacctgggcgccaacaaggacgacgagtgggccaccgactactacgacctctccatcgcctaccccgtccccgacccgcgcgcggtggtgggggccttcgacatctggggccaggggacgatggtcaccgtgagctcc

SEQ ID NO: 9904 - RNA, 432 nt, synthetic construct
  misc_feature 1..432: note = derived and/or modified sequence opt1 from anti-HIV_cap256-048-005394_VR-Chain
  source 1..432: mol_type = other RNA
caggtgcagctggtcgagagcggcgggggcgtggtgcagcccgggcgctccctccggctgagctgcgccgcctcccagttcaccttcagctcctacggcatgcactgggtccgccaggcgccggggaagggcctggagtgggtggccgccatcagcttcgccggcaccaacaagtactacgccgactccgtgaaggggcggttcacgatcagccgcgacaactccaagaacgcgctctacctgcagatgaacagcctgcgggccgaggacaccgccctctactactgcgccaaggacctgcgcgagttcgagtgcgaggagtgggcgtccgactactacgacttcggccgggactacccctgccaggacccccgcggggtcgtgggcaccttcgacatctgggggcagggcaccatggtgacggtcagctcc

SEQ ID NO: 9905 - RNA, 432 nt, synthetic construct
  misc_feature 1..432: note = derived and/or modified sequence opt1 from anti-HIV_cap256-048-004226_VR-Chain
  source 1..432: mol_type = other RNA
caggtgcagctggtcgagagcggcgggggcgtggtgcagcccgggcgctccctccggctgagctgcgccgcctccggcttcaccttcaacaagcacgggatgcactgggtccgccaggcgccgggcaagggcctggagtgggtggccttcgtggccttcgacgggagcgacaagtactacgccgactccgtcaagggccggttcaccatcagccgcgacaactccaagaacacgctcagcctgcagatgaacaacctgcgggccgaggacaccgcggtgtactactgcgccaaggaggtgggggacaacaaggacgacgagtgggcctccgactactacgacctcagcatcgcctaccccgtccaggacccccgcgcggtggtgggcgggtacgacatctggggccagggcaccatggtcaccgtgtccagc

SEQ ID NO: 9906 - RNA, 432 nt, synthetic construct
  misc_feature 1..432: note = derived and/or modified sequence opt1 from anti-HIV_cap256-048-004097_VR-Chain
  source 1..432: mol_type = other RNA
caggtgcagctggtcgagagcggcgggggcgtggtgcagcccgggcgctccctccggctgagctgcgccgcctccggcttcaccttcagcgcgtacaccgtccactgggtgcgccaggccccggggcggggcctggagtgggtgtccgtcatcagctacgacgaccgcaacaagtactacgcccactccgtgaagggccggttcacgatcagccgcgacaactccaagaacaccctctacctgcagatgaacagcctgcggcgcgaggacaccgccgtgtactactgcgccaaggacctcggggcgaacaaggacgacgagtgggccaccgactactacgacctgtccatcgcctaccccgtccccgacccccgggccgtggtgggcgcgttcgacatctgggggcagggcacgatggtcaccgtgagctcc

SEQ ID NO: 9907 - RNA, 432 nt, synthetic construct
  misc_feature 1..432: note = derived and/or modified sequence opt1 from anti-HIV_cap256-048-003289_VR-Chain
  source 1..432: mol_type = other RNA
caggtgcagctggtcgagagcggcgggggcgtggtgcagcccgggcgctccctccggctgagctgcgccgcctccggcttcaccttcagcaagtacgggatgcactgggtccgccaggcgccgggcaagggcctggagtgggtggccttcgtggccttcgacgggtccagcaagaactacgccgactccgtcaagggccggttcaccatcagccgcgacaactccaagaacacggtgagcctccagatgaactccctgcggcccgaggacaccgccgtgtactactgcgcgaaggacctgggggccaacaaggacgacgagtgggccaccgactactacgacctcagcatcgcctaccccgtccccgacccgcgcgcggtggtgggcgccttcgacatctgggggcagggcaccatggtcacggtgtccagc

SEQ ID NO: 9908 - RNA, 432 nt, synthetic construct
  misc_feature 1..432: note = derived and/or modified sequence opt1 from anti-HIV_cap256-048-002601_VR-Chain
  source 1..432: mol_type = other RNA
caggtgcagctggtcgagagcggcgggggcgtggtgcagcccgggcgctccctccggctgagctgcgccgcctccggcttcagcttcaacaactacgcgatggactgggtccgccaggccccggggaagggcctggagtgggtggccgtgatctccagcgacggccggaacaagaactacgccgagtccgtcaaggggcgcttcaccatcagccgggacaactccaagaacaccgtgtacctccagatgaacagcctgcgcgccgaggacacggcggtgtactactgcgccaaggacgtcggcgacaccaagaaggacgagtgggccaccgactactacgacctgtccatcgcctaccccgtgcaggacccccaggcggtggtcggggccttcgacatctggggccaggggaccatggtgacggtgagctcc

SEQ ID NO: 9909 - RNA, 432 nt, synthetic construct
  misc_feature 1..432: note = derived and/or modified sequence opt1 from anti-HIV_cap256-048-002129_VR-Chain
  source 1..432: mol_type = other RNA
caggtgcagctggtcgagagcggcgggggcgtggtgcagcccgggcgctccctccggctgagctgcgccgcctccggcttcaccttcagcacctacgcgatgcactgggtccgccaggccccggggaagggcctggagtgggtggccctcatctcctacgacggcacggacaagtactacgccgacagcgtgaaggggcggttcatcatctcccgcgacaacagccggtccaccctgtacctgcagatgaacagcctccgcctggaggacaccgccgtctaccactgcgcgaaggacctgggcgggtccaagagcgacgagtgggccaccgactactacgacctctccgtggcctaccccgtgcaggacccccgggccgtcgtgggcgtgttcgacatctgggggcagggcacgatggtcaccgtgagctcc

SEQ ID NO: 9910 - RNA, 432 nt, synthetic construct
  misc_feature 1..432: note = derived and/or modified sequence opt1 from anti-HIV_cap256-048-001875_VR-Chain
  source 1..432: mol_type = other RNA
caggtgcagctggtcgagagcggcgggggcgtggtgcagcccgggggctccctccggctgagctgcgccacctccgggctgaccttcagcaactacggcatgcactgggtccggcaggccccgggccgcgggctcgagtgggtggcgttcacgcggtacgacggcacctacaactactacgccgactccgtgaaggggcgcttcaccatcagccgggacaactccaagggcaccctgtacctgcagatggacgggctccgccccgaggacacggccctgtactactgcgccaaggacctgggcgagcgggagtgcgaggagtgggccagcgactactacgacttcggccgcgacttcccctgccaggacccccgcggggtcgtgggcaccttcgacatctgggggcagggcaccatggtgaccgtctccagc

SEQ ID NO: 9911 - RNA, 432 nt, synthetic construct
  misc_feature 1..432: note = derived and/or modified sequence opt1 from anti-HIV_cap256-048-001302_VR-Chain
  source 1..432: mol_type = other RNA
caggtgcagctggtcgagagcggcgggggcgtggtgcagcccgggcgctccctccggctgagctgcgccgcctccggcttcaccttcagctactccgggatgcactgggtccgccaggcgccgggcaagggcatggagtgggtggccgtgatcagctacgacgggtccaacaagtactacgccgacagcgtcaagggccggttcaccatctcccgcgacaacagcaagaacacggtgtacctgcagatgaactccctccgcggggtggacaccgccgtctactactgcgccaaggacctgggcgggggcgaggtggaggagtgggcgaccgactactacgactggagcatcgcctaccccgtggagcacccccgggccgtcgtgggcgtgttcgacatctgggggcagggcaccaaggtcacggtgtccagc

SEQ ID NO: 9912 - RNA, 432 nt, synthetic construct
  misc_feature 1..432: note = derived and/or modified sequence opt1 from anti-HIV_cap256-048-001203_VR-Chain
  source 1..432: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccatcatcagctacgacggcaccatcaagtactacgccgactccgtgaaggggcggttcacgatcagccgcgacaactccaagaacaccgtcagcctccagatgaactccctgcggcccgaggacaccgccgtgtactactgcgcgaaggacgtgggcgccaacaaggacgacgagtgggccaccgactactacgacctgagcatcgcctaccccgtccccgacccgcgcgcggtggtgggggccttcgacatctggggccaggggacgatggtcaccgtgtccagc

SEQ ID NO: 9913 - RNA, 432 nt, synthetic construct
  misc_feature 1..432: note = derived and/or modified sequence opt1 from anti-HIV_cap256-048-000383_VR-Chain
  source 1..432: mol_type = other RNA
caggtgcagctggtcgagagcggcgggggcgtggtgcagcccgggcgctccctccggctgagctgcaccgcctccggcttcaccttcaaccactacgccatggactgggtccgccaggcgccggggaagggcctggagtgggtggccgtgatcagctccgacggcagcgacaagacgtacgccgactccgtcaaggggcggttcaccatcagccgcgacaactccaagaacaccgtgtacctccagatgaacagcctgcgggccgaggacaccgccgtgtactactgcgcgaaggacgtcggcgggtccaaggacgacgagtgggccacggactactacgacctgagcatcgcctaccccgtgcccgacccccgcgccgtggtcggcgcgttcgacttctgggggccgggcaccatggtgaccgtgtccagc

SEQ ID NO: 9914 - RNA, 432 nt, synthetic construct
  misc_feature 1..432: note = derived and/or modified sequence opt1 from anti-HIV_cap256-038-261791_VR-Chain
  source 1..432: mol_type = other RNA
caggtgcagctggtcgagttcggcgggggcgtggtgcagcccgggggcagcctccgcctgtcctgcgccgccttcgggttcaccatcagctcctacggcatgcactgggtccggcaggcgccgggcaaggggctgcagtgggtggccttcatccgctacgacgagagctccaagttctacgccgacagcgtgaagggccggttcaccatctcccgcgacaacagcgagaacacgctctacctgcagatgaactccctgcgggccgaggacaccgccgtctactactgcgcgaaggacctcggggagagcgagaacgaggagtgggccaccgactactacgacttctccatcgcctaccccggccaggacccccgcggggtggtgggcatcttcgacatctggggccaggggaccatggtcacggtgagctcc

SEQ ID NO: 9915 - RNA, 432 nt, synthetic construct
  misc_feature 1..432: note = derived and/or modified sequence opt1 from anti-HIV_cap256-038-241540_VR-Chain
  source 1..432: mol_type = other RNA
caggtgcagctggtcgagagcggcgggggcgtggtgcagcccgggcgctccctccggctgagctgcgccgcctccggcttcaccttcagcaactccgcgatgcactgggtccgccaggccccggggaagggcctggagtgggtggccctcatcagctacgtgggcgggaacatctactacgccgactccgtcaagggccggttcaccgtgagccgcgacaactccaagaagacgctgtacctgcagatgaacagcctccgggtggaggacaccgccgtctactactgcgtgaaggacgtgggggagtccgagaacgaggagtgggcgagcgactactacgacttcggccgcgactaccccgggcaggacacccgggccgtcgtgggcgccttcgacatctggggccaggggaccatggtgacggtctccagc

SEQ ID NO: 9916 - RNA, 432 nt, synthetic construct
  misc_feature 1..432: note = derived and/or modified sequence opt1 from anti-HIV_cap256-038-235677_VR-Chain
  source 1..432: mol_type = other RNA
ctggtgcagctcgtcgagagcggcgggggcgtggtgcagcccgggggctccctgcgcctgagctgcgccgcctccgggttccggttcagctcctacggcatgcactgggtccgccaggcgccgggcaaggggctcgagtgggtggccttcatccggtacgacggcagcttcaaggactacgccgactccgtgcgcgggcggttcaccatcagccgcgagaactccaagaacaccctgtacctgcagatgaacagcctccggacggacgacaccgccgtctactactgcgccaaggacctgggcgagtccgagaccgaggagtggcccagcgactactacgacttcgggcgcgactaccccggccaggacccccggggcgtggtggggaccttcgacatctggggccacgggacgatggtcaccgtgtccagc

SEQ ID NO: 9917 - RNA, 435 nt, synthetic construct
  misc_feature 1..435: note = derived and/or modified sequence opt1 from anti-HIV_cap256-038-234314_VR-Chain
  source 1..435: mol_type = other RNA
gaggtgcagctgctcgagagcggcgggggcctggtccagcccgggggctccctgcgcctcagctgcgccgcctccgggttcaccttcagccggtacgcgatgtcctgggtgcgccaggccccgggcaagggcctggagtgggtggccgtcatcagctacgacgggtccaacaagtactacgccgacagcgtgaagggccggttcaccatctcccgcgacaacagcaagaacacgctgtacctccagatgaactccctgcgggccgtggacaccgcggtctactactgcgccaaggacctgggggagggcgagaacgaggagtgggccaccgactactacgacttcagctactggctcccctgccccaagtaccacggggcctggctggagctgctctacatctggggccagggcaccatggtgacggtgtccagc

SEQ ID NO: 9918 - RNA, 432 nt, synthetic construct
  misc_feature 1..432: note = derived and/or modified sequence opt1 from anti-HIV_cap256-038-234273_VR-Chain
  source 1..432: mol_type = other RNA
gaggtgcagctggtcgagagcggcgggggcctcatccagcccgggggctccctgcgcctgagctgcgccgcctccgggttcaccgtgagcaccaacttcatgtcctgggtgcggcaggcgccgggcaagggcctcgagtgggtcgccgtgatcagctacgacgggaacaacaagtactacgccgactccgtgaagggccgcttcacgatcagccgggagaactccaagaacaccctgtacctgcagatgaacagcctccgcaccgacgacaccgccgtctactactgcgccaaggacctgggggagtccgagacggaggagtggcccagcgactactacgacttcggccgggactaccccgggcaggacccccgcggcgtggtgggcaccttcgacatctgggggcacggcaccatggtcaccgtgtccagc

SEQ ID NO: 9919 - RNA, 432 nt, synthetic construct
  misc_feature 1..432: note = derived and/or modified sequence opt1 from anti-HIV_cap256-038-223164_VR-Chain
  source 1..432: mol_type = other RNA
gaggtgcagctggtcgagagcggcgggggcctcgtgcgccccgggggctccctgcggctgagctgcgccgcctccgggttcagcctcggctcctactggatgacctgggtgcgccaggcgccgggcaaggggctggagtgggtcgccgtgatcagctacgacggctccaacaagtactacgccgacagcgtgaaggggcggttcaccatctcccgcgacaacagcaagaacacgctgtacctccagatgaactccctgcgggccgaggacaccgccctgtactactgcgcgaaggacctcggcgagagcgagaacgaggagtgggcctccgactactacgacttcgggcgcgactaccccggccaggacccccggggcgtcgtggggaccttcgacatctggggccaggggaccatggtgacggtcagctcc

SEQ ID NO: 9920 - RNA, 432 nt, synthetic construct
  misc_feature 1..432: note = derived and/or modified sequence opt1 from anti-HIV_cap256-038-220289_VR-Chain
  source 1..432: mol_type = other RNA
gaggtgcagctggtcgagagcggcgggggcctcgtgcagcccgggggctccctgcgcctgagctgcaccgcctccgggttcaccttcagctcctacgagatgaactgggtgcggcaggccccgggcaagggccccgagtgggtcgcggtgatcagctacgacgggaacaacaagtactacgccgactccgtgaagggccgcttcacgatcagccgggagaactccaagaacaccctctacctgcagatgaacagcctgcgcaccgacgacaccgccgtctactactgcgccaaggacctcggggagtccgagacggaggagtggcccagcgactactacgacttcggccgggactaccccgggcaggacccgcgcggcgtggtgggcaccttcgacatctgggggcacggcaccatggtcaccgtgtccagc

SEQ ID NO: 9921 - RNA, 432 nt, synthetic construct
  misc_feature 1..432: note = derived and/or modified sequence opt1 from anti-HIV_cap256-038-220020_VR-Chain
  source 1..432: mol_type = other RNA
caggtgcagctggtcgagagcggcgggggcgtggtgcagcccgggcggtccctccggctgagctgcgccgcctccggcttcaccttcagccgcaacgcgatgcactgggtccggcaggccccggggaagggcctggagtgggtggccctcatctcctacgacggcagcaacaagtactacgtggactccgtcaaggggcgcttcaccatcagccgggacaactccaagaacacgctgtacctgcagatgaacagcctccgcgccgacgacaccgccgtgtactactgcgcgaaggacctgggcgagtccgagaccgaggagtgggggaccgactactacgacttcagcacgggctaccccgtgcaggacccccgcggggtcgtgggcgccttcgacatctggggccaggggaccatggtgtccgtcagctcc

SEQ ID NO: 9922 - RNA, 432 nt, synthetic construct
  misc_feature 1..432: note = derived and/or modified sequence opt1 from anti-HIV_cap256-038-216853_VR-Chain
  source 1..432: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccgtgatcagctacgacggctccaacaagtactacgccgacagcgtcaaggggcggttcaccatctcccgcgacaacagcaagaacacgctctacgtgcagatgaactccctgcgggccgaggacaccgcggtgtactactgcgcccgcgacctgggcgagagcgagaccgaggagtggccctccgactactacgacttcgggcgggactaccccggccaggacccccgcggggtcgtgggcaccttcgacatctggggccacgggacgatggtgaccgtcagctcc

SEQ ID NO: 9923 - RNA, 432 nt, synthetic construct
  misc_feature 1..432: note = derived and/or modified sequence opt1 from anti-HIV_cap256-038-213466_VR-Chain
  source 1..432: mol_type = other RNA
gaggtgcagctggtcgagagcggcgggggcctcgtgcagcccgggcgctccctgcgggtgagctgcgccgcctccggcttcaccttcgaggactacgcgatgcactgggtccgccaggccccggggaagggcctggagtgggtggccgtgatcagcgacgacggcaacaacaagtactacgccgactccgtcaaggggcggttcaccatcagccgcgacaactccaagaacacgctctacctgcagatgaacagcctgcgggtggaggacaccgccgtgtactactgcgtcaaggacgtgggcgagtccgagaacgaggagtgggcgagcgactactacgacttcgggcgcgactaccccggccaggacacccgggccgtggtcggggccttcgacatctggggccagggcaccatggtgacggtgtccagc

SEQ ID NO: 9924 - RNA, 432 nt, synthetic construct
  misc_feature 1..432: note = derived and/or modified sequence opt1 from anti-HIV_cap256-038-213212_VR-Chain
  source 1..432: mol_type = other RNA
caggtgcagctggtcgagagcggcgggggcgtggtgcagcccgggggctccctccgcctgagctgcgccgcctccgggttcatcttcagcgactacggcatgcactgggtccggcaggcgccgggcaaggggctggagtgggtggcctccatctggcacgacggcagcaagaagtactacgccgactccgtgaaggggcgcttcaccatcagccgggagaactccaagaacaccctctacctgcagatgaacagcctgcgcgccgaggacacggccgtctaccactgcgcgaaggacctcggcgagtccgagatcgaggagtggaccagcgactactacgacttcgggcgggactaccccggccaggacccccgcggcgtgttcgggaccttcgacatctggggccacgggaccatggtgacggtctccagc

SEQ ID NO: 9925 - RNA, 432 nt, synthetic construct
  misc_feature 1..432: note = derived and/or modified sequence opt1 from anti-HIV_cap256-038-213120_VR-Chain
  source 1..432: mol_type = other RNA
caggtgcacctggtcgagagcggcgggggcctcgtgaagcccgggggctccctgcgcctgagctgcgccgcctccgggttcaccttcagcgactactacatgatctggatccggcaggcgccgggcaagggcctcgagtgggtggccgtcatctccagcgacgggtccaacaagaactacgccgacagcgtgaagggccgcttcaccatctcccgggacaacagcaagaacacgctgtacctgcagatgaactccctccgcgccgaggacaccgccgtgtactactgcgcgaaggacctgggggagagcgagaacgaggagtgggccaccgactactacgacttcgccaccggctaccccgtccaggacccccgggccgtggtgggggcgttcgacatctggggccagggcacgatggtcaccgtgtccccc

SEQ ID NO: 9926 - RNA, 432 nt, synthetic construct
  misc_feature 1..432: note = derived and/or modified sequence opt1 from anti-HIV_cap256-038-212592_VR-Chain
  source 1..432: mol_type = other RNA
ctggtgcagctcgtcgagagcggcgggggcgtggtgcagcccgggaagtccctgcgcctgagctgcgccgcctccggcttcaccttcagctcctacgcgatgcactggatccggcaggccccggggaagggcctcgagtgggtcgccgtgatcagcgacgacggctccatcaagaactacgccgacagcgtgaaggggcgcttcaccatctcccgggacacgagcaagaagctgatgtacctgcagatgaactccctcagcgccaacgacaccgcggtctactactgcgccaaggacctgggcgagcgcgagaacgaggagtgggcctccgactactacgacttcgggcgggactaccccggccaggacccccgcggggtggtgggcagcatcgacacctggggccacgggaccatggtcacggtgtccagc

SEQ ID NO: 9927 - RNA, 432 nt, synthetic construct
  misc_feature 1..432: note = derived and/or modified sequence opt1 from anti-HIV_cap256-038-211790_VR-Chain
  source 1..432: mol_type = other RNA
gagctgcagctcgtggagagcggcgggggcctggtccagcccgggggctccctgcgcctcagctgcgtggtgtccgggttcaccgtcagcaccaactacatctcctgggtgcggcaggccccgggcaagggcctggagtgggtggccgtcatcagctacgacgggtccaacaagtactacgcggacagcgtgaagggccgcttcacgatctcccgggacaacagcaagaacaccctgtacctccagatgaactccctgcgcgccgaggacaccgccctgtactactgcgccaaggacctcggggagagcgagaacgaggagtgggcctccgactactacgacttcggccgggactaccccgggcaggacccccgcggcgtggtcggcaccttcgacatctgggggcagggcacgatggtgaccgtgagctcc

SEQ ID NO: 9928 - RNA, 432 nt, synthetic construct
  misc_feature 1..432: note = derived and/or modified sequence opt1 from anti-HIV_cap256-038-209916_VR-Chain
  source 1..432: mol_type = other RNA
caggtgcagctggtcgagagcggcgggggcgtggtgcagcccgggggctccctccggctgagctgcgccgcctccgggttcaccttcagctccttcggcatgcactgggtccggcaggcgccgggcaaggggctggagtgggtgagcttcatccgcaacgacggcgggatccggtactccgccgacagcgtgcgcggccggttcaccatctcccgcgacaacagcaagaacacgctctacctgcagatgaactccctgcggaccgacgacaccgccgtctactactgcgccaaggacctcggggagagcgagaccgaggagtggccctccgactactacgacttcggccgcgactaccccggccaggacccccgcggggtggtgggcacgttcgacatctgggggcacggcaccatggtcaccgtgagctcc

SEQ ID NO: 9929 - RNA, 432 nt, synthetic construct
  misc_feature 1..432: note = derived and/or modified sequence opt1 from anti-HIV_cap256-038-207938_VR-Chain
  source 1..432: mol_type = other RNA
caggtgcagctggtcgagagcggcgggggcgtggtgcaccccgggcgctccctccggctgagctgcgccgcctccggcttcaccttcagctcctacgggatgcactgggtccgccaggcgccgggcaagggcctggagtgggtggccgtgatcagccacgacgggtccaacaagtactacgccgacagcgtcaagggccggttcaccatctcccgcgacaacagcaagaacacgctctacctgcagatgaactccctgcgggccgaggacaccgccgtgtactactgcgcgaaggacctcggggagagcgagaacgaggagtgggcctccgactactacgacttcggccgcgactaccccgggcaggacccccggggcgtggtcggcgtgttcgacatctgggggcagggcaccatggtgaccgtcagctcc

SEQ ID NO: 9930 - RNA, 432 nt, synthetic construct
  misc_feature 1..432: note = derived and/or modified sequence opt1 from anti-HIV_cap256-038-202245_VR-Chain
  source 1..432: mol_type = other RNA
caggtgcacctggtcgagagcggcgggggcgtggtgcagcccgggcgctccctccggctgagctgcaccgtctccggcttcaccttcgggagctacgccctgcactgggtgcgccaggccccgggcaagggcctcgagtggctgtccgtgatcagctacgacgggaacaacaagtactacgcggactccgtcaagggccggttcacgatcagccgcgagaactccaagaacaccctgtacctccagatgaacagcctgcgggccgaggacaccgccgtgtaccactgcgccaaggacctgggggagtccgagaaggaggagtgggccagcgactactacgacttcggccgcgactaccccgggcaggacccccggggcgtggtcggcaccttcgacatctgggggcacggcacgatggtgaccgtgtccagc

SEQ ID NO: 9931 - RNA, 432 nt, synthetic construct
  misc_feature 1..432: note = derived and/or modified sequence opt1 from anti-HIV_cap256-038-197721_VR-Chain
  source 1..432: mol_type = other RNA
caggtgcagctggtcgagagcggcgggggcgtggtgcagcccgggaagtccctccgcctgagctgcgccggctccgggttcatcttcagcaactacccgatgcactgggtccggcaggcccccggcaagggcctggagtggatggcggacgtgtcctacgacgggagcaacaaggactacgccgactccgtgaagggccgcttcaccatcagccgggacaactccaagaacaccctctacctgcagatgaacagcctgcgcgccgaggacacggccgtctactactgcgtgaaggacgtgggggagtccgagaacgaggagtgggccagcgactactacgacttcggccgggactaccccgggcaggacacccgcgcggtcgtgggcgccttcgacatctggggccaggggaccatggtgaccgtctccagc

SEQ ID NO: 9932 - RNA, 432 nt, synthetic construct
  misc_feature 1..432: note = derived and/or modified sequence opt1 from anti-HIV_cap256-038-196679_VR-Chain
  source 1..432: mol_type = other RNA
gaggtgcagctgctcgagagcggcgggggcctggtccagcccgggggctccctgcgcctcagctgcgccgcctccgggttcaccttcagctcctacgcgatgagctgggtgcggcaggccccgggcaagggcctggagtgggtggccgtcatctcctacgacgggggcaacaagtactacgccgacagcgtgaaggggcgcttcaccatctcccgggacaacagcaagaacacgctgtacctccagatgaactccctgcgcgccgaggacaccgcgctgtactactgcgccaaggacctcggcgagagcgagaacgaggagtgggcctccgactactacgacttcgggcgggactaccccggccaggacagccgcggcgtggtcgggaccttcgacgtgtggggccaggggaccatggtgacggtctccagc

SEQ ID NO: 9933 - RNA, 438 nt, synthetic construct
  misc_feature 1..438: note = derived and/or modified sequence opt1 from anti-HIV_cap256-038-196118_VR-Chain
  source 1..438: mol_type = other RNA
caggtgcagctggtcgagagcggcgggggcgtggtgcagcccgggggctccctccgcctgagctgcgccgcctccgggttcaccttcagcacctacggcatgcactgggtccggcaggcgccgggcaaggggctggagtgggtgacgttcatccgcaacgacggcaccaacaagtactacgccgactccgtgaaggggcggttcaccatcagccgcgacaacaccaagaacacgctctacctgcagatgtactccctgcgggccgaggacaccgccgtctactactgcgccaaggacctcggcgagagcgagaacgaggacgaggagtgggcgtccgactactacgacttcgggcgcgactaccccggccaggacagccggggcgtggtggggaccttcgacatgtggggccaggggaccatggtcacggtgtccagc

SEQ ID NO: 9934 - RNA, 429 nt, synthetic construct
  misc_feature 1..429: note = derived and/or modified sequence opt1 from anti-HIV_cap256-038-195382_VR-Chain
  source 1..429: mol_type = other RNA
caggtgcacctggtcgagagcggcgggggcgtggtgcagcccgggcgctccctccggctgagctgcgccgcctccggcttcaccttcagcaactacccggtccactgggtgcgccaggcgcccgggaagggcctggagtgggtggccgtcatctccttcgacggcatcaacaactacgccgggagcgtgaagggccggttcatcatctcccgcgacaacagcaagaacaccctctacctgcagatgaactccctgcgggccgaggacacggccgtgtactactgcgtcaaggacctcggggagagcgagaaggaggagtggccctccgactactacgacttcggccgcgactaccccgggcaggacagccggggcgtggtgggcgtcttcgacatctgggggcagggcaccatggtgaccgtgtccagc

SEQ ID NO: 9935 - RNA, 432 nt, synthetic construct
  misc_feature 1..432: note = derived and/or modified sequence opt1 from anti-HIV_cap256-038-180001_VR-Chain
  source 1..432: mol_type = other RNA
gaggtgcagctggtcgagagcggcgggggcctcgtgcagcccgggcgctccctgcggctgagctgcaccgcctccggcttcaccttcggggactacgccatgagctggttccgccaggcgccgggcaagggcctcgagtgggtggccgacatctcctacgacgggagcaacaagtactacgccgactccgtcaagggccggctgacgatcagccgcgacaactccaagaacaccctgtacctccagatgaacagcctgcgggccgaggacaccgccgtgtactactgcgtgaaggacctgggggagtccgagaaggaggagtggcccagcgactactacgacttcggccgcgactaccccgggcaggactcccggggcgtcgtgggcgtgttcgacatctgggggcagggcaccatggtcacggtgagctcc

SEQ ID NO: 9936 - RNA, 432 nt, synthetic construct
  misc_feature 1..432: note = derived and/or modified sequence opt1 from anti-HIV_cap256-038-178021_VR-Chain
  source 1..432: mol_type = other RNA
caggtgaagctggtcgagagcggcgggggcgtggtgcagcccgggggctccctccgcctgagctgcgccgccgcggggttcatcttctccaacagcggcatgcactgggtccggcaggccccggacaagggcctggagtgggtggccttcgtgccctacgacgggtccaacaagtactacgccgacagcgtcaagggccgcttcaccatctcccgggacaacagcaagaacaccctctccctgcagatgaacagcctgcgcacggaggacaccgccgtgtactactgcgcgaaggacctcggggagtccgagaccgaggagtggcccagcgactactacgacttcggccgggactaccccgggcaggacccgcgcggcgtggtcggcaccttcgacatctgggggcacggcacgatggtgaccgtgtccagc

SEQ ID NO: 9937 - RNA, 432 nt, synthetic construct
  misc_feature 1..432: note = derived and/or modified sequence opt1 from anti-HIV_cap256-038-177104_VR-Chain
  source 1..432: mol_type = other RNA
gaggtgcagctgctcgagagcggcgggggcctggtccagcccgggggctccctgcgcctcagctgcgccgcctccgggttcaccttcagctcctacgcgatgaactgggtgcggcaggccccgggcaagggcctggagtgggtggccgtcatcagctacgacgggggcgacaagtactacgccgactccgtgaaggggcgcttcaccatcagccgggacaactccaagaacacgctgtacctccagatgaacagcctgcgcgtggaggacaccgccgtctactactgcgtgaaggacgtgggcgagtccgagaacgaggagtgggcgagcgactactacgacttcgggcgggactaccccggccaggacacccgcgccgtcgtgggcgccttcgacatctgggggcagggcaccatggtgacggtctccagc

SEQ ID NO: 9938 - RNA, 432 nt, synthetic construct
  misc_feature 1..432: note = derived and/or modified sequence opt1 from anti-HIV_cap256-038-171261_VR-Chain
  source 1..432: mol_type = other RNA
caggtgcagctggtcgagagcggcgggggcgtggtgcagcccgggcgctccctccggctgagctgcgccgcctccggcttcaccttcagctcctacgcgatgtactgggtccgccaggccccggggaagggcctggagtgggtggccgtgatcagctccgacggcagcgacaagaactacgccgactccgtcaaggggcggttcaccatcagccgcgacaactccaacaacacgctctacctgcagatgaacagcctgcgggccgaggacaccgcggtgtactactgcgcccgcgacctcggcgagtccgagaacgaggagtggcccagcgactactacgacttcgggcgggactaccccggccaggacccccgcggggtgatcggcaccttcgacgtctggggccaggggaccatggtgacggtgtccagc

SEQ ID NO: 9939 - RNA, 432 nt, synthetic construct
  misc_feature 1..432: note = derived and/or modified sequence opt1 from anti-HIV_cap256-038-169090_VR-Chain
  source 1..432: mol_type = other RNA
caggtgcagctggtcgagagcggcgggggcgtggtgcagcccgggcgctccctccggctgagctgcgccgcctcccgcttcaccttcaagacctacacgatgcactgggtccggcaggcgccgggcaaggggctggagtgggtggccctcatcagctacgacggctccaacaagtactacgccgacagcgtgaagggccgcctgaccatctcccgggacaacagcaagaacaccctgtacctccagatgaactccctgcgcgccgaggacaccgccgtctactactgcgtgaaggacctgggggagagcgagaaggaggagtggccctccgactactacgacttcggccgggactaccccgggcaggacagccgcggcgtggtcggggtgttcgacatctggggccagggcacgatggtgaccgtctccagc

SEQ ID NO: 9940 - RNA, 432 nt, synthetic construct
  misc_feature 1..432: note = derived and/or modified sequence opt1 from anti-HIV_cap256-038-168705_VR-Chain
  source 1..432: mol_type = other RNA
gaggtgcagctggtcgagagcggcgggggcctcgtgaagcccgggggctccctgcgcctgagctgcgccgcctccgggttcaccttcagctcctacagcatgaactgggtgcggcgcgcgccgggcaagggcctcgagtgggtcgccctgatctcctacgacgagaacaagaagtactacgccgacagcgtgaaggggcggttcaccatctcccgcgagaacagcaagaacacgctgtacctccagatgaactccctgcgggccgaggacaccgccgtgtactactgcgcgaaggacctgggcgagcgcgagaacgaggagtgggccagcgactactacgacttcgggcgggactaccccggccaggacccccgcggggtcgtgggctccatcgacacctggggccacgggaccatggtgacggtcagctcc

SEQ ID NO: 9941 - RNA, 432 nt, synthetic construct
  misc_feature 1..432: note = derived and/or modified sequence opt1 from anti-HIV_cap256-038-167685_VR-Chain
  source 1..432: mol_type = other RNA
caggtgcagctggtcgagagcggcgggggcgtggtgcagcccgggcgctccctccggctgagctgcgccgcctccggcatcaccttcagctcctacgcgatccactgggtccgccaggccccggggaagggcctggagtgggtggccgtgatcagctacgacggctccaacaagtactacgccgacagcgtcaaggggcggttcaccatctcccgcgacaacagcaagaacacgctctacctgcagatgaactccctgcgggccgaggacaccgcggtgtactactgcgccaaggacctcggcgagagcgagaacgaggagtgggccaccgactactacgacttctccatcgggtaccccggccaggacccccgcggggtggtcggcgccttcgacatctggggccaggggaccatggtgacggtgagcctg

SEQ ID NO: 9942 - RNA, 432 nt, synthetic construct
  misc_feature 1..432: note = derived and/or modified sequence opt1 from anti-HIV_cap256-038-158775_VR-Chain
  source 1..432: mol_type = other RNA
caggtgcagctggtcgagagcggcgggggcgtggtgcagcccgggggctccctccgcctgagctgcgccgcctccgggttcaccttcagcacctacggcatgcactgggtccggcaggcgccgggcaaggggctggagtgggtggccttcatccgcgacaacggctccaacaagtactacgccgacagcgtgaaggggcggttcacgatctcccgcgacaacagcaagaacaccctctacctgcagatgaactccctgcgggccgaggacaccgccctctactactgcgcgaaggacctgggcgagagcgagaacgaggagtgggcctccgactactacgacttcgggcgcgactaccccggccaggacagccggggcgtcgtggggaccttcgacgtgtggggccaggggacgatggtcaccgtgtccagc

SEQ ID NO: 9943 - RNA, 432 nt, synthetic construct
  misc_feature 1..432: note = derived and/or modified sequence opt1 from anti-HIV_cap256-038-157318_VR-Chain
  source 1..432: mol_type = other RNA
cacgtgcagctggtcgagagcggcgggggcgtggtgcagcccgggcggtccctccggctgagctgcgccgcctccggcatcaccttcagcacctacgacatgcactgggtccgccaggcgccggggaagggcctggagtgggtggccgtgatctccaacgacggcagcaacaagtactacgccgactccgtcaaggggcggttcacgatcagccgcgacaactccaagaacaccctctacctgcagatgaacagcctgcgggccgaggacaccgccctctactactgcgcgaaggacctgggcgagtccgagaaggaggagtgggccagcgactactacgacttcgggcgcgactaccccggccaggacccccgcggggtggtggccaccttcgacatctggggccagggcacgatggtcaccgtgtccagc

SEQ ID NO: 9944 - RNA, 432 nt, synthetic construct
  misc_feature 1..432: note = derived and/or modified sequence opt1 from anti-HIV_cap256-038-153058_VR-Chain
  source 1..432: mol_type = other RNA
caggtgcagctggtcgagagcggcgggggcgtggtgcagcccgggcgctccctccggctgagctgcgccgcctccggcttcaccttcagcacctacgcgatgcactgggtccgccaggccccggggaagggcctggagtgggtggccgtgatctcctacgacggcagccactcctactacgccgggagcgtcaagggccggttcacgacctcccgcgacaacagcaagaacaccctcaacctgcagatgaactccctgcggcccgaggacaccgccctctactactgcgcgaaggacctgggggagagcgagaacgaggagtgggcctccgactactacgacttcggccgcgactaccccgggcaggacagccggggcgtggtgggcacgttcgacgtctgggggcagggcaccatggtgaccgtgtccagc

SEQ ID NO: 9945 - RNA, 432 nt, synthetic construct
  misc_feature 1..432: note = derived and/or modified sequence opt1 from anti-HIV_cap256-038-150027_VR-Chain
  source 1..432: mol_type = other RNA
ctggtgcagctcgtcgagagcggcgggggcgtggtgcagcccgggggctccctgcgcctgagctgcgccgcctccgggttccggttcagctcctacggcatgcactgggtccgccaggcgccgggcaaggggctcgagtgggtggccttcatccggtacgacggcagcttcaaggactacgccgactccgtgcgcgggcggttcaccatcagccgcgacaactccaagaacaccgtctacgtgcagatgaacagcctgcgggccgaggacacggccgtgtactactgcgcgaaggacctgggcgagtccgagaacgaggagtgggccaccgactactacgacttcgccaccgggtaccccgtccaggacccccgcgccgtggtgggcgcgttcgacatctggggccaggggaccatggtcacggtgagcccc

SEQ ID NO: 9946 - RNA, 432 nt, synthetic construct
  misc_feature 1..432: note = derived and/or modified sequence opt1 from anti-HIV_cap256-038-146372_VR-Chain
  source 1..432: mol_type = other RNA
caggtgcagctggtcgagagcggcgggggcgtggtgcagcccgggcgctccctccggctgagctgcgccgcctccggcttcaccttcagctccttcgggatgcactgggtccgccagagcccgggcaagggcctggagtgggtggcggtgatctcctacgacgggaacaacaagtactacgccgacagcgtcaagggccggttcaccatctcccgcgagaacagcaagaacacgctctacctgcagatgaactccctgcggaccgacgacaccgccgtgtactactgcgccaaggacctcggggagagcgagaccgaggagtgggccacggactactacgacttcgcgaccggctaccccgtgcaggacccccgcgccgtcgtgggggccttcgacatctggggccagggcaccatggtgaccgtctccccc

SEQ ID NO: 9947 - RNA, 432 nt, synthetic construct
  misc_feature 1..432: note = derived and/or modified sequence opt1 from anti-HIV_cap256-038-141868_VR-Chain
  source 1..432: mol_type = other RNA
gagctgcggctcgtggagagcggcgggaacctggtccagcccggcgggtccctgaccctcagctgcgtggcctccggcttcaccttcgacagctacgggatgtcctgggtgcggcaggccccgggcaagggcctggagtgggtcgcgctgatcagctacgacgagaacaagaagtactacgccgactccgtgaaggggcgcttcacgatcagccgggagaactccaagaacaccctctacctgcagatgaacagcctgcgcgccgaggacaccgccgtgtactactgcgccaaggacctcggcgagcgggagaacgaggagtgggcgtccgactactacgacttcgggcgcgactaccccggccaggacccccgcggggtcgtgggcagcatcgacacctggggccacgggacgatggtgaccgtctccagc

SEQ ID NO: 9948 - RNA, 432 nt, synthetic construct
  misc_feature 1..432: note = derived and/or modified sequence opt1 from anti-HIV_cap256-038-141616_VR-Chain
  source 1..432: mol_type = other RNA
gaggtgcagctgctcgagagcggcgggggcctggtccagcccgggggctccctgcgcctcagctgcgccgcctccgggttcaccttcagctcctacgcgatgagctgggtgcggcaggccccgggcaagggcctggagtgggtggccgtcatctccaaggacgggagcgacaactcctacgtggacagcgtgaagggccgcttcaccatctcccgggacaacagcaagaacacgctgtacctccagatgaactccctgcgcgccgaggacaccgccgtctactactgcgcgcgggacctgggggagagcgagaacgaggagtggccctccgactactacgacttcggccgcgactaccccgggcaggacccccggggcgtgatcggcaccttcgacgtgtgggggcagggcaccatggtcacggtgagctcc

SEQ ID NO: 9949 - RNA, 432 nt, synthetic construct
  misc_feature 1..432: note = derived and/or modified sequence opt1 from anti-HIV_cap256-038-127989_VR-Chain
  source 1..432: mol_type = other RNA
caggcccagctggtggagagcggcgggggcgtcgtgcagcccgggcgctccctccggctgagctgcgccgcgtccggcttcaccttcagcaacttcgccatgcactgggtgcgccaggccccggggaagggcctggagtgggtcgccgtgatgtccgacgacggcagcaacaagtactacgccgactccgtgaaggggcggttcaccatcagccgcgacaactccgagaacacgctctacctgcagatgaacagcctgcgggcggaggacaccgccgtctactactgcgccaaggacctcggcgagtccgagaccgaggagtgggccaccgactactacgacttcgggacgggctaccccgggcaggacccccgcgcgatgatcggcaccttcgacatctggggccgggggaccatggtgaccgtgagctcc

SEQ ID NO: 9950 - RNA, 432 nt, synthetic construct
  misc_feature 1..432: note = derived and/or modified sequence opt1 from anti-HIV_cap256-038-118109_VR-Chain
  source 1..432: mol_type = other RNA
caggtgcagctggtcgagagcggcgggggcgtggtgcagcccgggggctccctccgcctgagctgcaccgcctccgggttcaccttcagcgcctacgacatgcactggatccggcaggcgccgggcaagggcctggggtgggtcgccttcatcacgaacgagggctccagcaagaactacgtggactccgtgaaggggcgcttcaccatcagccgggacaactccaagaacaccctctacctgcagatgaacagcctgcgcgccgaggacaccgccgtctactactgcgccaaggacctcggcgagtccgagaacgaggagtgggcgacggactactacgacttcagcatcgcctaccccgggcaggacccccggggcgtggtgggcatcttcgacatctgggggcagggcaccatggtcaccgtgtccagc

SEQ ID NO: 9951 - RNA, 432 nt, synthetic construct
  misc_feature 1..432: note = derived and/or modified sequence opt1 from anti-HIV_cap256-038-112226_VR-Chain
  source 1..432: mol_type = other RNA
gaggtgcagctggtcgagagcggcgggggcctcgtgcagcccgggggctccctgcgcctgagctgcgccgcctccgggttcaccttcagctcctactggatgacctgggtgcggcaggcgccgggcaagggcctcgagtgggtcgccgtgatcagcgacgacgggaacaacaagtactacgccgactccgtgaagggccgcttcacgatcagccgggacaactccaagaacaccctgtacctgcagatgaacagcctccgcgtcgaggacaccgccgtgtactactgcgtgaaggacgtcggggagtccgagaacgaggagtgggccagcgactactacgacttcggccgggactaccccgggcaggacacccgcgcggtggtgggcgccttcgacatctggggccaggggacgatggtcaccgtgtccagc

SEQ ID NO: 9952 - RNA, 432 nt, synthetic construct
  misc_feature 1..432: note = derived and/or modified sequence opt1 from anti-HIV_cap256-038-105918_VR-Chain
  source 1..432: mol_type = other RNA
gaggtgcagctgctcgagagcggcgggggcctggtccagcccgggggctccctgcgcctcagctgcgccgcctccgggttcaccttcaacatccacccgatgcactgggtgcggcaggcgcccggcaagggcctggagtgggtggccgtcatcagctacgacgggaacaacaagtactacgccgactccgtgaagggccgcttcaccatcagccgggagaactccaagaacacgctgtacctccagatgaacagcctgcgcaccgacgacaccgccgtgtactactgcgccaaggacctgggggagtccgagaccgaggagtggcccagcgactactacgacttcggccgggactaccccgggcaggacccgcgcggcgtcgtgggcacgttcgacatctgggggcacggcaccatggtgaccgtctccagc

SEQ ID NO: 9953 - RNA, 432 nt, synthetic construct
  misc_feature 1..432: note = derived and/or modified sequence opt1 from anti-HIV_cap256-038-104487_VR-Chain
  source 1..432: mol_type = other RNA
ctggtgcagctcgtcgagagcggcgggggcgtggtgcagcccgggaagtccctgcgcctgagctgcgccgcctccggcttcaccttcagctcctacgcgatgcactggatccggcaggccccggggaagggcctcgagtgggtcgccgtgatcagcgacgacggctccatcaagaactacgccgacagcgtgaaggggcgcttcaccatctcccgggacaacagcaagaacacgctgtacctgcagatgaactccctccgcgccgaggacaccgcggtctactactgcgccaaggacctgggcgagagcgagaacgaggagtgggccaccgactactacgggttctccatcggctaccccgggcaggacccccggggcgtggtgggcatcttcgacatctgggcccaggggaccatggtcacggtgagctcc

SEQ ID NO: 9954 - RNA, 432 nt, synthetic construct
  misc_feature 1..432: note = derived and/or modified sequence opt1 from anti-HIV_cap256-038-102308_VR-Chain
  source 1..432: mol_type = other RNA
caggtgcagctggtcgagagcggcgggggcgtggtgcagcccgggggctccctccgcctgagctgcgccgccctggacttcccgttctccagcttcgggatgcactgggtccggcagacccccggccgcggcctcgagtgggtggcgatcatctggtccgacgggagcaaccggtactacgtggactccgtcaagggccgcttcaccatcagccgggacaactccaagaacacgctgtacctgcagatgaacagcctccgccccgacgacaccgccgtgtactactgcgtgaaggacctgggggagtccgagaacgaggagtgggccaccgactactacgacttcagcgtcggctaccccgggcagggcccgcggggcgtggtggggatcttcgacatctggggccaggggaccatggtcacggtgtccagc

SEQ ID NO: 9955 - RNA, 432 nt, synthetic construct
  misc_feature 1..432: note = derived and/or modified sequence opt1 from anti-HIV_cap256-038-091115_VR-Chain
  source 1..432: mol_type = other RNA
caggtgcagctggtcgagagcggcgggggcgtggtgcagcccgggcgctccctccggctgagctgcgccgtctccggcttcaccttcagctcctacgggctgcactgggtgcgccaggccccgggcaagggcctcgagtgggtggcggtcatcagctacgacgggtccaacaagtactacgccgacagcgtgaagggccggttcaccatctcccgcgacaacagcaagaacacgctgtacctgcagatcaactccctccgggccgaggacaccgccgtgtactactgcgccaaggacctgggggagagcgagaacgaggagtgggcgaccgactactacgacttctccatcggctaccccgggcaggacccccgcgccgtcgtgggcgccttcgacatctggggccaggggaccatggtgacggtcagctcc

SEQ ID NO: 9956 - RNA, 432 nt, synthetic construct
  misc_feature 1..432: note = derived and/or modified sequence opt1 from anti-HIV_cap256-038-090262_VR-Chain
  source 1..432: mol_type = other RNA
caggtgcagctggtcgagagcggcgggggcgtggtgcaggccgggggctccctccgcctgagctgcgccgcgtccgggttcaccttcaacaactacggcatgcactgggtccggcaggcccccggcaaggggctggagtgggccgccttcatccgctacgacggcagcaacaagtactacgccgactccgtgcgggggcgcttcaccatcagccgggacaactccaagaacacgctctacctgcagatgaacagcctgcgcgcggaggacaccgccgtgtactactgcgtcaaggacgtgggcgagtccgagaacgaggagtgggccagcgactactacgacttcgggcgggactacccgggccaggacacccgcgccgtggtcggcgcgttcgacatctgggggcagggcaccatggtgacggtgtccagc

SEQ ID NO: 9957 - RNA, 432 nt, synthetic construct
  misc_feature 1..432: note = derived and/or modified sequence opt1 from anti-HIV_cap256-038-083260_VR-Chain
  source 1..432: mol_type = other RNA
caggtgcagctggtcgagagcggcgggggcctcgtgaagcccgggggctccctgcgcctgagctgcgccgcctccgggttcaccttcagcgactactacatgacctggatccggcaggcgccgggcaagggcctcgagtgggtggccgtcatctcctacgacgggggcaacaagtactacgccgacagcgtgaaggggcgcttcacgatctcccgggacaacagcaagaacaccctgtacctgcagatgaactccctccgcgccgaggacaccgccctgtactactgcgcgaaggacctgggcgagagcgagaacgaggagtgggcctccgactactacgacttcgggcgggactaccccggccaggacagccgcggcgtggtcgggaccttcgacgtgtggggccaggggacgatggtgaccgtctccagc

SEQ ID NO: 9958 - RNA, 432 nt, synthetic construct
  misc_feature 1..432: note = derived and/or modified sequence opt1 from anti-HIV_cap256-038-080981_VR-Chain
  source 1..432: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcatggagtgggtggccgtgatcagctacgacgggtccaacaagtactacgccgacagcgtcaagggccggttcaccatctcccgcgacaacagcaagaacacgctgtacctccagatgaactccctgcgggccgtggacaccgccgtgtactactgcgcgaaggacctgggggagggcgagaacgaggagtgggccaccgactactacgacttcagcatcgggtaccccggccaggacccccgcggcgtcgtgggggccttcgacatctggggccaggggaccatggtgacggtctccagc

SEQ ID NO: 9959 - RNA, 432 nt, synthetic construct
  misc_feature 1..432: note = derived and/or modified sequence opt1 from anti-HIV_cap256-038-080873_VR-Chain
  source 1..432: mol_type = other RNA
ctggtgcagctcgtcgagagcggcgggggcgtggtgcagcccgggggctccctgcgcctgagctgcgccgcctccgggttccggttcagctcctacggcatgcactgggtccgccaggcgccgggcaaggggctcgagtgggtggccttcatccggtacgacggcagcttcaaggactacgccgactccgtgcgcgggcggttcaccatcagccgcgacaactccaagaacaccgtctacctgcagatgaacagcctgcgggccgaggacacggccgtgtactactgcgtgaaggacctcggcgagtccgagaaggaggagtggcccagcgactactacgacttcgggcgcgactaccccggccaggactcccggggcgtcgtgggggtgttcgacatctggggccaggggaccatggtcaccgtgagctcc

SEQ ID NO: 9960 - RNA, 432 nt, synthetic construct
  misc_feature 1..432: note = derived and/or modified sequence opt1 from anti-HIV_cap256-038-074413_VR-Chain
  source 1..432: mol_type = other RNA
caggtgcagctggtcgagagcggcgggggcgtggtgcagcccgggggctccctccgcctgagctgcgccgcctccgggttcaccttcagcacctacggcatgcactgggtccggcagccgcccggcaaggggctggagtgggtggcgttcatccgctacgacggctccaacacgtactacgccgacagcgtgaaggggcggttcaccatctcccgcgacaacagcaagaacaccctctacctgcagatgaactccctgcgggccgaggacaccgccgtctactactgcgccaaggacctcggcgagagcgagaacgaggagtgggcgtccgactactacgacttcgggcgcgactaccccggccaggacccccggggcgtggtgggggtcttcgacatctggggccaggggacgatggtgaccgtgagctcc

SEQ ID NO: 9961 - RNA, 432 nt, synthetic construct
  misc_feature 1..432: note = derived and/or modified sequence opt1 from anti-HIV_cap256-038-073153_VR-Chain
  source 1..432: mol_type = other RNA
caggtgcagctggtcgagagcggcgggggcgtggtgcagcccgggcgctccctccggctgagctgcgccgcctccggcttcaccttcagctcctacgggatgcactgggtccgccaggcgccgggcaagggcctggagtgggtggccctcatcagctacgacgggaccaacaagtactacgccgactccgtgaagggccggttcacgatcagccgcgacaactccaagaacaccctgttcctgcagatgaacagcctccgggccgaggacaccgccctgtactactgcgcgaaggacctgggggagtccgagaacgaggagtgggccagcgactactacgacttcggccgcgactaccccgggcaggacccccggggcgtcgtgggcaccttcgacatctgggggcagggcacgatggtgaccgtctccagc

SEQ ID NO: 9962 - RNA, 432 nt, synthetic construct
  misc_feature 1..432: note = derived and/or modified sequence opt1 from anti-HIV_cap256-038-064227_VR-Chain
  source 1..432: mol_type = other RNA
gaggtgcaggtcgtggagagcggcgggggcctggtgcagcccgggggctccctccgcctgagctgcgccgcctccgggttcaccttcagcaactactggatgtcctgggtccggcaggcgccgggcaagggcctggagtgggtggccgtgatgagcttctccgggagcggctcctactacgccgacagcgtcaaggggcgcttcaccatctccagcgacgactccatgaacacggtgtacctccagatgaacagcctgcgggccgaggacaccgccgtgtactactgcgcgaaggacctgggcgagcgcgagaacgaggagtgggcctccgactactacgacttcgggcgggactaccccggccaggacccccgcggcgtcgtggggagcatcgacacctggggccacgggaccatggtgacggtctccagc

SEQ ID NO: 9963 - RNA, 432 nt, synthetic construct
  misc_feature 1..432: note = derived and/or modified sequence opt1 from anti-HIV_cap256-038-061640_VR-Chain
  source 1..432: mol_type = other RNA
caggtgcagctggtcgagagcggcgggggcgtggtgcagcccgggcgctccctccggctgagctgcaccgcctcccgcttcagcttcaacaactacgccatgcactgggtccggcaggcgccgggcaaggggctggagtgggtggccatcatctccaaggacggcagcgacaactcctacgtggacagcgtcaagggccgcttcaccatctcccgggacaacagcaagaacacgctctacctgcagatgaactccctgcgcgccgaggacaccgccgtgtactactgcgcccgggacctcggggagagcgagaacgaggagtggccctccgactactacgacttcggccgcgactaccccgggcaggacccccggggcgtgatcgggaccttcgacgtctggggccagggcaccatggtgacggtgagctcc

SEQ ID NO: 9964 - RNA, 414 nt, synthetic construct
  misc_feature 1..414: note = derived and/or modified sequence opt1 from anti-HIV_cap256-038-059482_VR-Chain
  source 1..414: mol_type = other RNA
cgcggcgtgcagtgccaggtccagctggtggagagcgggggcggggtggtccagcccggcttcaccttctccagctacgtgatgcactgggtgcggcaggccccggggaagggcctcgagtgggtcgccgacatctcctacgacggcagcaacaagtactacgcggactccgtgaaggggcgcctgaccatcagccgggacaactccaagaacacgctgtacctccagatgaacagcctgcgcgccgaggacaccgccgtgtactactgcgtcaaggacctgggcgagtccgagaaggaggagtggcccagcgactactacgacttcgccaccgggtaccccgtgcaggacccccgggccgtggtcggcgcgttcgacatctgggggcagggcaccatggtgacggtgtccccg

SEQ ID NO: 9965 - RNA, 432 nt, synthetic construct
  misc_feature 1..432: note = derived and/or modified sequence opt1 from anti-HIV_cap256-038-054000_VR-Chain
  source 1..432: mol_type = other RNA
gaggtgcagctggtcgagagcggcgggtccgtggtgcggcccggcgggagcctccggctgtcctgcgccgccagcggcttcaccttcgacgactccgggatgagctgggtccgccagggcccgggcaaggggctggagtgggtggcggtgatctcctacgacggcgggaacaagtactacgccgacagcgtcaagggccggttcaccatctcccgcgacaacagcaagaacacgctctacctgcagatgaactccctgcgggccgaggacaccgccctctactactgcgccaaggacctgggggagagcgagaacgaggagtgggcgtccgactactacgacttcggccgcgactaccccggccaggacagccgcggggtggtgggcaccttcgacgtctgggggcagggcaccatggtgacggtgtccagc

SEQ ID NO: 9966 - RNA, 432 nt, synthetic construct
  misc_feature 1..432: note = derived and/or modified sequence opt1 from anti-HIV_cap256-038-050554_VR-Chain
  source 1..432: mol_type = other RNA
gaggtgcagctgctcgagagcggcggggacctggtccagtccggcgggagcctgcgcctctcctgcgtggccagcggcttcaccttctccacccacgccatgacgtgggtgcggcaggcgcccgggaagggcctggagtgggtcgccgtgatcagctccgacggcagcaacaagaacttcgccgactccgtgaaggggcgcttcaccatcagccgggacaactccaagaacaccctgtacctccagatgaacagcctgcgcccggaggacaccgccgtctactactgcgccaaggacctgggcgagtccgagaacgaggagtgggcgacggactactacgacttcagcaccgggtaccccgtgcaggacccccgggccgtggtcggcgccttcgacatctgggggcagggcaccatggtgaccgtgtccagc

SEQ ID NO: 9967 - RNA, 432 nt, synthetic construct
  misc_feature 1..432: note = derived and/or modified sequence opt1 from anti-HIV_cap256-038-044256_VR-Chain
  source 1..432: mol_type = other RNA
caggtgcagctggtcgagagcggcgggggcgtggtgcagcccgggcgctccctccggctgagctgcgccgcctccggcttcaccttcagctcctacgcgatgcactgggtccgccaggccccggggaagggcctggagtgggtggccgtgatcagctacgacggctccaacaagtaccacgccgggagcgtcaagggccggttcatcatctcccgcgacaacagcaagaacaccctctacctgcagatgaactccctgcgggccgaggacacggcgctctactactgcgccaaggacctgggggagagcgagaacgaggagtgggcctccgactactacgacttcggccgcgactaccccgggcaggacccccggggcgtggtgggcaccttcgacatctgggggcagggcaccatggtcaccgtgagctcc

SEQ ID NO: 9968 - RNA, 432 nt, synthetic construct
  misc_feature 1..432: note = derived and/or modified sequence opt1 from anti-HIV_cap256-038-040944_VR-Chain
  source 1..432: mol_type = other RNA
caggtgcagctggtcgagagcggcgggggcgtggtgcagcccgggcgctccctccggctgagctgcgccgcctccggcttcaccttcagcaactacgcgatggactgggtccgccaggccccggggaagggcctggagtgggtggccgtgatctcctacgacggcagcaacaagtactacgccgactccgtcaaggggcggttcaccatcagccgcgacaactccaagaacacgctctacctgcagatgaacagcctgcgggccgaggacaccgcggtgtactactgcgccaaggacctcggcgagtccgagaacgaggagtgggccaccgactactacgacttcagcaccgggtaccccggccaggacccccgcgccgtggtcggggcgttcgacatctggggccagggcacgatggtgaccgtgtccagc

SEQ ID NO: 9969 - RNA, 432 nt, synthetic construct
  misc_feature 1..432: note = derived and/or modified sequence opt1 from anti-HIV_cap256-038-040090_VR-Chain
  source 1..432: mol_type = other RNA
caggtgcagctggtcgagagcggcgggggcgtggtgcagcccgggcgctccctccggctgagctgcgccgcctccggcttcagcttctccaactacgcgatggactgggtccgccaggccccggggaagggcctggagtgggtggccgtgatcagctccgacggcagcaacaagaactacgccgactccgtcaaggggcggttcaccatcagccgcgacaactccaagaacaccctctacctgcagatggacagcctgcgggccgacgacacggcggtgtactactgcgccaaggacctcggcgagtccgagaacgaggagtgggccaccgactactacgacttcagcatcgggtaccccgtgcaggacccccgcggcgtcgtggggatcttcgacatctggggccagggcaccatggtgaccgtctccagc

SEQ ID NO: 9970 - RNA, 432 nt, synthetic construct
  misc_feature 1..432: note = derived and/or modified sequence opt1 from anti-HIV_cap256-038-032874_VR-Chain
  source 1..432: mol_type = other RNA
caggtgcagctggtcgagagcggcgggggcgtggtgcagcccgggggctccctccgcctgagctgcgccgcctccgggttcaccttcagctcctacggcatgcactgggtccggcaggcgccgggcaaggggctggagtgggtggccttcatccgctacgacggcaacaacaagtactacgccgacagcgtgaaggggcggttcaccatctcccgcgagaacagcaagaacacgctctacctgcagatgaactccctgcgggccgaggacaccgccgtctaccactgcgcgaaggacctcggcgagagcgagaaggaggagtgggcctccgactactacgacttcgggcgcgactaccccggccaggacccccggggcgtggtggggaccttcgacatctggggccacgggaccatggtcacggtgagctcc

SEQ ID NO: 9971 - RNA, 432 nt, synthetic construct
  misc_feature 1..432: note = derived and/or modified sequence opt1 from anti-HIV_cap256-038-025899_VR-Chain
  source 1..432: mol_type = other RNA
caggtgcagctggtcgagagcggcgggggcgtggtgcagcccgggcgctccctccggctgagctgcgtcgcctccggcttcaccttcagcaactacgccatgtactgggtgcgccaggcgccggggaagggcctggagtgggtgaccatcatctccttcgacggcagcaaccagtactacgccgactccgtcaaggggcggttcacgatcagccgcgagaactccaagaacaccctctacctgcagatgaacagcctgcgggccgaggacaccgccgtgtactactgcgccaaggacctcggcgagcgcgagaacgaggagtgggcgtccgactactacgacttcgggcgggactaccccggccaggacccccgcggggtggtcggcagcatcgacacctggggccacgggacgatggtgaccgtgtccagc

SEQ ID NO: 9972 - RNA, 432 nt, synthetic construct
  misc_feature 1..432: note = derived and/or modified sequence opt1 from anti-HIV_cap256-038-024581_VR-Chain
  source 1..432: mol_type = other RNA
cacatccagctggtggagagcggcgggggcgtcgtgcagcccgggggctccctccgcctgagctgcgccgcctccgggttcccgttcagctccttcggcatgcactgggtgcggcagacccccggccgcgggctggagtgggtcgcgatcatctggagcgacggctcccacaaggagtacaccgacagcgtgaaggggcggttcacgatctcccgcgacaacagccggtccaccatggacctccagatgaacaacctgcgccccgaggacaccgccgtgtactactgcgccaaggacctgggcgagcgggagaacgaggagtgggccagcgactactacgacttcgggcgcgactaccccggccaggacccgcggggcgtcgtggggtccatcgacacctggggccacgggacgatggtgaccgtcagctcc

SEQ ID NO: 9973 - RNA, 432 nt, synthetic construct
  misc_feature 1..432: note = derived and/or modified sequence opt1 from anti-HIV_cap256-038-013345_VR-Chain
  source 1..432: mol_type = other RNA
caggtgcagctggtcgagagcggcgggggcgtggtgcagcccgggcgctccctccggctgagctgcgccgtctccggcttcaccttcagctcctacgggatgcactgggtgcgccaggccccgggcaagggcctggagtgggtggcggccatcagctacgacgggtccaacaagtactacgtcgacagcgtgaagggccggttcaccatctcccgcgacaacagcaagaacacgctctacctgcagatgaactccctgcgggccgaggacaccgccgtgtactactgcgcccgcgacctcggggagcgggagatcgaggagtgggcgaccgactactacgacttcagcatcggctaccccgggcaggacccccgcggcgtcgtgggcgtgttcgacatctgggggcagggcaccatggtcacggtgtccagc

SEQ ID NO: 9974 - RNA, 438 nt, synthetic construct
  misc_feature 1..438: note = derived and/or modified sequence opt1 from anti-HIV_cap256-038-011559_VR-Chain
  source 1..438: mol_type = other RNA
caggtgcagctggtcgagagcggcgggggcgtggtgcagcccgggcgctccctccggctgagctgcgaggcctccggcttcaccttcagctcctacgggatggactgggtccgccaggccccgggcaagggcctggagtgggtggcgctcatcagccacgacgggtccaacaagcactacgccgacagcgtgaagggccggttcaccatctcccgcgacaacagccggaacacgctgtacctgcagatgaactccctccgcgccgaggacaccgccctgtactactgcgccaaggacctgggggagagcgagaacgaggacgaggagtgggcgtccgactactacgacttcggccgggactaccccgggcaggacagccgcggcgtcgtgggcaccttcgacatgtgggggcagggcaccatggtgacggtctccagc

SEQ ID NO: 9975 - RNA, 432 nt, synthetic construct
  misc_feature 1..432: note = derived and/or modified sequence opt1 from anti-HIV_cap256-038-009634_VR-Chain
  source 1..432: mol_type = other RNA
caggtgcagctggtcgagagcggcgggggcgtggtgcagcccgggcgctccctccggctgagctgcgccgcctccggcttcaccttcaccagcttcgggatgcactgggtccgccaggcgccgggcaagggcctggagtgggtggccgtgatctcctacgacgggaacaacaagtactacgccgacagcgtcaagggccggttcacgatctcccgcgagaacagcaagaacaccctctacctgcagatgaactccctgcgggccgaggacaccgccgtgtaccactgcgcgaaggacctcggggagagcgagatcgaggagtggacctccgactactacgacttcggccgcgactaccccgggcaggacccccggggcgtgttcggcacgttcgacatctgggggcacggcaccatggtcaccgtgagctcc

SEQ ID NO: 9976 - RNA, 432 nt, synthetic construct
  misc_feature 1..432: note = derived and/or modified sequence opt1 from anti-HIV_cap256-038-006730_VR-Chain
  source 1..432: mol_type = other RNA
caggtgcagctggtcgagagcggcgggggcgtggtgcagcccgggcgctccctccggctgagctgcgccgcctccggcttcaccttcagctccttcgggatgcactgggtccgccaggcgccgggcaagggcctggagtgggtggccgtgatcagcaaggacgggtccgacaacagctacgtcgactccgtgaagggccggttcaccatcagccgcgacaactccaagaacacgctctacctgcagatgaacagcctgcgggccgaggacaccgccgtgtactactgcgcccgcgacctcggggagtccgagaacgaggagtggcccagcgactactacgacttcggccgggactaccccgggcaggacccccgcggcgtcatcggcaccttcgacgtgtgggggcagggcaccatggtgacggtctccagc

SEQ ID NO: 9977 - RNA, 432 nt, synthetic construct
  misc_feature 1..432: note = derived and/or modified sequence opt1 from anti-HIV_cap256-038-004887_VR-Chain
  source 1..432: mol_type = other RNA
caggtgcagctggtcgagagcggcgggggcgtggtgcagcccgggcgctccctccggctgagctgcgccgcctccggcttcagcttctccaccagcgggatgcactgggtccgccaggcgccgggcaagggcatggagtgggtggccgtgatctcctacgacgggagcaacaagtactacgccgactccgtcaagggccggttcaccatcagccgcgacaactccaagaacacgctgtacctccagatgaacagcctgcgggccgtggacaccgccgtgtactactgcgcgaaggacctgggggagggcgagaacgaggagtgggccaccgactactacgacttctccatcgggtaccccgtccagaacccccgcggcctcgtgggcgccttcgacatctgggggcagggcaccatggtgacggtcagctcc

SEQ ID NO: 9978 - RNA, 432 nt, synthetic construct
  misc_feature 1..432: note = derived and/or modified sequence opt1 from anti-HIV_cap256-038-004840_VR-Chain
  source 1..432: mol_type = other RNA
caggtgcagctggtcgagagcggcgggggcgtggtgcagcccgggcgctccctccggctgagctgcgccgcctccggcttcaccttcagctccttcgggatgcactgggtccgccagagcccgggcaagggcctggagtgggtggcggtgatctcctacgacgggaacaacaagtactacgccgacagcgtcaagggccggttcaccatctcccgcgagaacagcaagaacacgctctacctgcagatgaactccctgcggaccgacgacaccgccgtgtactactgcgccaaggacctcggggagagcgagaccgaggagtggccctccgactactacgacttcggccgcgactaccccgggcaggacccccggggcgtggtcggcacgttcgacatctgggggcacggcaccatggtgaccgtgagctcc

SEQ ID NO: 9979 - RNA, 432 nt, synthetic construct
  misc_feature 1..432: note = derived and/or modified sequence opt1 from anti-HIV_cap256-038-002181_VR-Chain
  source 1..432: mol_type = other RNA
gaggtgcagctggtcgagagcggcgggggcctcgtgcagcccgggcgctccctgcggctgagctgcgccgcctccggcttcaccttcgaggactacgcgatgcactgggtgcgccaggccccggggaagggcctcgagtgggtcgccgtgatcagctacgacggctccaacaagtactacgtggacagcgtcaaggggcggttcaccatctcccgcgacaacagcaagaacacgctgtacctgcagatgaactccctccgggccgaggacaccgccgtgtactactgcgcgaaggacctgggcgagagcgagaacgaggagtgggccaccgactactacgacttctccatcgggtaccccggccaggacccccgcggggtggtcggcatcttcgacatctggggccaggggaccatggtgacggtgagctcc

SEQ ID NO: 9980 - RNA, 432 nt, synthetic construct
  misc_feature 1..432: note = derived and/or modified sequence opt1 from anti-HIV_cap256-038-001902_VR-Chain
  source 1..432: mol_type = other RNA
caggtgcagctggtcgagagcggcgggggcgtggtgcagcccgggcgctccctccggctgagctgcgccgcctccggcttcaccttcagctccttcgggatgcactgggtccgccaggcgccgggcaagggcctggagtgggtggccgtgatcagctacgacgggaacaacaagtactacgccgactccgtcaagggccggttcaccatcagccgcgagaactccgagaacacgctctacctgcagatgaacagcctgcgggccgacgacaccgccgtgtactactgcgcgaaggacctcggggagtccgagaacgaggagtgggccagcgactactacgacttcggccgcgactaccccgggcaggacacccggggcgtggtcggcaccttcgacatctgggggcacggcacgatggtgaccgtgtccagc

SEQ ID NO: 9981 - RNA, 432 nt, synthetic construct
  misc_feature 1..432: note = derived and/or modified sequence opt1 from anti-HIV_cap256-038-000976_VR-Chain
  source 1..432: mol_type = other RNA
caggtgcagctggtcgagagcggcgggggcgtggtgcagcccgggcgctccctccggctgagctgcgccgcctccggcttcaccttcagctccttcgggatgcactgggtccgccaggcgccgggcaagggcctggagtgggtggccgtgatcagcgacgacgggaacaacaagtactacgccgactccgtcaagggccggttcaccatcagccgcgacaactccaagaacacgctctacctgcagatgaacagcctgcgggtggaggacaccgccgtgtactactgcgtcaaggacgtgggggagtccgagaacgaggagtgggccagcgactactacgacttcggccgcgactaccccgggcaggacacccgggcggtggtcggcgccttcgacatctggggccaggggaccatggtgacggtgtccagc

SEQ ID NO: 9982 - RNA, 432 nt, synthetic construct
  misc_feature 1..432: note = derived and/or modified sequence opt1 from anti-HIV_cap256-038-000384_VR-Chain
  source 1..432: mol_type = other RNA
caggtgcagctggtcgagagcggcgggggcgtggtgcagcccgggaagtccctccgcctgagctgcgccgcctccggcttcaccttcagctcctacgtcatgcactgggtgcggcaggcgccggggaagggcctggagtgggtggccgacatcagctacgacggctccaacaagtactacgccgacagcgtcaaggggcgcctcaccatctcccgggacaacagcaagaacacgctgtacctgcagatgaactccctccgcgccgaggacaccgccgtgtactactgcgtgaaggacctgggcgagagcgagaaggaggagtggccctccgactactacgacttcgggcgggactaccccggccaggacagccgcggggtcgtgggcgtgttcgacatctggggccaggggaccatggtcaccgtgtccagc

SEQ ID NO: 9983 - RNA, 321 nt, synthetic construct
  misc_feature 1..321: note = derived and/or modified sequence opt1 from anti-HIV_206-314431_VR-Chain
  source 1..321: mol_type = other RNA
cagttcgtgctgacccagcccccgagcgtctccgccgcccccggccagaacgtgaccatcagctgctccgggccgcccagccacatcgagaagaacgacgtgtcctggtaccagcgcctccccggcatggcgcccaagatggtcatctacgagagccggcgccggcccctggggatccccgtgcgcttcacggcctcccggagcggctccagcgccaccctggtgatcaccgggctccagaccgccgacgaggccgactactactgcggcacgtgggacggccgcatgaacttcgggaccggcaccaccgtcacggtgctg

SEQ ID NO: 9984 - RNA, 321 nt, synthetic construct
  misc_feature 1..321: note = derived and/or modified sequence opt1 from anti-HIV_206-247594_VR-Chain
  source 1..321: mol_type = other RNA
cagagcatcctgacccagcccccgtccgtgagcgccgcccccggccagaacgtcaccatctcctgcagcgggccgccctcccacatcgagaagaacgacgtgagctggtaccagcgcttccccggcatggcgcccaagatgatcatctacgagtccaagcggcgccccttcggggtgcccggccggttcagcgcctcccgcagcgggaagtccgccacgctcgccatcaccggcctgcagaccggcgacgaggccgactactactgcgggacctgggacggccggatgaacttcgggacgggcaccaccgtcaccgtgctg

SEQ ID NO: 9985 - RNA, 321 nt, synthetic construct
  misc_feature 1..321: note = derived and/or modified sequence opt1 from anti-HIV_206-116890_VR-Chain
  source 1..321: mol_type = other RNA
cagagcgtgctgacccagcccccgtccgtcagcgccgcccccggccagaacgtgaccatctcctgcagcgggccgccctcccacatcgagaagaacgacgtgagctggtaccagcacctccccggcgaggcgcccaagatgatcatctacgagtcctggcgccggcccgccgggatccccgcccgcttcagcgcctcccggagcggcaagtccgggacgctggccatcaccggcctgcagaccggcgacgaggcggactactactgcgggacctggaacggccgcatgaacttcgggacgggcaccaccgtcaccgtgctc

SEQ ID NO: 9986 - RNA, 333 nt, synthetic construct
  misc_feature 1..333: note = derived and/or modified sequence opt1 from anti-HIV_206-072383_VR-Chain
  source 1..333: mol_type = other RNA
cagagcgtgctgacccagcccccgtccgtcagcgccgcccccggccagcgcgtgatcatctcctgcagcgggaacaactccaccatcggcaacaacttcgtgagctggtaccagcaggtccccgggacggcgcccaagctcctgatctacgagaccaaccggcgcccgtccggcatccccgaccggttcagcgggtccaagagcggcacctccgccaccctggccatcagcggcctccagacgggggacgaggccgacttctactgcaccgtgtggggcgtgcgcaagggggtcgccgcggtgttcggcaccgggacccggctgacggtgctg

SEQ ID NO: 9987 - RNA, 333 nt, synthetic construct
  misc_feature 1..333: note = derived and/or modified sequence opt1 from anti-HIV_206-037527_VR-Chain
  source 1..333: mol_type = other RNA
cagagcgtgctgacccagcccccgtccgtcagcgccgcccccggccagaaggtgatcatctcctgcagcgggaacaactccaccatcggcaagatcctcgtgagctggtaccagcaggtccccgggacggcgcccaagctggtgatctacgagaccaaccgccggccgtccggcatccccgaccgcttcagcgggtccaagagcggcacctccgccaccctggccatcacgggcctccagaccggggacgaggccgactacttctgcaaggtgtggggcgtccggaagggggtggccgcggtgttcggcaccgggaccaaggtcacggtgctg

SEQ ID NO: 9988 - RNA, 333 nt, synthetic construct
  misc_feature 1..333: note = derived and/or modified sequence opt1 from anti-HIV_206-009095_VR-Chain
  source 1..333: mol_type = other RNA
cagagcgtgctgacccagcccccgtccgtcagcgccgcccccgcgcagcgcgtgatcatctcctgcagcggcgacaactccaccatcgggaacaacttcgtgagctggtaccagcaggtccccggcgccgcccccaagctcctgatctacgagacgaaccggcgcccgtccgggatccccgaccggttcagcggctccaagagcgggaccaccgccaccctggccatctccggcctccagacgggcgacgaggcggactaccactgcaccgtgtggggcgtgcgcaagggggtcgccgccgtgttcgggaccggcaccaaggtgacggtcctg

SEQ ID NO: 9989 - RNA, 321 nt, synthetic construct
  misc_feature 1..321: note = derived and/or modified sequence opt1 from anti-HIV_176-503620_VR-Chain
  source 1..321: mol_type = other RNA
cagagcgtgctgacccagcccccgtccgtcagcaccgcccccggccagacggtgaccgtgtcctgcagcgggggcacctccaacaccgggaacaacttcgtcagctggtaccagcacctccccggcacggcccccaagctgctgatctacgagaacaacaagcgcccgctcggggtgcccgaccggttctccggcgccaagagcggcacctccgcgaccctggccctgaccgggctccagacgggcgacgagggggactactactgcgccacctggagcggctccctgaacatcgggaccggcaccaaggtgagcgtcctg

SEQ ID NO: 9990 - RNA, 321 nt, synthetic construct
  misc_feature 1..321: note = derived and/or modified sequence opt1 from anti-HIV_176-478726_VR-Chain
  source 1..321: mol_type = other RNA
cagagcgtgctgacccagcccccgtccgtcagcgccgcccccggccagaacgtgaacatctcctgcagcgggccgccctcccacatcgagcgcaacgacgtgagctggtaccagcacctccccggcgcggcccccaagatgatcatctacgagtcctggcggcgccccgccgggatccccgaccggttcagcgcctcccgcagcggcgcctccgcgaccctggccatcacggggctgcagaccggcgacgaggccgactactactgcggcacctggaacgggcggatgaacttcggcaccgggacgaccgtcaccgtgctc

SEQ ID NO: 9991 - RNA, 321 nt, synthetic construct
  misc_feature 1..321: note = derived and/or modified sequence opt1 from anti-HIV_176-245056_VR-Chain
  source 1..321: mol_type = other RNA
cagagcgtgctgacccagcccccgtccgtcagcgccgcccccggccagaacgtgaccatctcctgcagcgggccgccctcccacatcgagaagaacggcgtgagctggtaccagcagttccccgggatggcgcccaagatggtcatctacgagtccaagcgccggcccttcggcgtgcccgcccgcttcagcgcctcccggagcgggaagtccgccacgctcgccatcaccggcctgcagaccggcgacgaggcggactactactgcgggacctgggacggccgcatgaacttcgggacgggcaccaccgtgaccgtcctg

SEQ ID NO: 9992 - RNA, 321 nt, synthetic construct
  misc_feature 1..321: note = derived and/or modified sequence opt1 from anti-HIV_176-164413_VR-Chain
  source 1..321: mol_type = other RNA
cagagcgtgctgacccagcccccgtccgtcagcgccgcccccggccagaaggtgaccatctcctgcagcgggggcacgtccaacatcgggaacaactacgtgagctggtaccagcgcctccccggcaccgcgcccaagctgctgatctacgagaacaacaagcggccgtccgggatccccgaccgcttcagcggccccaagtccggcaccagcgccaccctcgccatcacggggctgcagcccggcgacgaggccgactactactgcgccacctggtccgggagcctgaacttcggcaccgggaccaaggtcacggtgctc

SEQ ID NO: 9993 - RNA, 333 nt, synthetic construct
  misc_feature 1..333: note = derived and/or modified sequence opt1 from anti-HIV_176-094308_VR-Chain
  source 1..333: mol_type = other RNA
cagagcgtgctgacccagcccccgtccgtcagcgccgcccccggccagaaggtgatcatctcctgcagcgggaacaactccaccatcggcaacaacttcgtgagctggtaccagcaggtccccgggacggcgcccaagctcctggtgtacgagacctaccgccggccgtccggcatccccgaccgcagctccgggagcaagtccggcaccaccgccacgcaggccatcagcggcctgcagaccggggacgaggccgactaccactgcaccgtgtggggcgtccggaagggggtggccgcggtgttcggcaccgggacgaaggtcaccgtgctc

SEQ ID NO: 9994 - RNA, 333 nt, synthetic construct
  misc_feature 1..333: note = derived and/or modified sequence opt1 from anti-HIV_176-065321_VR-Chain
  source 1..333: mol_type = other RNA
cagagcgtgctgacccagcccccgtccgtcagcgccgcccccggccgccgggtgatcatctcctgcagcgggaacaactccaccatcggcaacaacttcgtgagctggtaccagcaggtccccgggacggcgcccaagctcctggtgtacgagaccaaccgccggccgtccggcatccccgaccgcttcagcgggtccaagagcggcacctccgccaccctggccatcagcggcctccagacgggggacgaggccgactactactgcaccgtgtggggcgtccggaagggggtggccgcggtgttcggcaccgggaccaaggtcacggtgctg

SEQ ID NO: 9995 - RNA, 324 nt, synthetic construct
  misc_feature 1..324: note = derived and/or modified sequence opt1 from anti-HIV_119-099719_VR-Chain
  source 1..324: mol_type = other RNA
cagagcgtgctgacccagcccccgtccgtcagcgccgcccccggccagaaggtgaccatctcctgcagcgggtccaacagctacatcggcaacaagtacatctcctggtaccagcagttccccgggacggcgcccaagctcctgatctacgagaacaacaagcgcccgagcggcgtgcccgaccggttctccgccagcaagtccgccaccagcgccaccctggccatcaccgggctccacacgggcgacgaggcggactactactgcgagacctgcgacggctccgggggcgtcttcgggaccggcaccaaggtgacggtgctg

SEQ ID NO: 9996 - RNA, 327 nt, synthetic construct
  misc_feature 1..327: note = derived and/or modified sequence opt1 from anti-HIV_119-099536_VR-Chain
  source 1..327: mol_type = other RNA
gagctgacccagcccccgagcgtgtccgccgccagcggccagaacgtcaacatctcctgcagcgggggctccagcaacatcgggtccaactacgtgagctggtaccagcagttccccggcaccgcgcccaagctcctgatctacgagacgaacaagcgcccctccgggatcccggaccggttcagcggctccaagagcggcgcctccgccaccctggccatcaccgggctccagaccggcgacgaggccgactactactgcgcgacgtgggccgacagcctgaactccgcccgcgtgttcgggaccggcaccaaggtcaccgtgctg

SEQ ID NO: 9997 - RNA, 333 nt, synthetic construct
  misc_feature 1..333: note = derived and/or modified sequence opt1 from anti-HIV_119-098907_VR-Chain
  source 1..333: mol_type = other RNA
cagagcgtgctgacccagcccccgtccgtcagcgccacccccggccagaaggtgacgatctcctgcagcgggtccaacagcaacatcggcgacaagtacgtgtcctggtaccagcacttccccgggaccgcccccaagctcctggtctacgagacctaccgccggccgagcggcatccccgaccgcttctccgggagcaagtccggcaccagcgcgacgctggccatcaccggcctccagaccggggacgaggccgactactactgcaccatctggggcgtgcggaagggggtgggcgccgtcttcgggacgggcaccaaggtgatcgtgctg

SEQ ID NO: 9998 - RNA, 324 nt, synthetic construct
  misc_feature 1..324: note = derived and/or modified sequence opt1 from anti-HIV_119-098555_VR-Chain
  source 1..324: mol_type = other RNA
cagagcgtgctgacccagcccccgtccgtcagcgccgcccccggccagaacgtgaccatctcctgcagcgggtccgcgagcaacatcggcaagaacttcgtgtcctggtaccagcagctccccgggacggcccccaagctgctgatctacggcagcaacaaccgcccgtccggggtccccgaccggttcagcggctccaagagcggcacctccgccagcctcgccatcaccgggctgcagaccggcgacgaggccgactactactgcgagacgtgggacgggtccggcgcggtgttcgggaccggcaccaaggtgaccgtcctg

SEQ ID NO: 9999 - RNA, 324 nt, synthetic construct
  misc_feature 1..324: note = derived and/or modified sequence opt1 from anti-HIV_119-097828_VR-Chain
  source 1..324: mol_type = other RNA
cagagcgtgctgacccagcccccgtccgtcagcgccgcccccggccagaaggtgaccatctcctgcagcgggtccagctccaacatcggcaagaactacgtgagctggtaccagctcctgcccgggacggcgccccgcctggtcatctacgagaacgacgagcggccgtccggcacccccgaccgcttcagcgggtccaagagcggcacctccgccaccctcgccatcacgggcctgcacaccggggacgaggccgactactactgcgagacctgggacggcagcgggggcgtgttcgggaccggcacgaaggtgaccgtcctg

SEQ ID NO: 10000 - RNA, 324 nt, synthetic construct
  misc_feature 1..324: note = derived and/or modified sequence opt1 from anti-HIV_119-096480_VR-Chain
  source 1..324: mol_type = other RNA
cagagcgtgctgacccagcccccgtccgtcagcggcgcccccgggcagcgcatcaccatctcctgcagcggctccacgagcaacatcgggcagaactacgtgtcctggtaccagcagctccccggcaccgcccccaagctgctgatcagcgacaacaaccggcgcccgtcctggacccccgaccggttcagcgggtccaagagcggcacctccgcgacgctcgccatcaccggcctgcagaccggggacgaggccgactactactgcgagacctgggacggcagcgggggcgtgttcgggcccggcacgcgcgtcaccgtgctg

SEQ ID NO: 10001 - RNA, 324 nt, synthetic construct
  misc_feature 1..324: note = derived and/or modified sequence opt1 from anti-HIV_119-095664_VR-Chain
  source 1..324: mol_type = other RNA
cagagcgtgctgacccagcccccgtccgtcagcgccgcccccggccagaaggtgaccatctcctgcagcgggggcgcggccaacatcgggaagaactccgtgagctggtaccagcagctccccggcacggcccccaagctgctgatctacgacaacaaccgccggccgtccgggacccccgaccgcttcagcggctccaagagcggcacctccgccaccctcgccatcagcgggctgcagacgggcgacgaggcggactactactgcgagacctggcacgggtccggcggggtcttcggcaccggcaccaaggtgacggtgctg

SEQ ID NO: 10002 - RNA, 321 nt, synthetic construct
  misc_feature 1..321: note = derived and/or modified sequence opt1 from anti-HIV_119-095212_VR-Chain
  source 1..321: mol_type = other RNA
cagagcgtgctgacccagcccccgtccgtcagcgccgcccccggccagaaggtgaccatctcctgcagcgggtccacgagcaacatcggcaagtccgacgtgttctggtaccagcagctccccgggaccgcgcccaagctgctgatcagcgagacctcccgccggccgagcggcatccccgaccgcttctccggggccaagagcggcacctccgccacgctcgccatcaccggcctgcagaccggggacgaggccgactacttctgcagcacctggtccggcagcctgaacttcgggacgggcacccgggtcaccgtgctc

SEQ ID NO: 10003 - RNA, 333 nt, synthetic construct
  misc_feature 1..333: note = derived and/or modified sequence opt1 from anti-HIV_119-094773_VR-Chain
  source 1..333: mol_type = other RNA
cagagcgtgctgacccagtcccccaccgtcagcgccgccccgggccagacggtgaccatctcctgcagcgggggcacctccaacgtggggaagaacttcgtcagctggtaccagcagttcccccgcaccgcgcccaagctcctgatctacgagaacaacaagcggccctccggcatcccggaccgcttcagcgggtccaagagcggcacgtccgccaccctggtgatcaccggcctccagaccggggacgaggccgacttctactgcggcacgtgggacgggagcctgcggaccggcggggtgatcggcaccggcacccgcgtcacggtgctg

SEQ ID NO: 10004 - RNA, 324 nt, synthetic construct
  misc_feature 1..324: note = derived and/or modified sequence opt1 from anti-HIV_119-094508_VR-Chain
  source 1..324: mol_type = other RNA
cagagcgtgctgacccagcccccgtccgtcagcgccacccccggccagcgcgtgacggtgtcctgcagcgggtccagctccaacatcggcaaccactacgtcagctggtaccagcaggtccccgggaccgcccccaagctcctgatctccgagaacagccggcgcccgtccggcacccccgaccggttcagcgggtccaagagcggcacctccgcgacgctggccatcaccggcctccagaccggggacgaggccgactactactgcgagacctgggacggcagcgggggcgtgttcgggacgggcaccaaggtgaccgtgctg

SEQ ID NO: 10005 - RNA, 324 nt, synthetic construct
  misc_feature 1..324: note = derived and/or modified sequence opt1 from anti-HIV_119-093795_VR-Chain
  source 1..324: mol_type = other RNA
cagagcgtgctgacccagcccccgtccgtcagcgccgcccccggccagaaggtgaccatctcctgcagcgggtccagctccaacatcggcaacaactacgtgagctggtaccagtacctccccgggacggcgcccaagctgctgatctccgagaacaaccgccggccgagcggcacccccgaccgcttctccgggagcaagtccggcaccagcgccaccctcgccatcacgggcctgcagaccggggacgaggccgactactactgcgagacctgggacggctccgggggcgtcttcgggaccggcacgaaggtgaccgtgctg

SEQ ID NO: 10006 - RNA, 321 nt, synthetic construct
  misc_feature 1..321: note = derived and/or modified sequence opt1 from anti-HIV_119-093732_VR-Chain
  source 1..321: mol_type = other RNA
cagagcgtgctgacccagcccccgtccgtcagcgccgccgcgggccagaacgtgaacatctcctgcagcgggcgcaagtccaacgtgggcgggaactacgtcagctggtaccagcagttccccggcaccgcccccaagctcctgatctacgaggacaacaagcggccctcctggatcccggaccgcttcacggccagccggtccgggaccagcgccaccctgggcatcaccggcctccagacgggggacgaggccgactacttctgctccacctggagcggctccctgaacttcgggaccggcacccgcgtgacggtgctg

SEQ ID NO: 10007 - RNA, 333 nt, synthetic construct
  misc_feature 1..333: note = derived and/or modified sequence opt1 from anti-HIV_119-092903_VR-Chain
  source 1..333: mol_type = other RNA
cagagcgtgctgacccagcccccgtccgtcagcgccgcgccccgccagaaggtgaccatctcctgcagcggctccagctccaacatcgggaaccactacgtgagctggtaccagcagctccccggcacggcccccaagctgctgatctacgagaacaacaagcggccgtccgggatccccgaccgcttcagcggctccaagagcgggacctccgccaccctcgccatcaccggcctgcagacgggcgacgaggccgactactactgcgccacctgggcgccccggctgaacagcgcccgcgtcttcgggaacggcaccatggtgaccgtgctc

SEQ ID NO: 10008 - RNA, 333 nt, synthetic construct
  misc_feature 1..333: note = derived and/or modified sequence opt1 from anti-HIV_119-092284_VR-Chain
  source 1..333: mol_type = other RNA
cagagcgtgctgacccagcccccgtccgtcagcggcgcccccgggcagcgcgtgaccatctcctgcacgggcagctccagcaacatcgggggctacgacgtgcactggtaccagcaggtccccgggaccgcccccaagctcctgctgtacgagaacgaccggcgcccgtccggcatccccgaccggttcagcggctccaagagcgggacctccgcgaccctcgtgatcacgggcctgcagaccggggacgaggccgacttctactgcggcacctgggacgggagcctgcgcaccggcggcgtgatcgggacgggcacccgggtcaccgtgctc

SEQ ID NO: 10009 - RNA, 333 nt, synthetic construct
  misc_feature 1..333: note = derived and/or modified sequence opt1 from anti-HIV_119-091586_VR-Chain
  source 1..333: mol_type = other RNA
cagagcgtgctgacccagcccccgtccatgagcgccgcccccggccagcgggtcaccatctcctgcagcgggacgtccagcgacatcggccggaactacgtgtcctggtaccagcagttccccggggcggcccccaaggtgctcatctacgagaacagcaaccgcccgtccggcatccccgaccggttcagcgggtccaagagcggcacctccgccaccctggccatcagcggcctgcagaccggggacgaggccgactactgctgcgcggtctggggcgtgcgccgcggggccggcgccgtgttcggggccggcacgaaggtcaccgtgctc

SEQ ID NO: 10010 - RNA, 333 nt, synthetic construct
  misc_feature 1..333: note = derived and/or modified sequence opt1 from anti-HIV_119-091023_VR-Chain
  source 1..333: mol_type = other RNA
cagagcgtgctgacccagcccccgtccgtcagcgccgcccccggccagcgcgtgaccatctcctgcagcgggtccacgagcaacatcggcaacaacttcgtgtcctggtaccaccacgtccccgggaccgcgcccaagctcctgatctacgacaacgtgaagcggccgaccaacgtgcccgaccgcttcagcggctccaagagcgggacctccgccacgctggccatcagcggcctccagaccggcgacgaggccgactactggtgcgccgtctggggcgtgcggcgcggggcgggggccgtgttcggcgccgggaccaaggtcaccgtgctg

SEQ ID NO: 10011 - RNA, 333 nt, synthetic construct
  misc_feature 1..333: note = derived and/or modified sequence opt1 from anti-HIV_119-090334_VR-Chain
  source 1..333: mol_type = other RNA
cagagcgtgctgacccagcccccgtccgtcagcggcgcccccgggcagcgcgtgaccatctcctgcacgggcagcgcctccaacatcggggacagcgacgtgcactggtaccagcagctccccggcaccgcgcccaagctgctgatcttcgacaacgacaagcggccgtccgggatccccgaccgcttcagcggctccaagagcggcacctccgccaccctcgccatcacggggctgcagagcggcgacgaggccgactactactgcgccgtctggggcgtgcggcagggggcgggggccgtgttcggcaccggcaccaaggtcaccgtgctg

SEQ ID NO: 10012 - RNA, 333 nt, synthetic construct
  misc_feature 1..333: note = derived and/or modified sequence opt1 from anti-HIV_119-088694_VR-Chain
  source 1..333: mol_type = other RNA
cagagcgtgctgacccagcccccgtccgtcagcgccgcccccggccagaaggtgaccatctcctgcagcgggtccagctccaacatccccatcaacggcgtgagctggtaccagcagttccccgggacggcgccgaagctcctggtctacgagacctaccgccggccctccggcatccccgaccgcttcagcgggtccaagagcggcacctccgccaccctggccatcacgggcctccagaccggggacgaggccgactactactgcaccgtgtggggcgtgcggaagggggtcggcgccgtgttcgggaccggcacgaaggtgaccgtcctg

SEQ ID NO: 10013 - RNA, 333 nt, synthetic construct
  misc_feature 1..333: note = derived and/or modified sequence opt1 from anti-HIV_119-088499_VR-Chain
  source 1..333: mol_type = other RNA
cagagcgtgctgacccagcccccgtccgtcagcgccgcccccggccagaaggtgaccatctcctgcagcgggtccaacagctacatcggcaacaagtacgtgtcctggtaccagcagttccccgggacggcgcccaagctcctgatctacgagaccaacaagcgcccgagcggcatccccgaccggttctccgggagcaagtccggcaccagcgccaccctggccatcacgggcctccagaccggggacgaggccgactactactgcgccacctgggcgccccgcctgaactccgcccgggtcttcggcaacgggaccatggtgacggtgctg

SEQ ID NO: 10014 - RNA, 333 nt, synthetic construct
  misc_feature 1..333: note = derived and/or modified sequence opt1 from anti-HIV_119-088298_VR-Chain
  source 1..333: mol_type = other RNA
cagagcgtgctgacccagcccccgtccgtcagcgccgcccccaaggagaaggtgaccatctcctgcagcggcgggacgtccaacatcggccgcaactacgtgagctggtaccagcaggtccccgggaccgcgcccaagctcctgatctacgagaacaacaagcggccgtccggcatccccgaccgcttcagcgggtccaagagcggcacctccgccaccctggtgatcacgggcctccagaccggggacgaggccgacttctactgcggcacctggggcgggagcctgcggaccgggggcgtgctgggcacggggacccgcgtcaccgtgctc

SEQ ID NO: 10015 - RNA, 324 nt, synthetic construct
  misc_feature 1..324: note = derived and/or modified sequence opt1 from anti-HIV_119-087488_VR-Chain
  source 1..324: mol_type = other RNA
cagagcgtgctgacccagcccccgtccgtcagcgccgcccccggccagaaggtgaccatcttctgctccgggcgctacagcaacatcgagtccaactacgtgagctggtaccagcagctccccggcacggcgcccaagctgctgatccacgagaacaaccggcgcccgtccgggacccccgaccggttcagcggctccaagagcgggacctccgccaccctcgccatcacgggcctgcacaccggcgacgaggccgactactactgcgagacctgggacgggagcggcggggtcttcggcaccgggacgaaggtgaccgtgctg

SEQ ID NO: 10016 - RNA, 333 nt, synthetic construct
  misc_feature 1..333: note = derived and/or modified sequence opt1 from anti-HIV_119-087423_VR-Chain
  source 1..333: mol_type = other RNA
cagagcgtgctgacccagcccccgtccgtcagcgccgcccccggccagaaggtgaccatctcctgcagcgcgtccagctccaacatcgggaacaactacgtgagctggtaccagcagctccccgccacggcccccaagctgctgatctacgacaccgacaagcgcccgtccggcatccccgaccggttcagcgggtccaagagcggcacctccgccaccctcgccatcacggggctgcagaccggcgacgaggcggactactactgcaccgtctggggcgtgcgcaagggggtgggcgccgtcttcgggaccggcacgaaggtgaccgtgctg

SEQ ID NO: 10017 - RNA, 324 nt, synthetic construct
  misc_feature 1..324: note = derived and/or modified sequence opt1 from anti-HIV_119-087371_VR-Chain
  source 1..324: mol_type = other RNA
cagagcgtgctgacccagcccccgtccctcagcgccgcccccggccagcgcgtcaccatctcctgcagcgggggcgcgtccaacatcgggaagaacagcgtgtcctggtacgtgcaggtccccggcacggcccccaagctgctgatctacgagaacaaccagcggccgagcgggatctccgaccgcttcagcggctccaagagcggctccagcgccaccctcgggatcaccggcctgcagaccgccgacgaggccgactactactgcgagacgtgggacgggtccggcggggtgttcggcaccggcaccaaggtgaccgtcctg

SEQ ID NO: 10018 - RNA, 321 nt, synthetic construct
  misc_feature 1..321: note = derived and/or modified sequence opt1 from anti-HIV_119-087279_VR-Chain
  source 1..321: mol_type = other RNA
cagagcgtgctgacccagcccccgtccgtcagcgccgcccccggccagaaggtgaccatctcctgcagcgggtccagctccaacatcggcaagaactacgtgagctggtaccagcagttccccgggacggcgcccaagctcctgatgtacgagaacaacaagcgcccgtccggcgtccccgaccggttcagcgggtccaagagcggcacctccgccaccctggacatcagcggcctccagaccggggacgaggccgactactactgctccacgtggagcggctccctgaacttcgggaccggcacccgcgtgaccgtgctg

SEQ ID NO: 10019 - RNA, 324 nt, synthetic construct
  misc_feature 1..324: note = derived and/or modified sequence opt1 from anti-HIV_119-087146_VR-Chain
  source 1..324: mol_type = other RNA
cagagcgtgctgacccagcccccgtccgtcagcgccgcccccggccagaaggtgaccatctcctgcagcgggtccagctccaacatcggcaagaacagcgtgtcctggtaccagcagttccccgggacggcgcccaagctcctgatctacgagaacaacaagcgcccgagcggcatccccgaccggttctccgggagcaagtccggcaccagcgccaccctggccatcaccggcctccacacgggggacgaggccgactactactgcgagacctgggacggctccgggggcgtcttcgggaccggcaccaaggtgacggtgctg

SEQ ID NO: 10020 - RNA, 324 nt, synthetic construct
  misc_feature 1..324: note = derived and/or modified sequence opt1 from anti-HIV_119-087048_VR-Chain
  source 1..324: mol_type = other RNA
cagttcgtgctgacccagcccccgagcgtctccgccgcgccccgccagaaggtgatcatcagctgctccggcagctccagcaacatcgggaagaactacgtgtcctggtaccagcagctccccggcaccgcccccaagctgctgatctacgacaacgacaagcggccgagcgggatctccgaccgcttcagcgcctccaagagcggcacgtccgccaccctcgccatcaccgggctgcacaccggcgacgaggccgactactactgcgagacgtgggacggcagcgggggcgtcttcgggaccggcaccaaggtgaccgtgctg

SEQ ID NO: 10021 - RNA, 321 nt, synthetic construct
  misc_feature 1..321: note = derived and/or modified sequence opt1 from anti-HIV_119-085802_VR-Chain
  source 1..321: mol_type = other RNA
cagagcatcctgacccagcccccgtccgtgagcgccgcccccggccagcgcgtcaccatcccctgcttcgggggccactccaacatcgggagcaactacgtgtcctggtaccagcacctccccggcacggcgccgaagctgctgatcttcgagaacaacaagcggcccagcgggatccccgaccgcttctccggcgccaagagcggcacctccgccaccctcgccatcaccgggctgcagacgggcgacgaggccgactacttctgcgcgacctggagcgggggcctgaacttcgggaccggcaccaaggtgacggtcctc

SEQ ID NO: 10022 - RNA, 324 nt, synthetic construct
  misc_feature 1..324: note = derived and/or modified sequence opt1 from anti-HIV_119-085784_VR-Chain
  source 1..324: mol_type = other RNA
cagagcttcctgacccagcccccgtccgtgagcgccgcccccggccagaaggtcaccatctcctgcagcgggtccaacagcaacatcggcaacaactacgtgtcctggtaccagtacctccccgggacggcgcccaagctgctgatctacgagaacgaccgccggccgagcggcacccccgaccgcttctccgggagcaagtccggcaccagcgccaccctcgccatcacgggcctgcagaccggggacgaggccgactactactgcgagacctgggacggctccgggggcgtgttcgggaccggcacgaaggtcaccgtgctg

SEQ ID NO: 10023 - RNA, 333 nt, synthetic construct
  misc_feature 1..333: note = derived and/or modified sequence opt1 from anti-HIV_119-085370_VR-Chain
  source 1..333: mol_type = other RNA
cagagcgtgctgacccagcccccgtccgtcagcgccgcccccggccagaccgtgacgatctcctgcagcgggtccagctccaacatcggcaacacctacgtgagctggtaccagcacctccccgggaccgcgcccaagctgctgatctacgacaacaacatccgcccgtccggcatccccgaccggttcagcgcctccaagagcgggacctccgccacgctcgccatcaccggcctgcagaccggcgacgaggccgactactactgcgcgacctgggcccccagcctgaactccgcccgcgtcttcgggagcggcacgcgggtggccgtgctc

SEQ ID NO: 10024 - RNA, 321 nt, synthetic construct
  misc_feature 1..321: note = derived and/or modified sequence opt1 from anti-HIV_119-085276_VR-Chain
  source 1..321: mol_type = other RNA
cagagcatcctgacccagcccccgtccgtgagcgccgcccccggccagcgcgtcaccatctcctgcagcgggtccagctccaacatcggcaacaactacgtgagctggtaccagcacgtgcccgggacggcgcccaagctcctgatctacgagaacaaccggcgcccgtccggcacccccgaccggttcagcggggccaagtccggcaccagcgccaccctggccatcacgggcctccagaccggggacgaggccgactacttctgctccacctggagcggctccctgaacttcgggaccggcacgaaggtcaccgtgctg

SEQ ID NO: 10025 - RNA, 333 nt, synthetic construct
  misc_feature 1..333: note = derived and/or modified sequence opt1 from anti-HIV_119-084885_VR-Chain
  source 1..333: mol_type = other RNA
cagagcgtgctgacccagcccccgtccgtcagcgccgcccccggcgagaaggtgaccatctcctgcagcgggtccagctccaagatcggcaacaacttcgtgagctggtaccagcaggtccccgggacggcgcccaagctcctggtgtacgagtcctaccgccggccgagcggcatccccgaccgcttctccgggagcaagtccggcaccagcgccaccctggccatcaccggcctccagacgggggacgaggccgactactactgcaccgtgtggggcgtccggaagggggtgggcgccgtgttcgggaccggcaccaaggtcacggtgctg

SEQ ID NO: 10026 - RNA, 333 nt, synthetic construct
  misc_feature 1..333: note = derived and/or modified sequence opt1 from anti-HIV_119-084874_VR-Chain
  source 1..333: mol_type = other RNA
cagagcgtgctgacccagcccccgtccgtcagcggcgcgccccgccagcgggtgaccatctcctgcagcgggtccgccagcaacatcggcaagaactccgtgagctggtaccagcaggtccccgggacggcccccaagctcctgatctacgagaacaacaagcgcccgtccggcatccccgaccggttcagcgggtccaagagcggcacctccgccaccctggtgatcaccggcctccagacgggggacgaggccgacttctactgcggcacctgggacgggagcctgcgcaccggcggggtgatcggcaccggcacgcgggtcaccgtgctg

SEQ ID NO: 10027 - RNA, 333 nt, synthetic construct
  misc_feature 1..333: note = derived and/or modified sequence opt1 from anti-HIV_119-084691_VR-Chain
  source 1..333: mol_type = other RNA
cagagcgtgctgacccagcccccgtccgtcagcgccgcccccggccagaaggtggtgatctcctgcagcgggtccagctccatcatcgagaagaacagcatctcctggtaccagcagggccccggggcggcccccaagctcctgatctacgagaacgacaagcggccgagcggcatccccgaccggttctccgggagcaagtccgccaccagcgccacgctggccatcgtcggcctccagaccggcgacgaggcggactactgctgcgccgtgtggggcgtgcgccgcggggccggggccgtcttcggcgcggggaccaaggtgaccgtgctg

SEQ ID NO: 10028 - RNA, 324 nt, synthetic construct
  misc_feature 1..324: note = derived and/or modified sequence opt1 from anti-HIV_119-083793_VR-Chain
  source 1..324: mol_type = other RNA
cagagcgtgctgacccagcccccgtccgtcagcgccgcccccggccagaaggtgaccatctcctgcagcgggtccagctccaacatcggcaagaacagcgtgtcctggtaccagcagctccccgcgacggcccccaagctgctgatctacgagagcaacaagcgcccgtccgggatccccgaccggttcagcggctccaagagcgggacctccgccaccctcgccatcaccggcctgcagacgggcgacgaggccgactactactgcgcgacctgggacgggcgcgtcagcgtgatcggcaccgggaccaaggtgacggtcctg

SEQ ID NO: 10029 - RNA, 324 nt, synthetic construct
  misc_feature 1..324: note = derived and/or modified sequence opt1 from anti-HIV_119-083163_VR-Chain
  source 1..324: mol_type = other RNA
cagagcgtgctgacccagcccccgtccgtcagcggcgcccccgggcagcgcgtgatcatctcctgcaccggcagctccagcaacatctgggggtacgacgtgcagtggtaccagcagctccccggcacggcccccaagctgctgctctacgagaacgaccggcgcccgtccgggacccccgaccggttcagcggctccaagagcggcacctccgcgaccctggccatcacggggctgcacaccggcgacgaggccgactactactgcgagacctgggacgggagcggcggggtcttcggcaccggcacgaaggtgaccgtgctc

SEQ ID NO: 10030 - RNA, 333 nt, synthetic construct
  misc_feature 1..333: note = derived and/or modified sequence opt1 from anti-HIV_119-082331_VR-Chain
  source 1..333: mol_type = other RNA
cagagcgtgctgacccagcccccgtccatcagcgccgcccccggccagaaggtcaccatctcctgcagcgggggctccagcaacatcggggcgaactacgtgtcctggtaccagcacctccccggcacggcccccaagctgctgatctacgagaccaacaagcgcccgagcgggatccccgaccggttctccggcagccagtccggcaccagcgccaccctcgtgatcacggggctgcagaccggcgacgaggccgacttctactgcgggacctggggcgggtccctgcgcgccggcggcgtcatcgggaccggcacgcgggtgaccgtgctc

SEQ ID NO: 10031 - RNA, 324 nt, synthetic construct
  misc_feature 1..324: note = derived and/or modified sequence opt1 from anti-HIV_119-082070_VR-Chain
  source 1..324: mol_type = other RNA
cagagcgtgctgacccagcccccgtccgtcagcgccgcccccggccagaaggtggtgatctcctgcagcgggtccagctccatcatcgagaagaacagcatctcctggtaccagcagggccccggggcggcccccaagctcctgatctacgagaacgaccgccggccgagcggcacccccgaccgcttctccgggagcaagtccggcacgagcgccaccctggccatcaccggcctccagaccggggacgaggccgactactactgcgagacgtgggacggctccgggggcgtcttcgggaccggcaccaaggtgaccgtgctg

SEQ ID NO: 10032 - RNA, 333 nt, synthetic construct
  misc_feature 1..333: note = derived and/or modified sequence opt1 from anti-HIV_119-081512_VR-Chain
  source 1..333: mol_type = other RNA
cagagcgtgctgacccagcccccgtccgtcagcgccgcccccggccagaacgtgaccttctcctgcagcgggtccaacagcaacatcggcgacaactacgtgtcctggtaccagcagatccccgggacggcgcccaagctcgtcatctacgacaacaacaagcgcccgagcggcatccccgaccggttctccgggagcaagtccggcaccagcgccaccctggtgatcaccggcctgcagacgggggacgaggccgacttctactgcggcacctgggacgggtccctccgcaccggcggggtgatcggcaccggcacgcgggtcaccgtgctg

SEQ ID NO: 10033 - RNA, 333 nt, synthetic construct
  misc_feature 1..333: note = derived and/or modified sequence opt1 from anti-HIV_119-080816_VR-Chain
  source 1..333: mol_type = other RNA
cagctggtgctcacccagcccccgagcgcctccggcacccccgggcagcgcgtcacgatcagctgctccggcagctccagcaacatcgggtccaacttcgtgagctggtaccagcagcggcccggcaccgcccccaagctgctgatctacgagaccaacaagcgcccgtccgggatccccgaccggttcagcggctccaagagcggcacctccgcgacgctcgccatcaccgggctgcagaccggcgacgaggccgactactactgcgccacctgggcgccccgcctgaacagcgcccgggtgttcgggaacggcacgatggtcaccgtgctc

SEQ ID NO: 10034 - RNA, 333 nt, synthetic construct
  misc_feature 1..333: note = derived and/or modified sequence opt1 from anti-HIV_119-079302_VR-Chain
  source 1..333: mol_type = other RNA
cagagcgtgctgacccagcccccgtccgtcagcgccgcccccggccagaaggtgaccatctcctgcagcgggtccagctcctacatcggcaacaagtacgtgagctggtaccagcagttccccgggacggcgcccaagctcctgatctacgagaacaacaagcgcctgtccggcatcccggaccggttcagcgcctccaagagcgccacctccgccaccctcgccatcagcgggctgcagaccggcgacgaggcggacttctactgcggcacgtgggacgggtccctgcgcaccggcggggtcatcggcaccgggacccgggtgacggtgctc

SEQ ID NO: 10035 - RNA, 327 nt, synthetic construct
  misc_feature 1..327: note = derived and/or modified sequence opt1 from anti-HIV_119-079292_VR-Chain
  source 1..327: mol_type = other RNA
cagagcgtgctgacccagcccccgtccgtcagcgccgcccccggccagaaggtgaccatctcctgcagcgggtccaacagcaacatcggcaacaactacgtgtcctggtaccagcagctccccgggacggcgcccaagctgctgatctacgacaacaacaagcgcccgagcggcatccccgaccggttctccgggagcaagtccggcaccagcgccaccctcggcatcaccgggctgcagacgggcgacgaggccaactactactgcgggacctgggacacctccctgagcggcgtcttcgggaccggcacggaggtgatcgtgctc

SEQ ID NO: 10036 - RNA, 321 nt, synthetic construct
  misc_feature 1..321: note = derived and/or modified sequence opt1 from anti-HIV_119-079289_VR-Chain
  source 1..321: mol_type = other RNA
cagagcgccctgacccagcccccgtccgtgagcgccgcgcccggccagcgcgtcaccatctcctgcagcgggaacaactccaacatcggcaacaacttcgtgagctggtaccagctcctgcccgggacggcccccaagctgctcatctacgagaacaacaagcggtccagcggcatcccggaccgcttctccgggagcaagtccggcaccagcgccaccctgggcatcaccgggctgcagacgggcgacgaggccgactacttctgctccacctggagcgggtccctcaacttcggcaccgggacccgggtgacggtcctg

SEQ ID NO: 10037 - RNA, 324 nt, synthetic construct
  misc_feature 1..324: note = derived and/or modified sequence opt1 from anti-HIV_119-078935_VR-Chain
  source 1..324: mol_type = other RNA
cagagcgtgctgacccagcccccgtccgtcagcgccgcccccggccagcgcgtgaccatctcctgcagcgggacgtccgcgaacatcgagaactactacgtgagctggtaccagcagctccccggcaccgcccccaagctgatcatctacgacgacaacaagcggccgtccgggatcccccagcgcttcagcggctccaagagcgggacctccgccaccctgggcatcacgggcctccagaccggggacgaggccgagtactactgcgagacctgggacggcagcgggggcgtcttcgggaccggcacgaaggtgaccgtgctg

SEQ ID NO: 10038 - RNA, 324 nt, synthetic construct
  misc_feature 1..324: note = derived and/or modified sequence opt1 from anti-HIV_119-078702_VR-Chain
  source 1..324: mol_type = other RNA
cagagcgtgctgacccagcccccgtccgtcagcgccgcccccggccagaaggtgaccatctcctgcagcgggtccagctccgtgttcggcaagaactacgtcagctggtaccagcacctccccgggacggcgcccaagctgctgatctacgagaacaccaagcgcccgtccggcatccccgaccggttcagcgggtccaagagcggcacctccgccaccctcgccatcacgggcctgcagaccggggacgaggccgactactactgcgagacctgggacggcagcgggggcgtgttcgggtccggcaccaaggtgacggtcctg

SEQ ID NO: 10039 - RNA, 324 nt, synthetic construct
  misc_feature 1..324: note = derived and/or modified sequence opt1 from anti-HIV_119-078593_VR-Chain
  source 1..324: mol_type = other RNA
cagagcttcctgacccagcccccgtccgtgagcgccgcccccggccagaaggtcaccatctcctgcagcgggtccaacagcaacatcggcaacaactacgtgtcctggtaccagcaggtccccgggacggcgcccaagctcctgatctacgagaacaacaagcgcccgagcggcatccccgaccggttctccgggagcaagtccggcaccagcgccaccctggtgatcaccggcctccacacgggggacgaggccgactactactgcgagacctgggacggctccgggggcgtgttcgggaccggcagcaacgtgaccctgctg

SEQ ID NO: 10040 - RNA, 333 nt, synthetic construct
  misc_feature 1..333: note = derived and/or modified sequence opt1 from anti-HIV_119-077708_VR-Chain
  source 1..333: mol_type = other RNA
cagagcgtgctgacccagcccccgtccctcagcgccgcccccggccagaaggtcaccatctcctgcagcgggacgacctccaacatcggcaacaactacgtgagctggtaccagcacctccccgggaccgcgcccaagctgctgatctacgagaacaccaagcgcccgtccggcatccccgaccggttcagcgggtccaagagcggcacgtccgccaccctgggcatcaccgggctgcagaccggcgacgaggccgactactactgcacggtgtggggcgtccgcaagggggtgggggccgtgttcggcaccggcaccaaggtcaccgtgctc

SEQ ID NO: 10041 - RNA, 321 nt, synthetic construct
  misc_feature 1..321: note = derived and/or modified sequence opt1 from anti-HIV_119-076904_VR-Chain
  source 1..321: mol_type = other RNA
cagagcgtgctgacccagcccccgtccgtcagcgccgcccccggccagaaggtgaccatctcctgcagccgctccagctcccacatcgagaacagctacgtgtcctggtaccagcacctccccgggacggcgcccaagctgctgatctacgagaacaacaagcggccgagcggcatccccgaccgcttctccgggagcaagtccggcaccagcgccaccctcgggatctccggcctgcagaccggcgacgaggccgactacttctgcagcacgtggtccgggagcctgaacttcggcaccgggacccgggtcaccgtgctc

SEQ ID NO: 10042 - RNA, 324 nt, synthetic construct
  misc_feature 1..324: note = derived and/or modified sequence opt1 from anti-HIV_119-075862_VR-Chain
  source 1..324: mol_type = other RNA
cagagcgtgctgacccagcccccgtccatcagcgccgcccccggccagaaggtcaccatctcctgcagcgggtccgcgagcaacatcggcaagaactccgtgagctggtaccagcagttccccgggacggcccccaagctcctgatctacgagaacaaccgccggccgtccggcacccccgaccgcttcagcgggtccaagagcggcacctccgccaccctggccatcacgggcctccagaccggggacgaggccgactactactgcgagacctgggacggcagcgggggcgtgttcgggaccggcacgaaggtcaccgtgctg

SEQ ID NO: 10043 - RNA, 333 nt, synthetic construct
  misc_feature 1..333: note = derived and/or modified sequence opt1 from anti-HIV_119-075465_VR-Chain
  source 1..333: mol_type = other RNA
cagagcgtgctgacccagcccccgtccgtcagcgccgcccccggccagaaggtggtgatctcctgcagcgggtccagctccatcatcggcaacaactacgtcagctggtaccagcagctccccgggaccgcgcccaagctgctgatctacgagaacaaccgccggccgtccggcatccccgaccgcttcagcgggtccaagagcggcacgtccgccaccctcgccatcagcggcctgcagaccggggacgaggccgactactgctgcgccgtgtggggcgtgcggcgcggggcgggcgccgtcttcggggccggcaccaaggtgacggtgctg

SEQ ID NO: 10044 - RNA, 330 nt, synthetic construct
  misc_feature 1..330: note = derived and/or modified sequence opt1 from anti-HIV_119-074822_VR-Chain
  source 1..330: mol_type = other RNA
agcgtgctgacccagcccccgtccgtcagcgccgcccccggccagaacatcaccatctcctgcagcgggggctccagcaacatcgcgaagaactacatctcctggtaccagcacctccccgggacggcccccaagatcgtgatctacgacaacgacaagcggccgctgggcatccccgaccggttcagcgcctccaagagcgggacctccgccaccctgggcatcaccggcctccagacgggggacgaggccgactactactgcgcggtgtggggcgtccgccgcggggtgggcgccgtgttcggggccggcaccaaggtcatcgtgctg

SEQ ID NO: 10045 - RNA, 333 nt, synthetic construct
  misc_feature 1..333: note = derived and/or modified sequence opt1 from anti-HIV_119-074629_VR-Chain
  source 1..333: mol_type = other RNA
cagagcgtgctgacccagcccccgtccgagagcgccgcccccggccagaaggtcaccatctcctgcagcgggggcacgtccaacatcgggaacaactacgtgagctggtaccgccggctccccggcaccgcgcccaagctgctgatctacgagaacaaccgccggccgtccgggatccccgaccgcttcagcggctccaagagcggcacctccgccaccctcgccatcagcgggctgcagacgggcgacgaggccgactactgctgcgccgtgtggggcgtccggcgcggggcgggggccgtgttcggcgccggcaccaaggtgaccgtcctg

SEQ ID NO: 10046 - RNA, 324 nt, synthetic construct
  misc_feature 1..324: note = derived and/or modified sequence opt1 from anti-HIV_119-074500_VR-Chain
  source 1..324: mol_type = other RNA
cagagcgtgctgacccagcccccgtccgtcagcgccgcccccggccagaaggtgaccatgtcctgcagcgggtccagctccaacatcggcaacaactacgtgagctggtaccagtacctccccgggacggcgcccaagctgctgatctacgagaacgaccgccggccgtccggcatccccgaccgcttcagcgcctccaagagcgggacctccgccaccctcgccatcaccggcctgcagacgggcgacgaggccgactactactgcgagacctgggacgggagcggcggggtcttcggcaccgggaccaaggtgacggtgctg

SEQ ID NO: 10047 - RNA, 333 nt, synthetic construct
  misc_feature 1..333: note = derived and/or modified sequence opt1 from anti-HIV_119-073911_VR-Chain
  source 1..333: mol_type = other RNA
cagagcgtgctgacccagcccccgtccgtcagcgccgcccccggccagcgcgtgaccatctcctgcagcgggtccagctccaacatcgagaacaactacgtgagctggtaccagcacctccccggcacggcgcccaagctgctggtctacgacgacaacaagcggccgtccgggatcccccaccgcttcagcgcctccaagagcggcacctccgccaccctcgccatcaccgggctgcagacgggcgacgaggccgactactactgcaccctgtggggcgtgcggaagggggtgggcgcggtcttcgggaccggcaccaaggtgacggtgctc

SEQ ID NO: 10048 - RNA, 324 nt, synthetic construct
  misc_feature 1..324: note = derived and/or modified sequence opt1 from anti-HIV_119-072765_VR-Chain
  source 1..324: mol_type = other RNA
cagagcgtgctgacccagcccccgtccgtcagcgccgcccccggccagaaggtgaccatctcctgcagcgggaactccagcaacatcggcaacaacttcgtgtcctggtaccagcaggtccccgggacggcgcccaagctcctggtgtacgagacctaccgccggccgagcggcacccccgaccgcttctccgggagcaagtccggcaccagcgccacgctggccatctccggcctccagaccggggacgaggccgactactactgcggcacctgggacgggagcggcggggtgttcggcaccggcacgaaggtcaccgtgctg

SEQ ID NO: 10049 - RNA, 333 nt, synthetic construct
  misc_feature 1..333: note = derived and/or modified sequence opt1 from anti-HIV_119-072313_VR-Chain
  source 1..333: mol_type = other RNA
cagttcgtgctgacccagcccccgagcgtctccgccgcccccggccagaaggtgaccatcagctgctccgcgagctccagcatcatcgggaagaactacgtgtcctggtaccagcagttccccggcacggcccccaagctcctgatctacgaggacaacaagcgcccgagcgggatccccgaccggttctccggcagcaagtccgggaccagcgccaccctggccatcaccggcctccagacgggcgacgaggccgactactactgcaccgtctggggcgtgcgcaagggggtgggggcggtcttcggcaccgggaccaaggtgacggtgctg

SEQ ID NO: 10050 - RNA, 333 nt, synthetic construct
  misc_feature 1..333: note = derived and/or modified sequence opt1 from anti-HIV_119-072280_VR-Chain
  source 1..333: mol_type = other RNA
cagagcgtgctgacccagcccccgtccgtcagcgccgcccccggccagaaggtgtccatcagctgctccgggagcgactccaacctcggcgacaactacgtgagctggtaccagcagttccccgggaccgcgcccaagctgctgatccacgacaacaacaagcgcccgtccggcacgcccgaccggttcagcgggtccaagagcggcacctccgccaccctcgccatcaccggcctgcagacgggggacgaggccgactactactgcgccacctgggcgccccgcctgaacagcgcccgggtcttcggcaacgggaccatggtgaccgtgctc

SEQ ID NO: 10051 - RNA, 333 nt, synthetic construct
  misc_feature 1..333: note = derived and/or modified sequence opt1 from anti-HIV_119-071693_VR-Chain
  source 1..333: mol_type = other RNA
cagagcgtgctgacccagcccccgtccgtcagcgccgcccccggccagaaggtggtgatctcctgcagcgggtccagctccatcatcgagaagaacagcatctcctggtaccagcagggccccggggcggcccccaagctcctgatctacgagaacgacaagcgcccgagcggcatccccgaccggttctccgggagcaagtccggcaccagcgccacgctggccatcaccggcctccagaccggggacgaggccgactactactgcaccatctggggcgtccgcaagggggtgggcgcggtgttcgggacgggcaccaaggtcaccgtgctg

SEQ ID NO: 10052 - RNA, 321 nt, synthetic construct
  misc_feature 1..321: note = derived and/or modified sequence opt1 from anti-HIV_119-071353_VR-Chain
  source 1..321: mol_type = other RNA
cagagcgtgctgacccagcccccgtccgccagcgccgcgcccggccagaaggtcaccatctcctgcagcgggtccaacagcaacatcggcaacaacttcgtgtcctggtaccagctgttccccgggacggcccccaagctcctgatcttcgagaacaacaagcgcccgagcggcatccccgaccggttctccggggccaagagcggcacctccgccaccctcgccatcaccggcctgcagacgggggacgaggcggactacttctgcagcacctggtccggcagcctgaacttcgggaccggcacccgcgtgacggtcctc

SEQ ID NO: 10053 - RNA, 324 nt, synthetic construct
  misc_feature 1..324: note = derived and/or modified sequence opt1 from anti-HIV_119-069711_VR-Chain
  source 1..324: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgatctacgacaacaacaaccgcccgtccggcgtccccgaccggttcagcgggtccaagagcggcacctccgccaccctcgccatcaccggcctgcagacgggggacgaggccgactactactgcgagacctgggacgacagcggcggggtgttcggcaccgggaccaaggtgacggtcctg

SEQ ID NO: 10054 - RNA, 333 nt, synthetic construct
  misc_feature 1..333: note = derived and/or modified sequence opt1 from anti-HIV_119-069061_VR-Chain
  source 1..333: mol_type = other RNA
cagagcgtgctgacccagcccccgtccgtcagcgccgcccccggccagaaggtgaccatctcctgcagcgggtccagctccaacatcggcagcaactacgtgtcctggtaccagcagctccccgggacggcgcccaagctgctggtctacgacaacaacgagcgcccgagcggcatccccgaccggttctccgggagcaagtccggcaccagcgccaccctcgccatcaccggcctgcagacgggggacgaggccgactactactgcgccacctgggcgccccgcctgaactccgcccgggtgttcggcaacgggaccatggtgaccgtcctc

SEQ ID NO: 10055 - RNA, 324 nt, synthetic construct
  misc_feature 1..324: note = derived and/or modified sequence opt1 from anti-HIV_119-068202_VR-Chain
  source 1..324: mol_type = other RNA
cagagcgtgctgacccaggagccctccgtcagcggcgccccggggcagcgcgtgaccatctcctgcacgggcagcaactccaacatcgggggccacgacgtgcactggtaccagcagctccccgggaccgcccccaagctgctgatctacgacaacgacaagcggcccagcggcatcccggaccgcttctccggcagcaagtccgacaccagcgcgtccctcgggatcaccggcctgcagacgggggacgaggccgactactactgcgagacctgggacggcagcgggggcgtcttcggcaccgggaccaaggtgacggtgctg

SEQ ID NO: 10056 - RNA, 324 nt, synthetic construct
  misc_feature 1..324: note = derived and/or modified sequence opt1 from anti-HIV_119-068063_VR-Chain
  source 1..324: mol_type = other RNA
cagagcgccctgacccagcccccgtccgccagcggctccctcgggcagagcgtgaccatctcctgcacgggcacccgcagcgacgtcgggaactactacgtgtcctggtaccagcagctgcccggcaccgcgcccaagctgctcatcagcgagaacaaccggcgcccctccgggaccccggaccggttcagcggctccaagagcggcacgtccgccaccctggccatcagcgggctgcagaccggcgacgaggccgactactactgcgggacctgggacggctccgggggcgtgttcggcacggggaccaaggtcaccgtgctc

SEQ ID NO: 10057 - RNA, 333 nt, synthetic construct
  misc_feature 1..333: note = derived and/or modified sequence opt1 from anti-HIV_119-067980_VR-Chain
  source 1..333: mol_type = other RNA
cagagcgtgctgacccagcccccgtccgtcagcgccgcccccggccagaaggtgaccatctcctgcagcgggaactccagcaacatcggcaacaacttcgtgtcctggtaccagcaggtccccgggacggcgcccaagctcctggtgtacgagacctaccgccggccgagcggcatccccgaccgcttctccgggagcaagtccggcaccagcgccaccctggccatcacgggcctccagaccggggacgaggccgactaccactgcgccatctggggcgtgcggaagggggtcggcgcggtgttcgggaccggcaccaaggtgacggtcgtg

SEQ ID NO: 10058 - RNA, 324 nt, synthetic construct
  misc_feature 1..324: note = derived and/or modified sequence opt1 from anti-HIV_119-067866_VR-Chain
  source 1..324: mol_type = other RNA
cagagcgtgctgacccagcccccgtccgtcagcgccgcccccggccagaaggtgaccatctcctgcagcgggtccacgagcaccatcggcaacaactacgtgtcctggtaccagcacctccccgggaccgcgcccaagctgctgatctacgacaacaacaagcgcccggccggcatccccgaccggttcaccgccagcaagtccgggacgagcgccaccctcgccatcaccggcctgcacaccggcgacgaggcggactactactgcgagacgtgggacgggtccggcggggtcttcggcaccgggaccaaggtgaccgtgctg

SEQ ID NO: 10059 - RNA, 321 nt, synthetic construct
  misc_feature 1..321: note = derived and/or modified sequence opt1 from anti-HIV_119-067756_VR-Chain
  source 1..321: mol_type = other RNA
cagagcgtgctgacccagcccccgtccgtcagcgccgcccccggccagaaggtggtgatctcctgcagcgggtccaccagcaacatcggcaagaacttcgtctcctggtaccagcagctccccgggacggcgcccaagctgctgatctacgagaacagccgccggccgtccggcatccccgaccgcttcagcggggccaagtccggcaccagcgccaccctcgccatcaccggcctgcagacgggggacgaggccgactacttctgctccacctggagcggctccctgaacttcgggaccggcacccgggtgacggtgctc

SEQ ID NO: 10060 - RNA, 321 nt, synthetic construct
  misc_feature 1..321: note = derived and/or modified sequence opt1 from anti-HIV_119-066859_VR-Chain
  source 1..321: mol_type = other RNA
cagagcgtgctgacccagcccccgtccgtcagcgccgcccccggccagaaggtgaccatcacgtgctccgggagcgcgtccaacatcgagaacaactacgtgagctggtaccagcagttccccggccccgccccgaagctcctgatctacgagaacgacaagcgcccctccgggatccccgaccggttcagcggctccgccagcgggacctccgccaccctggccatcaccggcctccagacgggcgacgaggcggactacttctgcagcacctggtccgggagcctgaacttcggcaccgggacccgcgtcacggtgctg

SEQ ID NO: 10061 - RNA, 333 nt, synthetic construct
  misc_feature 1..333: note = derived and/or modified sequence opt1 from anti-HIV_119-065821_VR-Chain
  source 1..333: mol_type = other RNA
cagagcgtgctgacccagcccccgtccgtcagcgccacccccggccagcgcgtgacggtgtcctgcagcgggtccagctccaacatcggcaaccactacgtcagctggtaccagcaggtccccgggaccgcccccaagctcctgatctacgacaactccaaccggccgagcggcatccccgaccgcttctccgggagcaagtccggcaccagcgcgaccctgggcatcacggggctccagaccggcgacgaggccgactactactgcaccgtgtggggcgtgcggaagggggtgggggccgtgttcggcaccggcacgaaggtcaccgtgctg

SEQ ID NO: 10062 - RNA, 333 nt, synthetic construct
  misc_feature 1..333: note = derived and/or modified sequence opt1 from anti-HIV_119-065191_VR-Chain
  source 1..333: mol_type = other RNA
cagagcgtgctgacccagcccccgtccgtcagcgccgcccccggccagaaggtgaccatctcctgcagcgggaacaactccaacatcggcaacaactacgtgagctggtaccagcagctccccgggacggcgcccaagctgctgatcttcgagaaccacaagcgcccgtccggcatccccgaccggttcagcgggtccaagagcggcacctccgccaccctcggcatcaccgggctgcagagcggcgacgaggccgactactactgcgccacgtgggcgccccgcctgaactccgcccgggtcttcgggaccggcaccaaggtgaccgtgctc

SEQ ID NO: 10063 - RNA, 333 nt, synthetic construct
  misc_feature 1..333: note = derived and/or modified sequence opt1 from anti-HIV_119-064667_VR-Chain
  source 1..333: mol_type = other RNA
cagagcgtgctgacccagcccccgtccgtcagcgccgcccccggccagaaggtgaccatctcctgcagcgggtccaacagctacatcggcaacaagtacgtgtcctggtaccagcaggtccccgggacggcgcccaagctcctgatctacgagaacaacaagcgcccgagcggcatccccgaccggttctccgggagcaagtccggcaccagcgccaccctggtgatcaccggcctccagacgggggacgaggccgacttctactgcggcacctgggacgggtccctgcgcaccggcggggtgatcggcaccggcacgcgggtcaccgtgctg

SEQ ID NO: 10064 - RNA, 324 nt, synthetic construct
  misc_feature 1..324: note = derived and/or modified sequence opt1 from anti-HIV_119-063791_VR-Chain
  source 1..324: mol_type = other RNA
cagagcgtgctgacccagcccccgtccgtcagcgccgcccccggccagaaggtgcccatctcctgcagcgggaactccagcaacatcggcaacaactacgtgtcctggtaccagcagctccccgggaccgcgccgaagctgctgatctacgagaacaacaagcgccccagcggcatccccgaccggttctccgggagcaagtccggcacgagcgccaccctcgccatcaccggcctgcacaccggggacgaggccgactactactgcgagacgtgggacggctccgggggcgtcttcgggaccggcaccaaggtgaccgtgctg

SEQ ID NO: 10065 - RNA, 333 nt, synthetic construct
  misc_feature 1..333: note = derived and/or modified sequence opt1 from anti-HIV_119-062989_VR-Chain
  source 1..333: mol_type = other RNA
cagagcgtgctgacccagcccccgtccgtcagcgccgcccccggccagcgggtgaccatctcctgcagcgggtccagctccaacatcggcaacaacttcgtgagctggtaccagcagttccccgggacggtccccaagctcctgatctacgagaacaaccggcgcccgtccggcatccccgaccggttcagcgggtccaagagcggcacctccgcgaccctggccatcaccggcctccagacgggggacgaggccgactactactgcgccgtgtggggcgtgcgccgcggggtcggcgccgtgttcggggcgggcaccaaggtgatcgtcctg

SEQ ID NO: 10066 - RNA, 321 nt, synthetic construct
  misc_feature 1..321: note = derived and/or modified sequence opt1 from anti-HIV_119-062286_VR-Chain
  source 1..321: mol_type = other RNA
cagagcgtgctgacccagcccccgtccgtcagcgccgcccccggccagaaggtgaccatctcctgcagcgggtccgcgagcaacatcggcaagaacttcgtgtcctggtaccagcagctccccgggacggcccccaagctgctgatcagcgagaacaaccgccggccgtccggcacccccgaccgcttcagcgggtccaagagcggcgcctccgccaccctcgtcatcagcggcctgcagaccggggacgaggccgactactactgcgcgacgtggtccggcagcctgtccatcgggaccggcaccaaggtgaccgtgctc

SEQ ID NO: 10067 - RNA, 321 nt, synthetic construct
  misc_feature 1..321: note = derived and/or modified sequence opt1 from anti-HIV_119-061416_VR-Chain
  source 1..321: mol_type = other RNA
cagagcgtgctgacccagcccccgtccgtcagcgccgcccccggccagaaggtggtgatctcctgcagcgggtccagctccatcttcgagaagaacagcatctcctggtaccagcagggccccggggcggcccccaagctcctgatctacgagaacgacaagcgccggagcggcatcccggaccgcttctccgggagcaagtccgccaccagcacgaccctggccatcgtcggcctccagaccggcgacgaggccgactacttctgctccacctggagcgggtccctgaacttcggcacggggacccgggtgaccgtgctg

SEQ ID NO: 10068 - RNA, 321 nt, synthetic construct
  misc_feature 1..321: note = derived and/or modified sequence opt1 from anti-HIV_119-061344_VR-Chain
  source 1..321: mol_type = other RNA
cagagcgtgctgacccagcccccgtccgtcagcgccgcccccggccagaaggtgaccatctcctgcagcgggtccagctccgtgttcggcaagaactacgtcagctggtaccagcacctccccgggacggcgcccaagctgctgatctacgagaacaacaagcgcccgtccggcatccccgaccggttcagcggggccaagtccggcaccgccgccaccctcgccatcaccggcctgcagacgggggacgaggcggactactactgcgccacctggagcggctccctgaacttcgggaccggcaccaaggtgacggtgctc

SEQ ID NO: 10069 - RNA, 324 nt, synthetic construct
  misc_feature 1..324: note = derived and/or modified sequence opt1 from anti-HIV_119-060240_VR-Chain
  source 1..324: mol_type = other RNA
cagagcgtgctgacccagcccccgtccgagtacggcgcccccgggcacaacgtcaccgtgagctgctccggcacgaccagcaacatcgagaacaacttcgtgtcctggtacctcatcgtccccgggaccgcccccaagctgctgatcttcgacaacgacaagcgcccgagcggcatccccgaccggttctccgggagcaagtccggcaccagcgcgacgctcgccatcaccggcctgcagaccggggacgaggccgactactactgcgccacctgggacggccgcgtgtccgtgatcgggacgggcaccaaggtcaccgtgctg

SEQ ID NO: 10070 - RNA, 333 nt, synthetic construct
  misc_feature 1..333: note = derived and/or modified sequence opt1 from anti-HIV_119-060184_VR-Chain
  source 1..333: mol_type = other RNA
cagagcgtgctgacccagcccccgtccgtcagcggcgcccccgggcagcgcgtgaccatctcctgcagcggctccagctccaacatcgggagcaacacggtgaactggtaccagcagctccccggcaccgcccccaagctgctgatctacgacaacaacaagcggccgtccgggatccccgaccgcttcagcggctccaagagcggcacctccgcgaccctcgtcatcacggggctgcagaccggcgacgaggccgacttctactgcgggacctgggacggcagcctgcggaccgggggcgtgatcggcacggggacccgcgtgaccgtcctc

SEQ ID NO: 10071 - RNA, 321 nt, synthetic construct
  misc_feature 1..321: note = derived and/or modified sequence opt1 from anti-HIV_119-058035_VR-Chain
  source 1..321: mol_type = other RNA
cagagcgtgctgacccagcccccgtccgtcagcgccgcccccggccagaaggtgaccatctcctgcagcgggtccgcgagcaacatcggcaagaacttcgtgtcctggtaccagcagctccccgggacggcccccaagctgctgatctacgagaacaaccgccggccgagcggcacccccgaccgcttctccggggccaagagcggcacctccgccaccctcgccatcacgggcctgcagaccggggacgaggcggactacttctgcagcacctggtccggcagcctgaacttcgggaccggcacgcgggtcaccgtgctc

SEQ ID NO: 10072 - RNA, 321 nt, synthetic construct
  misc_feature 1..321: note = derived and/or modified sequence opt1 from anti-HIV_119-057858_VR-Chain
  source 1..321: mol_type = other RNA
cagagcgtgctgacccagcccccgtccgtcagcgccgcccccggccagaacgtgaacatctcctgcagcgggggctccagcaacatcgggtccaactacgtgagctggtaccagcagttccccggcaccgcgcccaagctcctgatctacgagaacaacaagcgcccgtccgggatccccgaccggttcagcggcgccaagtccggcacgagcgccaccctggccatcaccgggctccagaccggcgacgaggccgactacttctgctccacgtggagcgggtccctgaacttcggcaccgggacccgcgtcaccgtgctg

SEQ ID NO: 10073 - RNA, 324 nt, synthetic construct
  misc_feature 1..324: note = derived and/or modified sequence opt1 from anti-HIV_119-057473_VR-Chain
  source 1..324: mol_type = other RNA
cagagcgtgctgacccagcccccgtccgtcagcgccgcccccggccagaaggtgaccatctcctgcagcgggtccagctccaacatcggcaacaactacgtgagctggtaccagcacctccccgggacggcgcccaagctgctgatctacgacacctactcccgcccgagcggcatccccgaccggttctccgggagcaagtccggcaccagcgccaccctcgccatcacgggcctgcagaccggggacgaggccgactactactgcggcacctgggacgggtccggcggggtcttcggcaccggcacgaaggtgaccgtgctg

SEQ ID NO: 10074 - RNA, 321 nt, synthetic construct
  misc_feature 1..321: note = derived and/or modified sequence opt1 from anti-HIV_119-057090_VR-Chain
  source 1..321: mol_type = other RNA
cagagcgtgctgacccagcccccgtccgtcagcgccgcccccggccagaccgtgacgatctcctgcagcgggtccaccagcaacatcggcaagaacgacgtgtcctggtaccagcagctccccgggaccgcgcccaagctgctgatcagcgagaacaaccgccggccgtccggcacccccgaccgcttcagcgcctccaagagcgggacgtccgccaccctcgccatcaccggcctgcagaccggcgacgaggccgactacttctgcagcacgtggtccgggagcctgaacttcggcaccgggacccgggtcaccgtgctc

SEQ ID NO: 10075 - RNA, 333 nt, synthetic construct
  misc_feature 1..333: note = derived and/or modified sequence opt1 from anti-HIV_119-055754_VR-Chain
  source 1..333: mol_type = other RNA
cagagcgtgctgacccagcccccgtccgtcagcgccgcccccggccagaaggtgaccatctcctgcagcgggaactccagctccatcggcaacaacttcgtgagctggtaccagcagctccccgggacggcgcccaagctgctggtctacgagaactaccgccggccgtccggcatccccgaccgcttcagcgggtccaagagcggcacctccgccaccctcgccatcgacggcctgcagacctgggacgaggccgactaccactgcgccatctggggcgtgcggaagggggtgggggcggtcttcggcacggggaccaaggtgaccgtggtc

SEQ ID NO: 10076 - RNA, 324 nt, synthetic construct
  misc_feature 1..324: note = derived and/or modified sequence opt1 from anti-HIV_119-054899_VR-Chain
  source 1..324: mol_type = other RNA
cagagcgtgctgacccagcccccgtccgtcagcgccgcccccggccagaaggtgaccatctcctgcagcgggtccaacagctacatcggcaacaagtacgtgtcctggtaccagcagttccccgggacggcgcccaagctcctgatccacgagaacaaccgccggccgagcggcacccccgaccgcttctccgggagcaagtccggcaccagcgccaccctggccatctccggcctccagacgggggacgaggccgactactactgcgagacctgggacggcagcgggggcgtcttcgggaccggcaccaaggtgacggtgctg

SEQ ID NO: 10077 - RNA, 324 nt, synthetic construct
  misc_feature 1..324: note = derived and/or modified sequence opt1 from anti-HIV_119-054501_VR-Chain
  source 1..324: mol_type = other RNA
cagagcgtgctgacccagcccccgtccgtcagcgccgcccccggccagaaggtgaccatctcctgcagcgggacgtccagcaacatcggcaacaactacgtgtcctggtaccagcacctccccgggaccgcgcccaagctgctgatcttcgagaccaacaagcgcccgagcggcatccccgaccggttctccgccagcaagtccgggaccagcgccacgctcgccatcaccggcctgcagaccggcgacgaggccgactactactgcgagacctgggacgggtccggcggggtcttcggccccgggacgcgcgtgaccgtgctg

SEQ ID NO: 10078 - RNA, 324 nt, synthetic construct
  misc_feature 1..324: note = derived and/or modified sequence opt1 from anti-HIV_119-051867_VR-Chain
  source 1..324: mol_type = other RNA
cagagcgtgctgacccagcccccgtccgtcagcgccgcccccggccagaaggtgaccatctcctgcagcgggaactccagcaacatcggcaacaacttcatctcctggtaccagcagctccccgggacggcgcccaagctgctgatctacgagaacgaccgccggccgagcggcacccccgaccgcttctccgggagcaagtccggcaccagcgccaccctcgccatcacgggcctgcagaccggggacgaggccgactactactgcgagacctgggacggctccgggggcgtgttcgggaccggcacgaaggtcaccgtgctg

SEQ ID NO: 10079 - RNA, 324 nt, synthetic construct
  misc_feature 1..324: note = derived and/or modified sequence opt1 from anti-HIV_119-051814_VR-Chain
  source 1..324: mol_type = other RNA
cagagcgtgctgacccagcccccgtccgtcagcgccgcccccggccagaaggtgaccatctcctgcagcgggtccaacagcaacatcggcaacaaggacgtgtcctggtaccagcagatccccgcgacggcccccaagctcctgatctacgagaacaacaagcgcccgagcgggatccccgaccggttctccggcagcaagtccgggaccagcgccaccctggccatcaccggcctccagacgggcgacgaggccgactactactgcgcgacctgggacgggcgcgtctccgtgatcggcaccgggaccaacgtgatcgtcctg

SEQ ID NO: 10080 - RNA, 321 nt, synthetic construct
  misc_feature 1..321: note = derived and/or modified sequence opt1 from anti-HIV_119-051567_VR-Chain
  source 1..321: mol_type = other RNA
cagagcgtgctgacccagcccccgtccgtcagcgccgcccccggccagaaggtgaccatctactgctccgggagccgctccaacatcggccggaactacgcgagctggtaccagcagctccccgggacggcccccaagctgctgatcttcgacaacaaccgccggccgtccggcatccccgaccgcttcagcggggccaagtccggcaccagcgccaccctcgccatcaccggcctgcagacgggggacgaggcggactacttctgctccacctggagcggctccctgaacttcgggaccggcacccgggtgacggtcctc

SEQ ID NO: 10081 - RNA, 324 nt, synthetic construct
  misc_feature 1..324: note = derived and/or modified sequence opt1 from anti-HIV_119-051483_VR-Chain
  source 1..324: mol_type = other RNA
cagagcgtgctgacccagcccccgtccgtcagcgccgcccccggccagaagctcaccatctcctgcagcgggacgtccagcaacatcggcaacaactacgtgtcctggtaccagcacctccccgggaccgcgcccaagctgctgatctacgagaacaaccgccggccgagcggcatccccgagcgcttctccgccagcaagtccgggaccagcgccaccctgggcatcacgggcctgcagaccggggacgaggccgactactactgcgagacctgggacgactccggcggggtgttcggcaccgggacgaaggtcaccgtgctc

SEQ ID NO: 10082 - RNA, 333 nt, synthetic construct
  misc_feature 1..333: note = derived and/or modified sequence opt1 from anti-HIV_119-050913_VR-Chain
  source 1..333: mol_type = other RNA
cagagcgtgctgacccagcccccgtccgtcagcgccgcccccggccagaaggtgaccatctcctgcagcgggggcacgtccaacatcgggaacaactacgtgagctggtaccagcagctccccggcaccgcgccccgcctgctgatctacgagaccaacaagcggccgtccgggatccccgaccgcttcttcggcagcaagtccggcaccagcgccacgctcgccatctccgggctgcagaccggcgacgaggccgactactactgcaccgtctggggcgtgcggaagggggtgggggccgtcttcggcaccggcacgaaggtgaccgtgctg

SEQ ID NO: 10083 - RNA, 333 nt, synthetic construct
  misc_feature 1..333: note = derived and/or modified sequence opt1 from anti-HIV_119-050187_VR-Chain
  source 1..333: mol_type = other RNA
cagagcgtgctgacccagcccccgtccgtcagcgccgcccccggccagaaggtgaccatctcctgcagcgggtccagctccaacatcggcaagaacagcgtgtcctggtaccagcagttccccgggacggcgcccaagctcctgatctacgagaacaacaagcgcccgagcggcatccccgaccggttctccgacagccagtccgggaccagcgccaccctggccatcaccggcctccagacgggcgacgaggccgactactcctgcgccacctgggcggccagcctgaactccgcccgcgtcttcgggaccggcacccgggtgacggtgctg

SEQ ID NO: 10084 - RNA, 324 nt, synthetic construct
  misc_feature 1..324: note = derived and/or modified sequence opt1 from anti-HIV_119-049069_VR-Chain
  source 1..324: mol_type = other RNA
cagagcgtgctgacccagcccccgtccgtcagcgccgcccccggccagaaggtgaccatctcctgcagcgggtccacgagcaacatcggcaagtccgacgtgttctggtaccagcagctccccgggaccgcgcccaagctgctgatcagcgagacctcccgccggccgagcggcacccccgaccgcttctccgggagcaagtccggcacgagcgccaccctcaccatcaccggcctgcagacgggggacgaggccgactactactgcgaggcctgggacggctccgggggcgtcttcgggaccggcaccaaggtgaccgtgctg

SEQ ID NO: 10085 - RNA, 333 nt, synthetic construct
  misc_feature 1..333: note = derived and/or modified sequence opt1 from anti-HIV_119-048517_VR-Chain
  source 1..333: mol_type = other RNA
cagagcgtgctgacccagcccccgtccgtcagcgccgcccccggccagaaggtgaccatctcctgcagcgggtccaagttcaacatcggcaacaaggacgtgagctggtaccagcactcccccgggacggcgcccaagctcctgatctacgagaacaacaagcggccgagcggcatccccgaccggttctccgggagcaagtccggcaccagcgccaccctgggcatctccgggctccagaccggcgacgaggccgactactgctgcgccgtctggggcgtgcgccgcggggccggggcggtgttcggcgccggcacgaaggtcaccgtgctg

SEQ ID NO: 10086 - RNA, 333 nt, synthetic construct
  misc_feature 1..333: note = derived and/or modified sequence opt1 from anti-HIV_119-048470_VR-Chain
  source 1..333: mol_type = other RNA
cagagcgtgctgacccagcccccgtccgtcagcgccgcccccggccagaaggtgaccatctcctgcagcgggtccacgagcaacatcggcaagaacctcgtgtcctggtaccagcagttccccgggaccgcgcccaagctgctgatctacgagaacaaccgccggccgagcggcatccccgaccgcttctccgggagcaagtccggcaccagcgccaccctcgtcatcacgggcctgcagaccggggacgaggccgacttctactgcggcacctggggcgggtccctgcgggccgggggcgtgatcggcaccgggacgcgcgtgaccgtcctc

SEQ ID NO: 10087 - RNA, 282 nt, synthetic construct
  misc_feature 1..282: note = derived and/or modified sequence opt1 from anti-HIV_119-048303_VR-Chain
  source 1..282: mol_type = other RNA
agcgtgctgacccagcccccgtccgtcagcgccgcccccggccagaacatcaccatctcctgcagcgggtccatcagcaacatcgcgtccaacttcatcagctggtaccagcagctccccggcacggcccccaagatcatcatctacgacaacgaccagcgcccgctggggatccccgcccggttctccggcagcaagtccggggccagcgccaccctggtgatcaccggcctccagaccggcgacgaggcggactactactgcgggacgtgggacggctcc

SEQ ID NO: 10088 - RNA, 333 nt, synthetic construct
  misc_feature 1..333: note = derived and/or modified sequence opt1 from anti-HIV_119-048021_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgatctacgacaacaacaagcgcccgtccggcatccccgaccggttcagcgggtccaagagcggcacctccgccaccctcgtcatcaccggcctgcagacgggggacgaggccgacttctactgcggcacctgggacgggagcctgtccggcgggggcgtgatcggcaccgggacccgcgtgacggtcctc

SEQ ID NO: 10089 - RNA, 324 nt, synthetic construct
  misc_feature 1..324: note = derived and/or modified sequence opt1 from anti-HIV_119-047928_VR-Chain
  source 1..324: mol_type = other RNA
cagagcgtgctgacccagcccccgtccgtcagcgccgcccccggccagaaggtgaccatctcctgcagcgggtccaacagcaacatcggcaacaactgcgtgtcctggtaccagcaggtccccgggacggcgcccaagctcctgatctacgagaacaaccgccggccgagcggcatccccgaccgcttctccgggagcaagtccggcaccagcgccaccctggccatctccggcctccagaccggggacgaggccgactactactgcggcacgtgggacgggagcggcggggtgttcggcaccgccaccaaggtgaccgtcctg

SEQ ID NO: 10090 - RNA, 324 nt, synthetic construct
  misc_feature 1..324: note = derived and/or modified sequence opt1 from anti-HIV_119-047384_VR-Chain
  source 1..324: mol_type = other RNA
cagagcgtgctgacccagcccccgtccgtcagcgccgcccccggccagaaggtgaccatctcctgcagcgggtccaacagcaacatcggcaacaaggacgtgtcctggtaccgccaggtcccgcccacggcgcccaagctcctgatctacgagaacaacaagcggcccagcgggatccccgaccgcttctccggcagcaagtccgggaccagcgccaccctggccatcaccggcctccagacgggcgacgaggccgactactactgcgccacctgggacgggcgggtgtccgtgttcggcaccgggaccaaggtcgcggtgctg

SEQ ID NO: 10091 - RNA, 333 nt, synthetic construct
  misc_feature 1..333: note = derived and/or modified sequence opt1 from anti-HIV_119-047145_VR-Chain
  source 1..333: mol_type = other RNA
cagagcgtgctgacccagcccccgtccgtcagcgccgcccccggccagaccgtgaacatctcctgcagcgggtccaacagcaacatcggctccaagtacgtgagctggtaccagcacttccccgggacggcgcccaagctcctgatctacgagaacaacaagcgctccagcggcatcccggaccggttctccgggagcaagtccgccaccagcgccaccctggccatcaccggcctccagacgggcgacgaggccgactactactgcgcgacctgggccccctccctgaacagcgcccgcgtcttcgggaccggcaccaaggtgacggtgctg

SEQ ID NO: 10092 - RNA, 333 nt, synthetic construct
  misc_feature 1..333: note = derived and/or modified sequence opt1 from anti-HIV_119-046752_VR-Chain
  source 1..333: mol_type = other RNA
cagagcgtgctgacccagcccccgtccgtcagcgccgcccccggccagaaggtgaccatctcctgcagcgggaactccagctccatcggcaacaacttcgtgagctggtaccagcagctccccgggacggcgcccaagctgctggtctacgagaactaccgccggccgtccggcatcagcgaccgcttctccgggagcaagtccggcaccagcgccaccctcgccatcaccggcctgcagacgggggacgaggccgactactactgcaccgtgtggggcgtgcggaagggggtcggcgccgtgttcgggaccggcaccaaggtgacggtcctg

SEQ ID NO: 10093 - RNA, 324 nt, synthetic construct
  misc_feature 1..324: note = derived and/or modified sequence opt1 from anti-HIV_119-046660_VR-Chain
  source 1..324: mol_type = other RNA
cagagcgtgctgacccagcccccgtccgtcagcgccgcccccggccagaaggtgaccatctcctgcagcgggtccagctccaacatcggcaaccactacgtgagctggtaccagcagctccccgggacggcgcccaagctgctgatctacgacaacaacaagcgcccgtccggcatccccgaccggttcagcgcctccaagagcgggacctccgccaccctcggcatcaccggcctgcagacgggggacgaggccgactactactgcgccacctgggacggccgcgtcagcgtgatcgggaccggcaccaaggtgacggtcgtg

SEQ ID NO: 10094 - RNA, 333 nt, synthetic construct
  misc_feature 1..333: note = derived and/or modified sequence opt1 from anti-HIV_119-046202_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctggtctacgagaactaccgccggccgtccggcatccccgaccgcttcagcgggtccaagagcggcacctccgccaccctcgccatcaccggcctgcagacgggggacgaggccgactaccactgcgccatctggggcgtgcggaagggggtgggcgcggtcttcgggaccggcaccaaggtgaccgtggtc

SEQ ID NO: 10095 - RNA, 333 nt, synthetic construct
  misc_feature 1..333: note = derived and/or modified sequence opt1 from anti-HIV_119-045790_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagtacctccccgggacggcgcccaagctgctgttctacgaggacaaccgccggccgtccggcacccccgaccgcttcagcgggtccaagagcggcacctccgccaccctcgccatcagcggcctgcagacgggggacgaggccgactactactgcaccatctggggcgtccggaagggggtgggcgccgtgttcgggaccggcaccaaggtcacggtgctg

SEQ ID NO: 10096 - RNA, 333 nt, synthetic construct
  misc_feature 1..333: note = derived and/or modified sequence opt1 from anti-HIV_119-044670_VR-Chain
  source 1..333: mol_type = other RNA
cagagcgtgctgacccagcccccgtccgtcagcggcgcccccggggagcgcgtgaccatctcctgcacgggcaacaccagcaacatcgggacctacgacgtgcagtggtaccagcacctccccggcaccgcgccccggctgctgatctaccacaacgtcaacctcccgtccggggtgcccgaccgcttcagcgcctccaagagcggcacgtccgccaccctggccatcaccggcctgcagaccggggacgaggccgactactactgcacgatctggggcgtgcggaagggggtcggcgccgtgttcgggaccggcaccaaggtgaccgtcctc

SEQ ID NO: 10097 - RNA, 321 nt, synthetic construct
  misc_feature 1..321: note = derived and/or modified sequence opt1 from anti-HIV_119-044140_VR-Chain
  source 1..321: mol_type = other RNA
cagagcgtgctgacccagcccccgtccgtcagcgccgcccccggccagaaggtgaccatctcctgcagcgggggcacgtccaacatcgggaaccacttcgtgagctggtaccgccacctccccggcaccgcgcccaagctgctgatctacgagaacaacaaccggccgtccgggatccccgaccgcttcagcggcgccaagtccggcaccagcgccaccctcgccatcacggggctgcagaccggcgacgagggggactactactgcgccacctggtccggcagcctgaacatcgggaccggcacgaaggtcaccgtgctc

SEQ ID NO: 10098 - RNA, 333 nt, synthetic construct
  misc_feature 1..333: note = derived and/or modified sequence opt1 from anti-HIV_119-042776_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcacctccccgggacggcgcccaagctgctgatctacgagtccgcccgccggccgagcggcacccccgaccgcttctccgggagcaagtccggcaccagcgccaccctcgccatcacgggcctgcagaccggggacgaggccgactactactgcaccctgtggggcgtccggaagggggtgggcgcggtgttcgggaccggcacgcgcgtcaccgtgctc

SEQ ID NO: 10099 - RNA, 333 nt, synthetic construct
  misc_feature 1..333: note = derived and/or modified sequence opt1 from anti-HIV_119-042581_VR-Chain
  source 1..333: mol_type = other RNA
cagagcgtgctgacccagcccccgtccgtcagcgccgcccccggccagaaggtgaccatctcctgcagcgggtccagctccaacatcggcaacaacttcgtgagctggtaccagcagctccccgggacggcgcccaagctgctgatcttcgagacccaccgccggccgtccggcatccccgaccgcttcagcgggtccaagagcggcacctccgccaccctcgccatcacgggcctgcagagcggggacgaggccgactactactgcgccgtctggggcgtgcggcagggggcgggcgccgtgttcgggaccggcaccaaggtcaccgtgctg

SEQ ID NO: 10100 - RNA, 333 nt, synthetic construct
  misc_feature 1..333: note = derived and/or modified sequence opt1 from anti-HIV_119-040905_VR-Chain
  source 1..333: mol_type = other RNA
cagagcgtgctgacccagcccccgtccgtcagcgccgcccccggccagaaggtgaccatctcctgcagcgggaactccagcaacatcggcgacaacttcgtgtcctggtaccagcagctccccgggatcgcgcccaagctgctggtctacgagacgaacaagcgcccgagcggcatccccgaccggttcgccgggtccaagagcggcacctccgccaccctcgtgatcaccggcctgcagacgggggacgaggccgacttctactgcggcacctgggacgggagcctgcgcaccggcggggtgatcggcaccggcacgcgggtcaccgtgctc

SEQ ID NO: 10101 - RNA, 321 nt, synthetic construct
  misc_feature 1..321: note = derived and/or modified sequence opt1 from anti-HIV_119-040322_VR-Chain
  source 1..321: mol_type = other RNA
cagagcgtgctgacccagcccccgtccgtcagcgccgcccccggccagaaggtggtgatctcctgcagcgggtccagctccatcatcgagaagaacagcatctcctggtaccagcagggccccggggcggcccccaagctcctgatctacgagaacgacaagcgcccgagcggcatccccgaccggttctccgggagcaagtccggcaccacgggcaccctggccatcaccgggctccagaccggcgacgaggccgactacttctgcgccacgtggagcgggcgcctgaacatcggcaccgggaccaaggtcaccgtgctg

SEQ ID NO: 10102 - RNA, 324 nt, synthetic construct
  misc_feature 1..324: note = derived and/or modified sequence opt1 from anti-HIV_119-039892_VR-Chain
  source 1..324: mol_type = other RNA
cagagcgtgctgacccagcccccgtccgtcagcgccgcccccggccagaaggtgaccatctcctgcagcgggtccaacgcgaacatcggcaacaaggacgtgagctggtaccagcagctccccgccacggcccccaagctgctgatctacgagtccaacaagcgcccgagcgggatccccgaccggttctccggcagcaagtccgggaccagcgccaccctcgccatcaccggcctgcagacgggcgacgaggcggactactactgcgccacctgggacgggcgcgtctccggcatcgggaccggcaccaaggtgacggtgctg

SEQ ID NO: 10103 - RNA, 324 nt, synthetic construct
  misc_feature 1..324: note = derived and/or modified sequence opt1 from anti-HIV_119-039764_VR-Chain
  source 1..324: mol_type = other RNA
cagagcgtgctgacccagcccccgtccgtcagcgccgcccccggccagaaggtgaccatctcctgcagcgggtccgcgagcaacatcggcaagaacttcgtgtcctggtaccagcaggtccccgggacggcccccaagctcctgatctacgagaacaaccgccggccgagcggcacccccgaccgcttctccgggagcaagtccggcaccagcggcaccctggccatctccgggctccagacgggcgacgaggccgactactactgcgagacctgggacgggagcggcggggtgttcggcaccggcaccaaggtgacggtcctg

SEQ ID NO: 10104 - RNA, 333 nt, synthetic construct
  misc_feature 1..333: note = derived and/or modified sequence opt1 from anti-HIV_119-039188_VR-Chain
  source 1..333: mol_type = other RNA
cagagcgtgctgacccagcccccgtccctcagcggcgcccccgggcagaccgtcacgatctcctgcagcggctccagctccaacatcgggaacaactacgtgagctggtaccagcagctgcccggcaccgcccccaagctgctcatctacgactccaaccgccggccgagcgggatccccgaccgcttctccggcagcaagtccggcaccagcgcgaccctggccatctccgggctgcagacgggcgacgaggccgactactgctgcgccgtgtggggcgtccggcgcggggccggggcggtgttcggcgccggcaccaaggtgaccgtcctc

SEQ ID NO: 10105 - RNA, 321 nt, synthetic construct
  misc_feature 1..321: note = derived and/or modified sequence opt1 from anti-HIV_119-039058_VR-Chain
  source 1..321: mol_type = other RNA
cagagcgtgctgacccagcccccgtccgtcagcggcgcccccgggcagcgcgtgaccatctcctgcacgggcagctccagcaacatcgggaacaactacgtgtcctggtaccggcgcctccccggcaccgcccccaagctgctgatctacgagaacaacaagcggccgagcgggatccccgaccgcttctccggcgccaagagcggcacctccgcgaccctcgccatcacggggctgcagaccggcgacgaggccgactacttctgcagcacctggtccgggagcctgaacttcggcaccgggacgcgggtcaccgtgctc

SEQ ID NO: 10106 - RNA, 321 nt, synthetic construct
  misc_feature 1..321: note = derived and/or modified sequence opt1 from anti-HIV_119-038837_VR-Chain
  source 1..321: mol_type = other RNA
cagagcgtgctgacccagcccccgtccgtcagcgccgcccccggccagaaggtgaccatctcctgcagcgggggcacgtccaacatcgggaacaacttcgtgagctggtaccagcacctccccggcaccgcgcccaagctgctgatcttcgagaacaacaagcgcccgtccggggtccccgaccggttcagcggcgccaagtccggcaccagcgccaccctcgccatcacggggctgcagaccggcgacgagggggactactactgcgccacctggtccggcagcctgaacatcgggaccggcacgaaggtgaccgtgctc

SEQ ID NO: 10107 - RNA, 321 nt, synthetic construct
  misc_feature 1..321: note = derived and/or modified sequence opt1 from anti-HIV_119-038396_VR-Chain
  source 1..321: mol_type = other RNA
cagagcgtgctgacccagcccccgtccgtcagcgccacccccggccagaaggtgacgatctcctgcagcgggtccaacagcaacatcggcaacaagtacgtgtcctggtaccagctgttccccgggaccgcccccaagctcctgatcagcgagaacaaccgccggccgtccggcacccccgaccgcttcagcgggtccaagagcggcacctccgcgacgctcgccatcaccggcctgcagaccggggacgaggccgactactactgcgccacctggagcggctccctgaacatcgggacgggcaccaaggtcaccgtgctc

SEQ ID NO: 10108 - RNA, 321 nt, synthetic construct
  misc_feature 1..321: note = derived and/or modified sequence opt1 from anti-HIV_119-036918_VR-Chain
  source 1..321: mol_type = other RNA
cagagcgtgctgacccagcccccgtccgtcagcgccgcccccggccagaaggtgaccatctcctgcagcggggccacgtccaacatctgggaccactacgtgagctggtacctccaggtccccggcaccgcgccccgcctgctgatctacgacaacgacaagcggccgtccgggatccccgaccgcttcagcggctccaagagcgggacctccgccaccctcgccatcacgggcctgcagaccggcgacgagggggactactactgcgccacctggagcggctccctgaacatcgggaccggcacgaaggtgaccgtgctc

SEQ ID NO: 10109 - RNA, 324 nt, synthetic construct
  misc_feature 1..324: note = derived and/or modified sequence opt1 from anti-HIV_119-036592_VR-Chain
  source 1..324: mol_type = other RNA
cagagcgtgctgacccagcccccgtccgtcagcgccgcccccggccagaaggtgaccatctcctgcagcgggtccaacagcaacacgggcaacaaggacgtgtcctggtaccagcaggtccccgcgaccgcccccaagctcctgatctacgagagcaacaagcgcccgtccgggatccccgaccggttcagcggctccaagagcgggacctccgccaccctggccatcacgggcctccagaccggcgacgaggccgactactactgcgcgatctgggacgggcgcgtgagcgtgatcggcaccgggaccaaggtcacggtgctg

SEQ ID NO: 10110 - RNA, 324 nt, synthetic construct
  misc_feature 1..324: note = derived and/or modified sequence opt1 from anti-HIV_119-036310_VR-Chain
  source 1..324: mol_type = other RNA
cagagcgtgctgacccagcccccgtccgtcagcgccgcccccggccagaaggtgaccatctcctgcagcgggtccacgagcaacatcggccagaactacgtgtcctggtaccagcagctccccgggaccgcgcccaagctgctgatctacgagaacaaccgccggccgagcggctcccccgaccgcttcagcgggtccaagagcggcacctccgccaccctcgccatcacgggcctgcagaccggggacgaggccgactactactgcgagacctgggacggcagcgggggcgtcttcgggaccggcacgaaggtgaccgtgctg

SEQ ID NO: 10111 - RNA, 333 nt, synthetic construct
  misc_feature 1..333: note = derived and/or modified sequence opt1 from anti-HIV_119-035618_VR-Chain
  source 1..333: mol_type = other RNA
cagagcgtgctgacccagcccccgtccgtcagcgccgcccccggccagaaggtgaccatctcctgcagcgggtccagcttcacgatcggcaacaaccacgtgtcctggtaccagcagctccccgggaccgcgcccaagctgctgatcttcgagagccacaagcgcccgtccggcgtccccgaccggttcagcgggtccaagagcggcacctccgccaccctcgccatcacgggcctgcagaccggggacgaggccgactactactgcaccgtgtggggcgtgcgcaagggggtcggcgccgtgttcgggaccggcacgaaggtgaccgtcctg

SEQ ID NO: 10112 - RNA, 321 nt, synthetic construct
  misc_feature 1..321: note = derived and/or modified sequence opt1 from anti-HIV_119-035569_VR-Chain
  source 1..321: mol_type = other RNA
cagagcgtgctgacccagcccccgtccgtcagcggcgcccccgggcagaccgtgacgatctcctgcaccggcagctccagcaacatcgggggctacgacgtgcactggtaccagcagctccccgggaccgcccccaagctgctgatctacgagaacaaccgccggccgtccggcacccccgaccgcttcagcggcgcgaagtccgggacgagcgccaccctcgccatcaccggcctgcagaccggggacgagggcgactactactgcgccacgtggtccgggagcctgaacatcggcaccggcaccaaggtcaccgtgctc

SEQ ID NO: 10113 - RNA, 324 nt, synthetic construct
  misc_feature 1..324: note = derived and/or modified sequence opt1 from anti-HIV_119-035466_VR-Chain
  source 1..324: mol_type = other RNA
cagagcgtgctgacccagcccccgtccgtcagcgccgccgcgggccagaacgtgaacatctcctgcagcgggaagaagtccaacatcggcaacaactacgtgagctggtaccagcagttccccgggaccgcccccaagctcctgatctacggcaacacgaaccgcccctccgggatcccggaccggttcagcggctccaagagcggcacctccgccaccctggccatcaccgggctccagacgggcgacgacgccgactactactgcgagacctgggacgggagcggcggggtcttcggcaccggcaccaaggtgacggtgctg

SEQ ID NO: 10114 - RNA, 333 nt, synthetic construct
  misc_feature 1..333: note = derived and/or modified sequence opt1 from anti-HIV_119-035157_VR-Chain
  source 1..333: mol_type = other RNA
cagagcgtgctgacccagcccccgtccgtcagcgccgcccccggccagaaggtgaccatctcctgcagcgggtccagctccaacatcggcaacaacttcgtgagctggtaccagcagcgccccgggacggcgcccaagctcctgatctacgagaccaacaagcggccgtccggcatccccgaccgcttcagcgggtccaagagcggcacctccgccaccctggccatcacgggcctccagaccggggacgaggccgactactactgcgccacctgggcgccccggctgaacagcgcccgcgtcttcggcaacgggaccatggtgacggtgctg

SEQ ID NO: 10115 - RNA, 333 nt, synthetic construct
  misc_feature 1..333: note = derived and/or modified sequence opt1 from anti-HIV_119-035121_VR-Chain
  source 1..333: mol_type = other RNA
cagagcgtgctgacccagcccccgtccgtcagcgccgcccccggccagaaggtgaccatctcctgcagcgggtccacgagctacatcggcaacaagtacgtgtcctggtaccagcagttccccggggcggcccccaagctcctgatctacgagaacaacaagcggccgagcggcatccccgaccggttctccgccagcaagtccgccaccagcgccaccctggcgatcaccgggctccagacgggcgacgaggccgactactgctgcgccgtctggggcgtgcgccgcggggccggcgcggtgttcggggccggcaccaaggtcaccgtgctg

SEQ ID NO: 10116 - RNA, 324 nt, synthetic construct
  misc_feature 1..324: note = derived and/or modified sequence opt1 from anti-HIV_119-035046_VR-Chain
  source 1..324: mol_type = other RNA
cagagcgccctgacccagcccgcctccgtgagcggctccccggggcagagcatcaccatctcctgcacgggcaccagctccgacgtcgggtacgactacgtgagctggtaccgccaggtgcccgcgaccacccccaagctcctgatctacgagaacaacaagcggccctccggcatcccggaccgcttcagcgggtccaagagcggcacgtccgccaccctggccatcaccggcctccagaccggggacgaggccgactactactgcgccacgtgggacggccgggtcagcgtgatcgggaccggcaccaaggtgaccgtcgtg

SEQ ID NO: 10117 - RNA, 324 nt, synthetic construct
  misc_feature 1..324: note = derived and/or modified sequence opt1 from anti-HIV_119-034754_VR-Chain
  source 1..324: mol_type = other RNA
cagagcgtgctgacccagcccccgtccgtcagcgccgcccccggcgagaaggtgaccatctcctgcagcgggtccagctccaacatcggcaacaactacgtgagctggtaccagcagctccccgggacggtccccaagctgctgatctacgacaacaacaagcgcccgtccggcacccccgaccggttcagcgggtccaagagcggcacctccgcgaccctcgccatcacgggcctgcagaccggggacgaggccgactactactgcgagacctgggacggcagcgggggcgtgttcgggaccggcacgaaggtgaccgtcctg

SEQ ID NO: 10118 - RNA, 324 nt, synthetic construct
  misc_feature 1..324: note = derived and/or modified sequence opt1 from anti-HIV_119-034318_VR-Chain
  source 1..324: mol_type = other RNA
cagagcgtgctgacccagcccccgtccgtcagcgccgcccccggccagaagatcaccatctcctgcagcgggtccagctccaacatcggcaacaacgacgtgagctggtaccagcagctccccgggacggcgcccaagctgctgatctacgagaacgaccgccggccgtccggcacccccgaccgcttcagcgggtccaagagcggcacctccgccaccctcgccatcacgggcctgcagaccggggacgaggccgactactactgcgagacctgggacggcagcgggggcgtgttcgggaccggcacgaaggtcaccgtgctg

SEQ ID NO: 10119 - RNA, 333 nt, synthetic construct
  misc_feature 1..333: note = derived and/or modified sequence opt1 from anti-HIV_119-033780_VR-Chain
  source 1..333: mol_type = other RNA
cagagcgtgctgacccagcccccgtccgtcagcgccgcccccggccagcgcgtgaccatctcctgcagcgggacgtccagcaacatcggcgagaactacgtgtcctggtaccagcagatccccgggaccgcgcccaagctcctgatctacgagaacaacaagcggccgagcggcatccccgaccgcttctccgggagcaagtccggcaccagcgccaccctggtcatcacgggcctccagaccggggacgaggccgacttctactgcggcacctggggcgggtccctgcggaccgggggcgtgctgggcacggggacccgcgtgaccgtcctc

SEQ ID NO: 10120 - RNA, 333 nt, synthetic construct
  misc_feature 1..333: note = derived and/or modified sequence opt1 from anti-HIV_119-033632_VR-Chain
  source 1..333: mol_type = other RNA
cagagcgtgctgacccagcccccgtccgtcagcgccgcccccggccagcgcgtgaccatctcctgcagcgggggctccagcaacatcgggtccaactacgtgagctggtaccagcagctccccggcacggcgcccaagctgctgatctaccagaacaacaagcggccgtccgggatccccgaccgcttcagcggctccaagagcggcacctccgccaccctcgggatcaccggcctgcagacgggggacgaggccgactactactgcaccgtctggggcgtgcggaagggggtgggcgccgtcttcggcaccgggaccaaggtgacggtgctg

SEQ ID NO: 10121 - RNA, 333 nt, synthetic construct
  misc_feature 1..333: note = derived and/or modified sequence opt1 from anti-HIV_119-033183_VR-Chain
  source 1..333: mol_type = other RNA
cagagcgtgctgacccagcccccgtccgtcagcgccgcccccggccagatggtgaccatctcctgcagcgggggcgcgtccaacctcgggaagaacagcgtgtcctggtaccagcagctgcccggcacggcccccaagctgctcatctacgaggacaaccgccggccgagcgggacccccgaccgcttctccggcagccggtccggcaccagcgccaccctggccatcacggggctgcagaccggcgacgaggccgactactactgcaccatctggggcgtccgcaagggggtgggggcggtgttcggcaccggcacgaaggtcaccgtgctc

SEQ ID NO: 10122 - RNA, 333 nt, synthetic construct
  misc_feature 1..333: note = derived and/or modified sequence opt1 from anti-HIV_119-030696_VR-Chain
  source 1..333: mol_type = other RNA
cagagcgtgctgacccagcccccgtccgtcagcggcgcccccgggcagatcgtgaccctctcctgcacgggcgccatgaccaacatcgggaacaacgacgtgcactggtaccagcacctccccggcaccgggcccaagctgctgatctacgagaacaacaagcgcccgagcggcatccccgaccggttctccggcagcaagtccgggaccagcgcgacgctggtcatcaccggcctgcagaccggggacgaggccgacttctactgcggcacctgggacgggtccctccgcacgggcggcgtgatcgggaccggcacccgggtgaccgtcctg

SEQ ID NO: 10123 - RNA, 324 nt, synthetic construct
  misc_feature 1..324: note = derived and/or modified sequence opt1 from anti-HIV_119-030059_VR-Chain
  source 1..324: mol_type = other RNA
cagagcgtgctgacccagcccccgtccgtcagcgccgcccccggccagaaggtggtgatctcctgcagcgggtccagctccatcatcgagaagaacagcatctcctggtaccagcagggccccggggcggcccccaagctcctgatctacgagaacgacaagcgcccgagcggcatctccgaccggttcagcgggtccaagagcgccacctccgccacgctggccatcaccggcctccacaccggcgacgaggcggactactactgcgagacctgggacgggagcggcggggtcttcggcacggggaccaaggtgaccgtgctg

SEQ ID NO: 10124 - RNA, 333 nt, synthetic construct
  misc_feature 1..333: note = derived and/or modified sequence opt1 from anti-HIV_119-029589_VR-Chain
  source 1..333: mol_type = other RNA
cagagcgtgctgacccagcccccgtccgtcagcgccgcccccggccagaaggtgaccatctcctgcagcgggacgtccagcaacatcggcaacaacttcgtgtcctggtaccagctcctgcccgggaccgcgccccgcctgctcatctacgacaacaacaagcggccgagcggcacccccgaccgcttctccgggagcaagtccggcaccagcgccacgctgggcatcaccgggctgcagaccggcgacgaggccgacttctactgcgggacctgggacggctccctccggaccgggggcgtcatcggcacggggacccgcgtgaccgtgctg

SEQ ID NO: 10125 - RNA, 324 nt, synthetic construct
  misc_feature 1..324: note = derived and/or modified sequence opt1 from anti-HIV_119-029448_VR-Chain
  source 1..324: mol_type = other RNA
cagagcgtgctgacccagcccccgtccgtcagcgccgcccccggccagaaggtgaccatctcctgcagcgggaactccagcaacatcggcaagaactccgtgagctggtaccaccagctccccgggacggcgcccaagctgctgatctacgagaacgaccgccggccgtccggcacccccgaccgcttcagcgggtccaagagcggcacctccgccaccctcgccatcacgggcctgcagaccggggacgaggccgactactactgcgagacctgggacggcagcgggggcgtcttcgggaccggcacgaaggtgaccgtgctg

SEQ ID NO: 10126 - RNA, 333 nt, synthetic construct
  misc_feature 1..333: note = derived and/or modified sequence opt1 from anti-HIV_119-029220_VR-Chain
  source 1..333: mol_type = other RNA
cagagcgtgctgacccagcccccgtccgtcagcgccgcccccggccagaaggtgaccatctcctgcagcgggtccacgagcaacatcggccagaactacgtgtcctggtaccagcagctccccgggaccgcgcccaagctgctgatctacgagaacgaccgccggccgagcggcatccccgaccgcttctccgggagcaagtccggcaccagcgccaccctcgccatctccggcctgcagacgggggacgaggccgactactgctgcgccgtctggggcgtgcggcgcggggcgggcgccgtgttcgggcccggcaccaaggtcaccgtgctg

SEQ ID NO: 10127 - RNA, 333 nt, synthetic construct
  misc_feature 1..333: note = derived and/or modified sequence opt1 from anti-HIV_119-028317_VR-Chain
  source 1..333: mol_type = other RNA
cagagcgtgctgacccagcccccgtccgtcagcgccgcccccggccagaaggtgaccatctcctgcagcgggtccagctccaacatcggcaacgactacgtgagctggtaccagcagctccccgggacggcgcccaagctgctgatctacgagaacaacaagcgcccgtccggcatccccgaccggttcagcgggtccaagagcggcacctccgccaccctcgccatcaccggcctgcagacgggggacgaggccgactactactgcaccatctggggcgtccgcaagggggtgggcgccgtgttcgggaccggcaccaaggtcacggtgctg

SEQ ID NO: 10128 - RNA, 324 nt, synthetic construct
  misc_feature 1..324: note = derived and/or modified sequence opt1 from anti-HIV_119-028165_VR-Chain
  source 1..324: mol_type = other RNA
cagagcgtgctgacccagcccccgtccgtcagcgccgcccccggccagaccgtgacgatctcctgcagcgggatcacctccaacatcggcaagaacgacgtgagctggtaccagcagctccccgggaccgcgcccaagctgctgatctccgagaacaaccgccggccgagcggcatccccgaccgcttctccgggagcaagtccggcaccagcgccacgctcgccatcaccggcctgcagaccggggacgaggccgactactactgcgccatctgggacggccgggtctccgtgatcgggaccggcacgaaggtgaccgtcctg

SEQ ID NO: 10129 - RNA, 324 nt, synthetic construct
  misc_feature 1..324: note = derived and/or modified sequence opt1 from anti-HIV_119-027147_VR-Chain
  source 1..324: mol_type = other RNA
cagagcgtgctgacccagcccccgtccgtcagcgccgcccccggccagaccgtgacgatctcctgcagcgggtccaccagcgacatcggcaagaacgacgtgtcctggtaccagcagctccccgggatcgcgcccaagctgctgatcagcgagaacaaccgccggccgtccggcacccccgaccgcttcagcgggtccaagagcggcacctccgccacgctcgccatcaccggcctgcagaccggggacgaggccgactactactgcgagacctgggacggcagcggggccgtcttcggcacggggaccaaggtgaccgtgctg

SEQ ID NO: 10130 - RNA, 333 nt, synthetic construct
  misc_feature 1..333: note = derived and/or modified sequence opt1 from anti-HIV_119-026743_VR-Chain
  source 1..333: mol_type = other RNA
cagagcgtgctgacccagcccccgtccgtcagcgccgcccccggccagaacgtgaccatctcctgcagcgggtccagctccaacatcggcaacaacttcgtgagctggtaccagcagcgccccgggacgggccccaagctcctgatctacgagaccaaccggcgcccgtccgggatccccgaccggttcagcggctccaagagcggcacctccgcgaccctggccatcacggggctccagaccggcgacgaggccgactactactgcgccacctgggcccccagcctgaactccgcgcgcgtcttcgggaccggcacgaaggtgaccgtgctg

SEQ ID NO: 10131 - RNA, 333 nt, synthetic construct
  misc_feature 1..333: note = derived and/or modified sequence opt1 from anti-HIV_119-026508_VR-Chain
  source 1..333: mol_type = other RNA
cagagcgtgctgacccagcccccgtccgtcagcgccgcccccggccagaaggtgaccatctcctgcagcgggtccagctccacgatcggcaacaactacatcagctggtaccaggtgctccccgggaccgcgcccaagctggtcatcttcaagaacaacgagcgcccgtcccgggtgcccgaccgcttcagcggctccaagagcgggacctccgccaccctgggcatcacgggcctccagctgggggacgagggcgactactactgcgggacctgggagaccagcctgtccggcgggggcgtgttcggcaccgggacgaaggtcaccgtgctc

SEQ ID NO: 10132 - RNA, 324 nt, synthetic construct
  misc_feature 1..324: note = derived and/or modified sequence opt1 from anti-HIV_119-025683_VR-Chain
  source 1..324: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgatctacgagaacaacaagcgcccgtccggcatccccgaccggttcagcgactcccagagcgggacctccgccaccctcgccatcaccggcctgcagacgggcgacgaggccgactactactgcgagacctgggacgggagcggcggggtcttcggcaccgggaccaaggtgacggtgctg

SEQ ID NO: 10133 - RNA, 333 nt, synthetic construct
  misc_feature 1..333: note = derived and/or modified sequence opt1 from anti-HIV_119-025614_VR-Chain
  source 1..333: mol_type = other RNA
cagagcctgctcacccagcccccgtccgtgagcgccgcccccggccagaacgtcatcatctcctgcagcgggtccagctccaacatcggcaagaactacgtggcgtggtaccagcaggtccccgggaccgcccccaagatcgtggtgttcgagacgaccaaccgcccgagcggcatccccgaccggttctccgggagcaagtccggcaccagcgccaccctggccatcacgggcctgcagaccggggacgaggccgactactactgcaccgtgtggggcgtccgcaagggggtgggcgcggtgttcgggaccggcacgaaggtcaccgtgctc

SEQ ID NO: 10134 - RNA, 324 nt, synthetic construct
  misc_feature 1..324: note = derived and/or modified sequence opt1 from anti-HIV_119-025548_VR-Chain
  source 1..324: mol_type = other RNA
cagagcatcctgacccagcccccgtccgtgagcgccgcccccggccagaaggtcaccatctcctgcagcgggtccagctccaacatcggcaacaactacgtgagctggtaccagcacgtgcccgggacggcgcccaagctcctgatctacgagaacaaccgccggccgtccggcacccccgaccgcttcagcgggtccaagagcggcacctccgccaccctggccatcacgggcctccagagcggggacgaggccgactactactgcggcacctgggacgggtccggcggggtcttcggcaccggcaccaaggtgacggtgctg

SEQ ID NO: 10135 - RNA, 333 nt, synthetic construct
  misc_feature 1..333: note = derived and/or modified sequence opt1 from anti-HIV_119-025526_VR-Chain
  source 1..333: mol_type = other RNA
cagagcgtgctgacccagcccccgtccgtcagcgccgcccccggccagaaggtgaccatctcctgcagcgggtccgcgagcaacatcggcaagaacttcgtgtcctggtaccagcagctccccgggacggcccccaagctgctgatctacgagaacaaccgccggccgagcggcacccccgaccgcttctccgggagcaagtccggcaccagcgccaccctcgccatcacgggcctgcagaccggggacgaggccgactactactgcaccgtctggggcgtgcggaagggggtgggcgcggtcttcgggaccggcacgaaggtgaccgtgctg

SEQ ID NO: 10136 - RNA, 324 nt, synthetic construct
  misc_feature 1..324: note = derived and/or modified sequence opt1 from anti-HIV_119-023552_VR-Chain
  source 1..324: mol_type = other RNA
cagagcgtgctgacccagcccccgtccgtcagcgccgcccccggccagaccgtgacgatctcctgcagcgggtccaccagcaacatcggcaagaacgacgtgtcctggtaccagcagctccccgggaccgcgcccaagctgctgatcagcgagaacaaccgccggccgtccggcacccccgaccgcttcagcgcctccaagagcgggacgtccgccaccctcgccatcaccggcctgcagaccggcgacgaggccgactactactgcgagacgtggcacgggagcggcggggtcttcggcaccgggaccaaggtgaccgtgctg

SEQ ID NO: 10137 - RNA, 321 nt, synthetic construct
  misc_feature 1..321: note = derived and/or modified sequence opt1 from anti-HIV_119-023092_VR-Chain
  source 1..321: mol_type = other RNA
cagagcgtgctgacccagcccccgtccgtcagcgccgcccccggccagaaggtgaccatctcctgcagcgggtccacgagcgacctcggccagacccgcgtgtcctggtaccagcagctgccccggagcgcgcccgagctgctcatcttcgagaacaaccgccggccgtccgggatccccgaccgcttcagcggcgccaagtccgggaccagcgccaccctggccatcacgggcctgcagaccggcgacgaggccgactacttctgctccacctggagcgggtccctcaacttcggcaccgggacgcgggtcaccgtgctg

SEQ ID NO: 10138 - RNA, 324 nt, synthetic construct
  misc_feature 1..324: note = derived and/or modified sequence opt1 from anti-HIV_119-022793_VR-Chain
  source 1..324: mol_type = other RNA
cagagcgtgctgacccagcccccgtccgtcagcgccgcccccggccagaaggtgaccatctcctgcagcgggggcacgtccaacatcgggaacaactacgtgagctggtaccgccggctccccggcaccgcgcccaagctgctgatctacgagaacaacaagcgcccgtccgggatccccgaccggttcagcggcgccaagtccggcaccagcgccaccctcgggatcacgggcctgcagaccggggacgaggccgactactactgcgagacctgggacgactccggcggggtcttcggcaccggcacgaaggtgaccgtgctg

SEQ ID NO: 10139 - RNA, 324 nt, synthetic construct
  misc_feature 1..324: note = derived and/or modified sequence opt1 from anti-HIV_119-022395_VR-Chain
  source 1..324: mol_type = other RNA
cagagcgtgctgacccagcccccgtccgtcagcgccgcccccggccagaccgtgacgatctcctgcagcgggtccaccagcaacatcggcaagaacgacgtgtcctggtaccagcagctccccgggaccgcgcccaagctgctgatcagcgacaacaaccgccggccgtcctggacccccgaccgcttcagcggctccaagagcgggacgtccgccaccctcgccatcaccggcctgcagaccggcgacgaggccgactactactgcgagacgtgggacgggagcggcggggtcttcggccccgggacccgggtgaccgtgctg

SEQ ID NO: 10140 - RNA, 333 nt, synthetic construct
  misc_feature 1..333: note = derived and/or modified sequence opt1 from anti-HIV_119-022334_VR-Chain
  source 1..333: mol_type = other RNA
cagagcgtgctgacccagcccccgtccgtcagcgccgcccccggccagaacgtgaacatctcctgcagcgggggctccagcaacatcgggtccaactacgtgagctggtaccagcagttccccggcaccgcgcccaagcacctcatctacgagaacaacaagcgcccgtccgggatccccgaccggttcagcgactcccagagcggcacgtccgccaccctgggcatcaccgggctgcagaccggcgacgaggccgactactactgcgggacgtgggacggcagcctccgcaccgggggcgtcatcggcaccgggacccgggtgacggtgctg

SEQ ID NO: 10141 - RNA, 321 nt, synthetic construct
  misc_feature 1..321: note = derived and/or modified sequence opt1 from anti-HIV_119-021866_VR-Chain
  source 1..321: mol_type = other RNA
cagagcgtgctgacccagcccccgtccgtcagcgccgcccccggccagcgcgtgaccatctcctgcagcgggtccgcgagcaacatcggcaagaacttcgtgtcctggtaccagcagctccccgggaaggcccccaagctgatcatctacgaggtcacgaagcggccgagcggcgtgcccgcccgcttctccgggagcaagtccggcaccagcgccaccctggccatcaccggcctccagacgggggacgaggcggactacttctgctccacctggagcggctccctgaacttcgggaccggcacccgggtgacggtcctg

SEQ ID NO: 10142 - RNA, 324 nt, synthetic construct
  misc_feature 1..324: note = derived and/or modified sequence opt1 from anti-HIV_119-021278_VR-Chain
  source 1..324: mol_type = other RNA
cagagcgtgctgacccagcccccgtccgtcagcgccgcccccggccagaaggtgaccatctcctgcagcgggtccgcgagcaacatcggcaagaacttcgtgtcctggtaccagcagctccccgggacggcccccaagctgctgatctacgagaacaaccgccggccgagcggcacccccgaccgcttctccgggagccggtccggcaccagcgccaccctcggcatcacggggctgcagaccggcgacgaggcccactactactgcgagacctgggacgactccgggggcgtcttcgggaccggcacgaaggtgaccgtgctg

SEQ ID NO: 10143 - RNA, 333 nt, synthetic construct
  misc_feature 1..333: note = derived and/or modified sequence opt1 from anti-HIV_119-021183_VR-Chain
  source 1..333: mol_type = other RNA
cagagcgtgctgacccagcccccgtccgtcagcgccgcccccggccagaaggtgaccatctcctgcagcgggaactccagcaacatcggcaacaacttcgtgtcctggtaccagcagttccccgggacggcgcccaagctcctggtcttcgagacccaccgccggccgagcggcatccccgaccgcttctccgggagcaagtccggcaccagcgccaccctggccatcacgggcctccagaccggggacgaggccgactactactgcgccgtgtggggcgtgcggcgcggggtcggcgcggtgttcggggccggcaccaaggtgaccgtcctg

SEQ ID NO: 10144 - RNA, 333 nt, synthetic construct
  misc_feature 1..333: note = derived and/or modified sequence opt1 from anti-HIV_119-019376_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcaggtccccgggacggcgcccaagctcctggtgtacgagacctaccgccggccgtccggcatccccgaccgcttcagcgggtccaagagcggcacctccgccaccctggccatcacgggcctccagaccggggacgaggccgactactactgcaccatctggggcgtgcggaagggggtcggcgccgtgttcgggaccggcacgaaggtgaccgtcctg

SEQ ID NO: 10145 - RNA, 321 nt, synthetic construct
  misc_feature 1..321: note = derived and/or modified sequence opt1 from anti-HIV_119-019238_VR-Chain
  source 1..321: mol_type = other RNA
cagagcgtgctgacccagcccccgtccgtcagcgccgcccccggccagaaggtgaccatctcctgcagcgggacgtccagcaacatcggcaacaaccacgtgtcctggtaccagcaggtccccgggaccgcgcccaagctcctgatctacgagaacaacaagcgcccgagcggcatccccgcccggttctccgccgccaagagcgggacctccgccaccctggcgatcacgggcctccagaccggcgacgaggccgactacttctgcgccacctggagcgggcgcctgaacatcggcaccgggacgaaggtgaccgtgctg

SEQ ID NO: 10146 - RNA, 333 nt, synthetic construct
  misc_feature 1..333: note = derived and/or modified sequence opt1 from anti-HIV_119-018500_VR-Chain
  source 1..333: mol_type = other RNA
cagagcgtgctgacccagcccccgtccgtcagcgccgcccccggccagaaggtgaacatctcctgcagcgggtccagctccaacatcggcaacaacttcgtgagctggtaccagcagcgccccgggaccgcgcccaagctcctgatctacgagacgaaccggcgcccgtccggcatccccgaccggttcagcgggtccaagagcggcacctccgccaccctggccatcaccggcctccagacgggggacgaggccgactactactgcgccacctgggcggccagcctgacctccgcccgcgtcttcggcatcgggaccaaggtgacggtgctg

SEQ ID NO: 10147 - RNA, 324 nt, synthetic construct
  misc_feature 1..324: note = derived and/or modified sequence opt1 from anti-HIV_119-018318_VR-Chain
  source 1..324: mol_type = other RNA
cagagcgtgctgacccagcccccgtccgtcagcgccgcccccggccagaccgtgatcatctcctgcagcgggtccacgagcaacatcggcaagaacgacgtgtcctggtaccagcagctccccgggaccgcgcccaagctgctgatcagcgagaacaaccgccggccgtccggcacccccgaccgcttcagcgggtccaagagcggcacctccgccacgctcgccatcaccggcctgcagaccggggacgacgccgactactactgcgagacctgggacggcagcgggggcgtcttcgggacgggcaccaaggtgaccctggtg

SEQ ID NO: 10148 - RNA, 333 nt, synthetic construct
  misc_feature 1..333: note = derived and/or modified sequence opt1 from anti-HIV_119-018218_VR-Chain
  source 1..333: mol_type = other RNA
cagagcgtgctgacccagcccccgtccgtcagcgccgcccccggccagaaggtgaccatctcctgcagcgggaactccagcaacatcggcaacaacttcgtgtcctggtaccagcagctccccgggacggcgcccaagctgctgatctacgagaacaaccgccggccgagcggcatccccgaccgcttctccgggagcaagtccggcaccagcgccaccctcgccatctccggcctgcagaccggggacgaggccgactactggtgcgccgtctggggcgtgcggcgcggggcgggcgccgtgttcggggccggcacgaaggtcaccgtgctg

SEQ ID NO: 10149 - RNA, 324 nt, synthetic construct
  misc_feature 1..324: note = derived and/or modified sequence opt1 from anti-HIV_119-017876_VR-Chain
  source 1..324: mol_type = other RNA
cagagcgtgctgacccagcccccgtccgtcagcgccgcccccggccagaaggtgaccatctcctgcagcgggtccacgagcaagatcggccagaactccgtgagctggtaccagcagctccccgggaccgcgcccaagctgctgatctacgagaacgaccgccggccgtccggcacccccgaccgcttcagcgcctccaagagcgggacctccgccacgctcgccatcaccggcctgcagaccggcgacgaggccgactactactgcgagacctgggacgacagcgggggcgtcttcgggacgggcaccaaggtgaccgtgctg

SEQ ID NO: 10150 - RNA, 324 nt, synthetic construct
  misc_feature 1..324: note = derived and/or modified sequence opt1 from anti-HIV_119-017740_VR-Chain
  source 1..324: mol_type = other RNA
cagagcgtgctgacccagcccccgtccgtcagcgccgcccccggccagaaggtgaccatctcctgcagcgggtccaacagcaacatcggcaacaaggacgtgtcctggtaccgccaggtccccgcgacggcccccaagctcccgatctacgagaacaagaacgagcccagcggggtgcccgaccggttctccggcagcaagtccgggaccagcgccaccctggccatcaccggcctgcagacgggcgacgaggccgactactactgcgcgacctgggacgggcgcgtgtccgtcatcggcaccgggaccaaggtgacggtggtc

SEQ ID NO: 10151 - RNA, 321 nt, synthetic construct
  misc_feature 1..321: note = derived and/or modified sequence opt1 from anti-HIV_119-017128_VR-Chain
  source 1..321: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgatctacgagaacaacaagcgcccgtccggcatccccgaccggttcagcggggccaagtccggcaccagcgccaccctcgccatcaccggcctgcagacgggggacgaggccgactacttctgctccacctggagcggctccctgaacttcgggaccggcacccgcgtcacggtgctc

SEQ ID NO: 10152 - RNA, 324 nt, synthetic construct
  misc_feature 1..324: note = derived and/or modified sequence opt1 from anti-HIV_119-017044_VR-Chain
  source 1..324: mol_type = other RNA
cagagcgtgctgacccagcccccgtccgtcagcgccgcccccggccagaaggtgaccatctcctgcagcgggtccaacagcaacatcggcaacaactacgtgtcctggtaccaccacctccccgggacggcgccccgcctgctgatctacgacaacaacaagcggccgagcggcatccccgaccgcttctccgggagcaagtccggcaccagcgccaccctcgccatcaccggcctgcagacgggggacgaggccgactactactgcgccacctgggacggccgggtctccgtgatcgggaccggcacccaggtgacggtcctg

SEQ ID NO: 10153 - RNA, 321 nt, synthetic construct
  misc_feature 1..321: note = derived and/or modified sequence opt1 from anti-HIV_119-016644_VR-Chain
  source 1..321: mol_type = other RNA
cagagcgtgctgacccagcccccgtccgtcagcgccgcccccggccagaaggtgaccatctcctgcagcgggggcacgtccaacatcgggaacaactacgtgagctggtaccagcagctccccggcaccgcgcccaagctgctgatctacgagaacaacaagcgcccgtccgggatccccgcccggttcagcgccgccaagtccggcaccagcgccaccctcgcgatcacgggcctgcagaccgaggacgaggccgactactactgcgccacctggtccgggagcctgaacatcggcaccgggacgaaggtcaccgtgctc

SEQ ID NO: 10154 - RNA, 333 nt, synthetic construct
  misc_feature 1..333: note = derived and/or modified sequence opt1 from anti-HIV_119-015878_VR-Chain
  source 1..333: mol_type = other RNA
cagagcgccctgacccagcccccgtccgccagcggctcccccgggcagagcgtgaccatctcctgcagcggctccagctccaacatcgggaacaacttcgtcagctggtaccagcagcgccccggcacggcgcccaagctcctgatctacgagaccaacaagcggccgtccgggatccccgaccgcttcagcggctccaagagcggcacctccgccaccctggccatcacggggctccagaccggcgacgaggccgactactactgcgccacctgggcgccccggctgaacagcgcccgcgtgttcgggaacggcaccatggtgacggtcctg

SEQ ID NO: 10155 - RNA, 321 nt, synthetic construct
  misc_feature 1..321: note = derived and/or modified sequence opt1 from anti-HIV_119-015538_VR-Chain
  source 1..321: mol_type = other RNA
cagagcgtgctgacccagcccccgtccgtcagcgccacccccggccagaaggtgacgatctcctgcagcgggtccagctccaacatcggcaacaactacgtgagctggtaccgccggctccccgggaccgcccccaagcacctgatctacgagaccaacaaccgcccgtccggcgtccccgcgcggctgagcgccgccaagtccgggaccagcgccacgctcgccatcaccggcctgcagaccgaggacgaggcggactactactgcgccacctggtccggcagcctgaacatcgggacgggcaccaaggtgaccgtgctc

SEQ ID NO: 10156 - RNA, 321 nt, synthetic construct
  misc_feature 1..321: note = derived and/or modified sequence opt1 from anti-HIV_119-015455_VR-Chain
  source 1..321: mol_type = other RNA
cagagcgtgctgacccagcccccgtccgtcagcgccacccccggccagaaggtgacgatctcctgcagcgggtccaacagcaacatcggcaacaaggacgtgtcctggtaccagcacttccccgggaccgcccccaagctcctgatctacgagaacaacaagcgcccgagcggcatccccgaccggttctccgggagcaagtccgcgaccagcgccaccctgacgatcaccggcctccagaccgaggacgaggccgactactactgcgccacctggtccggcagcctgaacatcgggacgggcaccaaggtcaccgtgctg

SEQ ID NO: 10157 - RNA, 321 nt, synthetic construct
  misc_feature 1..321: note = derived and/or modified sequence opt1 from anti-HIV_119-014425_VR-Chain
  source 1..321: mol_type = other RNA
cagagcgtgctgacccagcccccgtccgtcagcgccgcccccggccagaaggtgaccatctcctgcagcgggggcacgtccaacatcgggaacaactacgtgagctggtaccagcacctccccggcaccgcgcccaagctgctgatctacgagaacaacaagcgcccgtccgggatccccgaccggttcagcggcgccaagtccggcaccagcgccaccctcgccatcacggggctgcagaccggcgacgagggggactactactgcgccacctggtccggcagcctgaacatcgggaccggcacgaaggtcaccgtgctc

SEQ ID NO: 10158 - RNA, 324 nt, synthetic construct
  misc_feature 1..324: note = derived and/or modified sequence opt1 from anti-HIV_119-013582_VR-Chain
  source 1..324: mol_type = other RNA
cagagcatggtgacccagtcccccagcgtctccgccgccccgggccagaaggtgaccatcagctgctccgggacgagctccaacatcggccagaactacgtgagctggtaccagcagctgcccgggaccgcgcccaagctcctgatctccgagaacaaccgccggcccagcggcaccccggaccgcttctccgggagcaagtccggcaccagcgccacgctggccatcaccggcctccagaccggggacgaggccgactactactgcgagacctgggacggctccgggggcgtcttcgggacgggcaccaaggtgaccgtgctg

SEQ ID NO: 10159 - RNA, 333 nt, synthetic construct
  misc_feature 1..333: note = derived and/or modified sequence opt1 from anti-HIV_119-013364_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgatctacgacaacaacaagcgcccgtccggcatccccgaccggttcagcgggtccaagagcggcacctccgccaccctcgccatcaccggcctgcacacgggggacgaggccgactactactgcaccgtctggggcgtgcgcaagggggtgggcgccgtcttcgggaccggcaccaaggtgacggtgctg

SEQ ID NO: 10160 - RNA, 333 nt, synthetic construct
  misc_feature 1..333: note = derived and/or modified sequence opt1 from anti-HIV_119-012886_VR-Chain
  source 1..333: mol_type = other RNA
cagagcatcctgacccagcccccgtccgtgagcgccgcccccggccagaaggtcaccatctcctgcagcgggtccagctccacgatcggcaccaactacgtgagctggtaccagcagttccccgggaccgcgcccaagctcctggtgttcgagacccaccgccggccgtccggcatccccgaccgcttcagcgggtccaagagcggcacgtccgccaccctggccatcaccggcctccagaccggggacgaggccgactactactgcgccgtctggggcgtgcggcgcggggtgggcgcggtcttcggggccggcacgaaggtgaccgtgctg

SEQ ID NO: 10161 - RNA, 333 nt, synthetic construct
  misc_feature 1..333: note = derived and/or modified sequence opt1 from anti-HIV_119-012249_VR-Chain
  source 1..333: mol_type = other RNA
cagagcgtgctgacccagcccccgtccgtcagcggcgcccccgggcagaaggtgaccatctcctgcagcggctccagctccaacatcgggcgcaactacgtgagctggtaccagcagctccccggcacggcccccaagctgctgatctacgagaacaacaagcggccgtccgggatccccgaccgcttcagcggctccaagagcggcacctccgcgaccctcgtcatcaccgggctgcagacgggcgacgaggccgacttctactgcgggacctgggacggcagcctgtccgggggcggcgtgatcgggaccggcacccgggtgacggtcctc

SEQ ID NO: 10162 - RNA, 324 nt, synthetic construct
  misc_feature 1..324: note = derived and/or modified sequence opt1 from anti-HIV_119-012161_VR-Chain
  source 1..324: mol_type = other RNA
cagagcttcctgacccagcccccgtccgtgagcgccgcccccggccagaaggtcaccatctcctgcagcgggtccaacagcaacatcggcaagaactacgtgtcctggtaccagtacctccccgggacggtgcccaagctgctgatctacgagaacgacaagcgcccgagcggcatccccgggcggttctccgcgagcaagtccggcaccagcgccaccctcgccatcaccggcctgcagacgggggacgaggccgactactactgcggcacctgggacgggtccggcggggtcttcggcaccggcaccaaggtgacggtgctg

SEQ ID NO: 10163 - RNA, 324 nt, synthetic construct
  misc_feature 1..324: note = derived and/or modified sequence opt1 from anti-HIV_119-012110_VR-Chain
  source 1..324: mol_type = other RNA
cagagcgtgctgacccagcccccgtccgtcagcgccgcccccggccagaccgtgacgatctcctgcagcgggtccaccagcaacatcggcaagaacgacgtgtcctggtaccagcagctccccgggaccgcgcccaagctgctgatcagcgagaacaaccgccggccgtccggcacccccgaccgcttcagcgggtccaagagcggcacgtccgccaccctcgccatcagcggcctgcagaccggggacgaggccgactactactgcggcacctgggacgggtccggcggggtcttcggcacgggcaccaaggtgaccgtgctg

SEQ ID NO: 10164 - RNA, 333 nt, synthetic construct
  misc_feature 1..333: note = derived and/or modified sequence opt1 from anti-HIV_119-012100_VR-Chain
  source 1..333: mol_type = other RNA
caggccgtgctgacccagcccccgagcgtctccgccgcgcccggccagaaggtggccatcagctgctccgggagctccagcaacatcggcaacaactacgtgtcctggtaccagcagctccccgggaccgtccccaagctgctgatctacgacacggacaagcgcccgagcggcatccccgaccggttctccgggagcaagtccggcaccagcgccaccctcggcatcacccgcctgcagacgggggacgaggccgactactactgcgccacctgggcgccccggctgaactccgcccgcgtgttcggcaacgggaccatggtgaccgtcctc

SEQ ID NO: 10165 - RNA, 324 nt, synthetic construct
  misc_feature 1..324: note = derived and/or modified sequence opt1 from anti-HIV_119-011651_VR-Chain
  source 1..324: mol_type = other RNA
cagagcgtgctgacccagcccccgtccgtcagcgccgcccccggccagaaggtgaccatctcctgcagcgggaactccagcaacatcggcaacaactacgtgtcctggtaccagcagctccccgggacggcgcccaagctgctgatctacgagaacaacaagcgcccgagcggcatccccgaccggttctccgggagcaagtccggcaccagcgccaccctcgccatcaccggcctgcagacgggggacgaggccgactactactgcgccacctgggacggccgcgtctccgtgttcgggaccggcaccaaggtggcggtcctg

SEQ ID NO: 10166 - RNA, 333 nt, synthetic construct
  misc_feature 1..333: note = derived and/or modified sequence opt1 from anti-HIV_119-011479_VR-Chain
  source 1..333: mol_type = other RNA
cagagcgtgctgacccagcccccgtccgtcagcgccacccccggccagaaggtgacgatctcctgcagcgggtccaacagcaacatcggcaacaagtacgtgtcctggtaccagcacttccccgggaccgcccccaagctcctgatctacgagaacaaccgccggccgagcggcatccccgaccgcttctccgggagcaagtccggcaccagcgcgaccctggccatcacgggcctccagaccggggacgaggccgactactactgcaccatctggggcgtccggaagggggtgggcgccgtgttcgggaccggcacgaaggtcaccgtgctg

SEQ ID NO: 10167 - RNA, 333 nt, synthetic construct
  misc_feature 1..333: note = derived and/or modified sequence opt1 from anti-HIV_119-011232_VR-Chain
  source 1..333: mol_type = other RNA
cagagcgtgctgacccagcccccgtccgtcagcgccgcccccggccagaacgtgaacatctcctgcagcgggggctccagcaacatcgggtccaactacgtgagctggtaccagcagttccccggcaccgcgcccaagctcctgatctacgacgacgacaagcggccgtccgggatcccccaccggttcagcgcctccaagagcggcacgtccgccaccctggccatcagcggcctccagaccggggacgaggccgactactgctgcgcggtctggggcgtgcgccgcggggccggcgccgtgttcggggccggcaccaaggtcacggtgctg

SEQ ID NO: 10168 - RNA, 333 nt, synthetic construct
  misc_feature 1..333: note = derived and/or modified sequence opt1 from anti-HIV_119-011175_VR-Chain
  source 1..333: mol_type = other RNA
cagagcgtgctgacccagcccccgtccgtcagcgccgcccccggccagaaggtgaccatctcctgcagcgggtccaacagctacatcggcaacaagtacgtgtcctggtaccagcagttccccgggacggcgcccaagctcctgatctacgagaacaaccgccggccgagcggcatccccgaccgcttctccgggagcaagtccggcaccagcgccaccctggccatctccggcctccagaccggggacgaggccgactactgctgcgccgtctggggcgtgcggcgcggggcgggcgccgtgttcgggcccggcacgaaggtcaccgtgctg

SEQ ID NO: 10169 - RNA, 321 nt, synthetic construct
  misc_feature 1..321: note = derived and/or modified sequence opt1 from anti-HIV_119-008396_VR-Chain
  source 1..321: mol_type = other RNA
cagagcgtgctgacccagcccccgtccgtcagcgccgcccccggccagaaggtgaccatctcctgcagcgggtccagctccaacatcggcaacaactacgtgagctggtaccagcaggtccccgggacggcgcccaagctcctggtgtacgagaacacccgccggccgtccggcgtgcccgaccgcttcagcggggccaagtccggcaccagcgccaccctggccatcacgggcctccagaccggggacgagggcgactactactgcgccacctggtccgggagcctgaacatcggcaccgggacgaaggtcaccgtgctg

SEQ ID NO: 10170 - RNA, 324 nt, synthetic construct
  misc_feature 1..324: note = derived and/or modified sequence opt1 from anti-HIV_119-007148_VR-Chain
  source 1..324: mol_type = other RNA
cagagcgtgctgacccagcccccgtccgtcagcgccgcccccggccagaaggtgaccatctcctgcagcgggtccacgagcaacatcggcaagaactacgtgtcctggtaccagcacctccccgggaccgcgcccaagctgctgctctacgagaacgaccgccggccgagcggcacccccgaccgcttctccgggagcaagtccggcaccagcgccacgctggccatcaccggcctgcacaccggggacgaggccgactactactgcgagacctgggacggctccgggggcgtcttcgggacgggcaccaaggtgaccgtgctc

SEQ ID NO: 10171 - RNA, 333 nt, synthetic construct
  misc_feature 1..333: note = derived and/or modified sequence opt1 from anti-HIV_119-007029_VR-Chain
  source 1..333: mol_type = other RNA
cagagcgtgctgacccagcccccgtccgtcagcgccgcccccggccagaaggtgaccatctcctgcagcgggaactccagcaacatcggcaacaacttcgtgtcctggtaccagcaggtccccgggacggcgcccaagctcctgctgtacgagacctaccgccggccgagcggcatctccgaccgcttcagcgggtccaagagcggcacctccgccaccctcgccatcacgggcctgcagaccggggacgaggccgactactactgcaccgtgtggggcgtgcggaagggggtcggcgccgtgttcgggaccggcacgaaggtgaccgtcctg

SEQ ID NO: 10172 - RNA, 324 nt, synthetic construct
  misc_feature 1..324: note = derived and/or modified sequence opt1 from anti-HIV_119-004707_VR-Chain
  source 1..324: mol_type = other RNA
cagagcgtgctgacccagcccccgtccgtcagcgccgcccccggccagaaggtgaccatctcctgcagcgggtccacgagcaacatcggcaagaacgacgtgtcctggtaccagcagctccccgggaccgcgcccaagctgctgatcagcgagaacaaccgccggccgtccggcacccccgaccgcttcagcgggtccaagagcggcacctccgccacgctcgccatcaccggcctgcagaccggggacgaggccgactactactgcgagacctgggacggcagcgggggcgtcttcgggacgggcaccaaggtgaccgtgctg

SEQ ID NO: 10173 - RNA, 333 nt, synthetic construct
  misc_feature 1..333: note = derived and/or modified sequence opt1 from anti-HIV_119-003910_VR-Chain
  source 1..333: mol_type = other RNA
cagagcgtgctgacccagcccccgtccgtcagcgccgcccccggccagaaggtggcgatctcctgcagcgggaacacctccagcatcggcaacaacttcgtgtcctggtaccagcaggtccccgggacggcccccaagctcctggtgtacgagacctaccgccggccgagcggcatccccgaccgcttctccgggagcaagtccggcaccagcgccaccctggccatcacgggcctccagaccggggacgaggccgactactactgcaccgtgtggggcgtccggaagggggtgggcgcggtgttcgggaccggcacgaaggtcaccgtgctg

SEQ ID NO: 10174 - RNA, 321 nt, synthetic construct
  misc_feature 1..321: note = derived and/or modified sequence opt1 from anti-HIV_119-002450_VR-Chain
  source 1..321: mol_type = other RNA
cagagcgtgctgacccagcccccgtccgtcagcggcgcccccgggcagcgcgtgaccatctcctgcacgggcagctccagcaacatcgggaacaactacgtgtcctggtaccagggcctccccgggaccgcccccaagctgctgatctacgagaacaacaagcggccgagcggcatccccgaccgcttctccggcgccaagagcgggaccgcggccaccctcgccatcacgggcctgcagaccggggacgaggccgactactactgcgcgacctggtccggcagcctgaacttcgggaccggcacgaaggtcaccgtgctc

SEQ ID NO: 10175 - RNA, 321 nt, synthetic construct
  misc_feature 1..321: note = derived and/or modified sequence opt1 from anti-HIV_119-001552_VR-Chain
  source 1..321: mol_type = other RNA
cagagcgtgctgacccagcccccgtccgtcagcgccgcccccggccagaaggtgaccatctcctgcagcgggtccaacagctacctcggcaacaagtacgtgtcctggtaccagcagttccccgggacggcgcccaagctgctgatctacgagaacaacaagcgcccgagcggcatccccgaccggttctccgccagcaagtccgccgccagcgccaccctcgcgatcaccgggctgcagaccggcgacgagggcgactactactgcgccacgtggaccgggtccctgaacatcggcaccgggaccaaggtcacggtgctc

SEQ ID NO: 10176 - RNA, 333 nt, synthetic construct
  misc_feature 1..333: note = derived and/or modified sequence opt1 from anti-HIV_059-188169_VR-Chain
  source 1..333: mol_type = other RNA
cagagcgtgctgacccagcccccgtccgtcagcgccgcccccggccagaaggtgaccatctcctgcagcgggtccacgagcaacatcggcgacaactacgtgtcctggtaccagcaggtccccgggaccgcgcccaagctcctgatctacgagaacaaccgccggccgagcggcacccccgaccgcttctccgggagcaagtccggcaccagcgccacgctggccatcaccggcctccagaccggggacgaggccgactactactgcggcacctgggacacgtccctgagcaccgggggcgtgttcgggaccggcaccaaggtgacggtcctg

SEQ ID NO: 10177 - RNA, 333 nt, synthetic construct
  misc_feature 1..333: note = derived and/or modified sequence opt1 from anti-HIV_059-183739_VR-Chain
  source 1..333: mol_type = other RNA
cagagcgtgctgacccagcccccgtccgtcagcgccgcccccggccagaaggtgaccatctcctgcagcgggtccacgagcaacatcggcaagaactacgtgtcctggtaccagcagctccccgggaccgcgcccaagctgctgatctacgagaacaaccgccggccgagcggcacccccgaccgcttctccgggagcaagtccggcaccagcgccacgctcggcatctccgggctgcagaccggcgacgaggccgactactactgcgggacctgggacaccagcctgtccggcgggggcgtcttcggcacggggaccaaggtgaccgtgctc

SEQ ID NO: 10178 - RNA, 333 nt, synthetic construct
  misc_feature 1..333: note = derived and/or modified sequence opt1 from anti-HIV_059-182376_VR-Chain
  source 1..333: mol_type = other RNA
cagagcgtgctgtcccagcccccgagcgtctccgccgcccccggccagaaggtgaccatcagctgctccgggagctccagcaacatcggcaactactacgtgtcctggtaccagcagttccccgggaccgcgcccaagctcctgatctacaagaacgacaaccgcccgagcggcatccccgaccggttctccgggagcaagtccggcacgagcgccaccctgggcatctccgggctccagaccggcgacgaggccgactactactgcgggacctggggcacgagcctgtccgggggcggcgtcttcgggaccggcaccaaggtgaccgtgctg

SEQ ID NO: 10179 - RNA, 333 nt, synthetic construct
  misc_feature 1..333: note = derived and/or modified sequence opt1 from anti-HIV_059-182199_VR-Chain
  source 1..333: mol_type = other RNA
cagagcgtgctgacccagcccccgtccgtcagcgccgcccccggccagaacatcaccatctcctgcagcgggtccagctccaacatcggcagccactccatcagctggtaccagcacctccccgggacggcgcccaagatcgtgatctacgacaacgacaagcgcccgctgggcatccccgaccggttctccgggagcaagtccggcaccagcgccaccctgggcatcaccgggctccagacgggcgacgaggccgactactactgcgggacctgggacacctccctgagcggcgggggcgtgttcggccccgggaccaaggtcacggtgctg

SEQ ID NO: 10180 - RNA, 324 nt, synthetic construct
  misc_feature 1..324: note = derived and/or modified sequence opt1 from anti-HIV_059-169202_VR-Chain
  source 1..324: mol_type = other RNA
cacagcgtgctgacccagcccccgtccgtcagcgccgcccccggccagaaggtgaccatctcctgcagcgggtccagctccaagatcggcaacaacttcgtgagctggtaccagcagctccccgggacggcgcccaagctgctgatctacgagaacaacaagcgcccgtccggcatccccgaccggttcagcgggtccaagagcggcacctccgccaccctcgccatcaccggcctgcagacgggggacgaggccgactactactgcggcacctgggacgggcgcgtcagcgtgatcggctccgggaccaagctgaccgtgctc

SEQ ID NO: 10181 - RNA, 324 nt, synthetic construct
  misc_feature 1..324: note = derived and/or modified sequence opt1 from anti-HIV_059-155645_VR-Chain
  source 1..324: mol_type = other RNA
cagagcgccctgacccagcccgcctccgtgagcggctccccggggcagagcatcaccatctcctgcacgggcaccagctccgacgtcgggtacaactacgtgagctggtaccagcagctccccggcaccgcgcccaagctgctgatctacgagaacaacaagcgcccctccgggatcccggaccggttcagcggctccaagagcggcacctccgccacgctcgccatcaccgggctgcagaccggcgacgaggccgactactactgcgggacctgggacggccgcctgagcgtgatcgggacgggcaccaaggtcaccgtgctc

SEQ ID NO: 10182 - RNA, 333 nt, synthetic construct
  misc_feature 1..333: note = derived and/or modified sequence opt1 from anti-HIV_059-151619_VR-Chain
  source 1..333: mol_type = other RNA
cagagcgtgctgacccagcccccgtccgtcagcgccgcccccggccagaaggtgaccatctcctgcagcgggtccagctccaacatcggcaacaacttcgtgagctggtaccagctcctgcccgggacgcccccgaagctgctcatcttcaagaacaacgagcgcccctccggcatccccgaccggttcagcgggtccaagagcggcacctccgcgaccctgggcatcaccgggctgcagacgggcgacgagggggactactactgcggcacctgggacaccagcctctccgggggcggcgtcttcgggaccggcacgcgcgtgaccgtgctg

SEQ ID NO: 10183 - RNA, 333 nt, synthetic construct
  misc_feature 1..333: note = derived and/or modified sequence opt1 from anti-HIV_059-146503_VR-Chain
  source 1..333: mol_type = other RNA
cagagcgtgctgacccagcccccgtccgtcagcgccacccccggccagaaggtgacgatctcctgcagcgggtccgccagcaacatcggcaacaactacgtgtcctggtaccagcagttccccgggaccgcgcccaagctcctgatctacgacaccaacaagcgcccgagcggcatccccgaccggttctccgggagcaagtccggcaccagcgccatcctgggcatcacggggctccagatcggcgacgaggccgactactactgcgggacctgggacacctccctgagcggcgggggcgtcttcggcaccgggacgaaggtgaccgtgctg

SEQ ID NO: 10184 - RNA, 324 nt, synthetic construct
  misc_feature 1..324: note = derived and/or modified sequence opt1 from anti-HIV_059-136098_VR-Chain
  source 1..324: mol_type = other RNA
cagagcgtgctgacccagcccccgtccgtcagcgccgcccccggccagcgcgtgaccatctcctgcagcgggtccagctccaacatcggcaacaactacgtgagctggtaccagcagctccccgggacggcgcccaagctgctgatctacgagaacaaccggcgcccgtccggcatccccgaccggttcagcgggtccaagagcggcacctccgccaccctcgccatcaccggcctgcagacgggggacgagggcgactactactgcgcccgctgggacgggcggctgagcgtcatcggctccgggaccaaggtgaccgtgctc

SEQ ID NO: 10185 - RNA, 333 nt, synthetic construct
  misc_feature 1..333: note = derived and/or modified sequence opt1 from anti-HIV_059-105516_VR-Chain
  source 1..333: mol_type = other RNA
cagagcgccctgacccagcccccgtccgtgagcgccgcgcccggccagaaggtcaccatctcctgcagcgggtccagctccaacatcggcaacaactacgtgagctggtaccagcagctccccgggacggcccccaagctgctgatctacgacaacaacaagcgcccgtccggcatccccgaccggttcagcgggtccaagagcggcacctccgccaccctcgccatcgccggcctgcagaccggggacgaggcgaactactactgcggcacgtgggacgggagcctgcgcaccggcggggtgttcggcaccggcaccaaggtcacggtgctc

SEQ ID NO: 10186 - RNA, 333 nt, synthetic construct
  misc_feature 1..333: note = derived and/or modified sequence opt1 from anti-HIV_059-095709_VR-Chain
  source 1..333: mol_type = other RNA
cagagcgtgctgacccagcccccgtccgtcagcgccgcccccggccagaaggtgaccatctcctgcagcgggcgctccagcaacatcggcaacaacttcgtgtcctggtaccagctcctgcccgggacggcgcccaagctgctcatctacaagaacaacgagcggccgagcggcatccccgaccgcttctccgccagcaagtccgggaccagcgccaccctgggcatcaccggcctgcagacgggggacgaggccgactactactgcggcacctgggacacctccctcagcgggggcggggtcttcggcaccggcacgaaggtgaccgtgctg

SEQ ID NO: 10187 - RNA, 333 nt, synthetic construct
  misc_feature 1..333: note = derived and/or modified sequence opt1 from anti-HIV_059-069468_VR-Chain
  source 1..333: mol_type = other RNA
cagagcgtgctgacccagcccccgtccgtcagcggcgcgccccgccagtccgtgatcatcagctgcaccgggtccagctccaacatcggcgggttcgacgtgcactggtaccagcagctccccggcacggcccccaagctgctgatctacgagaacaaccggcgcccgagcgggacccccgaccggttctccggcagcaagtccggcaccagcgccaccctcgccatcacggggctgcagaccggcgacgaggccgactactactgcgggacctgggacggctccctgagcaccgggggcgtcatcggcacggggaccaaggtgaccgtgctc

SEQ ID NO: 10188 - RNA, 333 nt, synthetic construct
  misc_feature 1..333: note = derived and/or modified sequence opt1 from anti-HIV_059-060026_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggtccccaagctgctgatctacaagaacgacaagcgcccgtccggcatccccgaccggttcagcgggtccaagagcgcgacctccgccaccctcggcatcaccggcctgcagacgggggacgaggccgactactactgcggcatctgggacaccagcctgtccgccgggggcgtgttcgggaccggcacccgcgtgacggtcctc

SEQ ID NO: 10189 - RNA, 333 nt, synthetic construct
  misc_feature 1..333: note = derived and/or modified sequence opt1 from anti-HIV_059-053668_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgatctacgagaacaacaagcgctccagcggcatcccggaccggttctccgggagcaagtccggcaccagcgccaccctcgccatcaccggcctgcagacgggggacgaggccgactactactgcggcacccgcgactccagcctgtccgggggcggggtcatcggcaccggcaccaaggtgacggtgctc

SEQ ID NO: 10190 - RNA, 333 nt, synthetic construct
  misc_feature 1..333: note = derived and/or modified sequence opt1 from anti-HIV_059-052864_VR-Chain
  source 1..333: mol_type = other RNA
cagagcgtgctgacccagcccccgtccctcagcgccgcccccggccagcgcgtcaccatctcctgcagcgggtccagctccaacatcggcaacaactacgtgagctggtaccagcagctgcccgggacggcgcccaagctgctcatctacgagtccaacaagcggccgagcggcacccccgaccgcttctccgggagcaagtccggcaccagcgccaccctggccatcacgggcctgcagaccggggacgaggccgactactactgcggcacctgggacgcctccctcagctccgggggcgtgatggggaccggcacgaaggtcaccgtgctg

SEQ ID NO: 10191 - RNA, 333 nt, synthetic construct
  misc_feature 1..333: note = derived and/or modified sequence opt1 from anti-HIV_059-050968_VR-Chain
  source 1..333: mol_type = other RNA
cagagcgtgctgacccaggccccctccgtcagcgccgcgccgggcgagaaggtgaccatctcctgcagcgggacgtccagcaacatcggctactactacgtgtcctggtaccagcagttccccgggaccgcccccaaggtcgtgatctacgagaacaaccgccggcccagcggcaccccggaccgcttctccgggagcaagtccggcaccagcgccacgctcgccatcaccggcctgcagaccggggacgaggccgactactactgcggcacctggggcgggtccctgagcaccgggggcgtgatcggcacggggaccaaggtcaccgtgctc

SEQ ID NO: 10192 - RNA, 333 nt, synthetic construct
  misc_feature 1..333: note = derived and/or modified sequence opt1 from anti-HIV_059-046422_VR-Chain
  source 1..333: mol_type = other RNA
cagagcgtgctgacccagcccccgtccgtcagcgccgcccccggccagaaggtgaccatctcctgcagcgggtccagctccacgatcggcaacaactacatcagctggtaccagctcctgcccgggacgcccccgaactacctgatcttcaagatctccgagcgccccagcggcgtgcccgaccggttctccgggagcaagtccggcaccagcgcgaccctccacatcaccggcctgcagaccggggacgagggcgactactactgcgggacctgggacacctccctgagcggcgggggcgtcttcggcacggggaccaaggtgaccgtgctc

SEQ ID NO: 10193 - RNA, 333 nt, synthetic construct
  misc_feature 1..333: note = derived and/or modified sequence opt1 from anti-HIV_059-045120_VR-Chain
  source 1..333: mol_type = other RNA
cagagcgtgctgacccagcccccgtccgtcagcgccgcccccggccagaaggtggcgatctcctgcagcgggtccagctccaccatcggcaacaactacgtgagctggtaccagctcctgcccgggacgcccccgaagctgctcatcttcaagtcccacgagcgccccagcggcatccccgaccggttctccgggagcaagtccggcaccagcgccaccctgggcatcaccgggctgcagacgggcgacgagggggactactactgcggcacctgggactccagcctctccgtcgggggcgtgttcggcaccgggaccaaggtgacggtcctg

SEQ ID NO: 10194 - RNA, 333 nt, synthetic construct
  misc_feature 1..333: note = derived and/or modified sequence opt1 from anti-HIV_059-039932_VR-Chain
  source 1..333: mol_type = other RNA
cagagcgtgctgacccagcccccgtccgtcagcgccgcccccggccagaaggtgaccatctcctgcagcgggtccagctccatcatcggcaagaactacgtgagctggtaccagcacctccccgggacggcgcccaagctgctgatctacgagaacaacaagcgcccgtccggcatccccgaccggttcagcgggtccaagagcggcacctccgccaccctcgccatcgccggcctgcagaccggggacgaggccaactactactgcggcacgtggggcgggagcctgtccaccgggggcgtcttcggcaccgggaccaaggtgacggtgctc

SEQ ID NO: 10195 - RNA, 333 nt, synthetic construct
  misc_feature 1..333: note = derived and/or modified sequence opt1 from anti-HIV_059-038595_VR-Chain
  source 1..333: mol_type = other RNA
cagagcgtgctgacccagcccccgtccgtcagcgccgcccccggccagaaggtgaccatctcctgcagcgggcgctccagcaacatcggcaacaacttcgtgtcctggtaccagcagctccccgggacggcgcccaagctgctgatctacgagaacaacaagcggccgagcggcatccccgaccgcttctccgggagcaagtccggcaccagcgccaccctcggcatcaccgggctgcagacgggcgacgaggccgactactactgcgggacctgggacacctccctgagcgccggcggggtcttcggctccggcaccaaggtgatcgtgctc

SEQ ID NO: 10196 - RNA, 333 nt, synthetic construct
  misc_feature 1..333: note = derived and/or modified sequence opt1 from anti-HIV_059-035082_VR-Chain
  source 1..333: mol_type = other RNA
cagagcgtgctgacccagcccccgtccgtcagcgccgcccccggccagaaggtgaccatctcctgcagcgggtccacgagcaacatcggcaagtccttcgtgagctggtaccagcagctccccgggaccgcgcccaagctgctgatctacgacaacaaccgccggccgtccggcacccccgaccgcttcagcgggtccaagagcggcacctccgccacgctcgccatcaccggcctgcagaccggggacgaggccgactactactgcggcacctggggcgggagcctgtccaccgggggcgtcatcggcacggggaccaaggtgaccgtgctc

SEQ ID NO: 10197 - RNA, 333 nt, synthetic construct
  misc_feature 1..333: note = derived and/or modified sequence opt1 from anti-HIV_059-029204_VR-Chain
  source 1..333: mol_type = other RNA
cagagcgtgctgacccagcccccgtccgtcagcgccgcccccggccagaaggtgaccatctcctgcagcgggtccacgagcaacatcggcaagatcctcgtgtcctggtaccagcagctgcccgggaccgcgcccaagccgagcatctacgacaacaaccgccggccctccggcacccccgaccgcttcagcgggtccaagagcggcacctccgccacgctggccatcaccggcctccagaccggggacgaggccgactactactgcggcacctgggacgggagcctgtccacgggcggggtcatcggcaccggcaccaaggtgaccgtgccc

SEQ ID NO: 10198 - RNA, 324 nt, synthetic construct
  misc_feature 1..324: note = derived and/or modified sequence opt1 from anti-HIV_059-025235_VR-Chain
  source 1..324: mol_type = other RNA
cagagcgtgctgacccagcccccgtccgtcagcggcgcccccgggcagaagatcaccatctcctgcagcggctccacgagcaacatcgggaagtcctacgtgagctggtaccagcagctccccggcaccgcccccaagctgctgatctacgagaacaaccgccggccgtccgggacccccgaccgcttcagcggctccaagagcggcacctccgcgacgctcgccatcaccgggctgcagaccggcgacgaggccgactactactgcgggacctgggacggcagcgggggcgtgatcggcacggggaccaaggtcaccgtgctg

SEQ ID NO: 10199 - RNA, 333 nt, synthetic construct
  misc_feature 1..333: note = derived and/or modified sequence opt1 from anti-HIV_059-015192_VR-Chain
  source 1..333: mol_type = other RNA
cagagcgtgctgacccagcccccgtccgtcagcgccgcccccggccagaaggtgaccatctcctgcagcgggtccagctccacgatcggcgacaagtacgtgagctggtaccagctcctgcccgggaccgcgcccaagctgctcatctacaagaacaacaagcgcccgtccggcatccccgaccggttcagcgggtccaagagcggcacctccgccaccctgggcatcacggggctgcagaccggcgacgaggccgactactactgcgggacctgggacaccagcctctccgtcggcggggtgttcggcacgggcaccaaggtgaccgtcctg

SEQ ID NO: 10200 - RNA, 333 nt, synthetic construct
  misc_feature 1..333: note = derived and/or modified sequence opt1 from anti-HIV_059-007060_VR-Chain
  source 1..333: mol_type = other RNA
cagagcgtgctgacccagcccccgtccgtcagcgccgcccccggccagaaggtgaccatctcctgcagcgggtccagctccaacatcggcaacaagtacgtgagctggtaccagcagctccccgggacggcgcccaagctgctgatctacgagaacaagaagcgcccgtccggcatccccgaccggttcagcgggtccaagagcggcacctccgccaccctcggcatcaccgggctgcagacgggcgacgaggccgactacttctgcgggacctgggacaccagcctgtccggcgggggcgtcttcggcagcgggaccaaggtgacggtgctc

SEQ ID NO: 10201 - RNA, 324 nt, synthetic construct
  misc_feature 1..324: note = derived and/or modified sequence opt1 from anti-HIV_059-006953_VR-Chain
  source 1..324: mol_type = other RNA
cagagcgtgctgacccagcccccgtccgtcagcgccgcccccggccagaaggtgaccatctcctgcagcgggtccagctccaacatcggcgtgagctggtaccagcaggtccccgggacggcgcccaagctcctgatctacgacaacgacaagcgcccgaccggcatccccgaccggttctccgggagcaagtccggcaccagcgccatcctggccatcaccggcctccagacgggggacgagggcgactactactgcgggacctgggagacctccctgagcggcgggggcgtgttcggcaccgggacgaaggtgaccgtcctg

SEQ ID NO: 10202 - RNA, 333 nt, synthetic construct
  misc_feature 1..333: note = derived and/or modified sequence opt1 from anti-HIV_059-005953_VR-Chain
  source 1..333: mol_type = other RNA
cacagcgtgctgacccagcccccgtccgtcagcgccgcccccggccagaaggtgaccatctcctgcagcgggacgtccagcaacatcggcaagaactacgtgtcctggtaccagcagctccccgggaccgcgcccaagctgctgatctacgagaacaaccgccggccgagcggcacccccgaccgcttctccgggagcaagtccggcaccagcgccacgctcgccatcaccggcctgcagaccggggacgaggccgactactactgcggcacctgggacacgtccctgagcaccgggggcgtcttcgggaccggcaccaaggtgacggtgctc

SEQ ID NO: 10203 - RNA, 324 nt, synthetic construct
  misc_feature 1..324: note = derived and/or modified sequence opt1 from anti-HIV_059-003725_VR-Chain
  source 1..324: mol_type = other RNA
cagagcgtgctgacccagcccccgtccgtcagcgccgcccccggccagaagctcaccatctcctgcagcgggtccacgagcaagatcggcaacaactacgtgtcctggtaccagcacctccccgggaccgcgcccaagctgctggtgtacgagaacaacaagcgcccgagcggcatccccgaccggttctccgggagcaagtccggcaccagcgccaccctggccatcacgggcctgcagaccggggacgaggccgactactactgcggcacctgggacgggcgcctctccgtcatcggcaccgggacgaaggtgaccgtgctg

SEQ ID NO: 10204 - RNA, 333 nt, synthetic construct
  misc_feature 1..333: note = derived and/or modified sequence opt1 from anti-HIV_059-002618_VR-Chain
  source 1..333: mol_type = other RNA
cagctggtgctcacccagcccccgagcgtctccgccgcccccggccagaaggtgaccatcagctgctccgggagctccagcaacatcggcaacaacttcgtgtcctggtaccagcagctgcccgggacggcgcccaagctgctcatctacgagaacaacaagcgcccgagcggcatccccgaccggttctccgggagcaagtccggcaccagcgccaccctgggcatcaccgggctgcagacgggcgacgaggccgactactactgcgggacctgggacacccgcctctccgccggcggggtcttcggcaccggcacgaaggtgaccgtgctg

SEQ ID NO: 10205 - RNA, 324 nt, synthetic construct
  misc_feature 1..324: note = derived and/or modified sequence opt1 from anti-HIV_059-001522_VR-Chain
  source 1..324: mol_type = other RNA
cagagcgtgctgacccagcccccgtccgtcagcgccgcccccggccagaaggtgaccatctcctgcagcgggtccaacagcaacatcggcaacaactacgtgtcctggtaccagcagctccccgggacggcgcccaagctgctgatctacgagaacaacaagcgcccgagcggcatccccgaccggttctccgggagcaagtccggcaccagcgccaccctcgccatcaccggcctgcagacgggggacgaggccgactactactgcggcacctgggacgggcgcctgtccgtcatcggcgccgggaccaaggtgatcgtggtc

SEQ ID NO: 10206 - RNA, 333 nt, synthetic construct
  misc_feature 1..333: note = derived and/or modified sequence opt1 from anti-HIV_059-000731_VR-Chain
  source 1..333: mol_type = other RNA
cagagcgtgctgacccagcccccgtccgtcagcgccgcccccggccagaaggtgaccatctcctgcagcgggtccacgagcaacatcggcaacaagtacgtgtcctggtaccagcaggtccccgggaccgcgcccaagctcctgatctacgagaacaaccgccggccgagcggcatccccgaccgcttctccgggagcaagtccggcaccagcgccaccctggccatcacgggcctccagaccggggacgaggccgactactactgcggcacctgggacgcctccctgcggaccgggggcgtgatcgggacgggcaccaaggtgaccgtcctg

SEQ ID NO: 10207 - RNA, 333 nt, synthetic construct
  misc_feature 1..333: note = derived and/or modified sequence opt1 from anti-HIV_059-000634_VR-Chain
  source 1..333: mol_type = other RNA
cagagcgtgctgacccagcccccgtccgtcagcgccgcccccggccagaaggtgaccatctcctgcagcgggtccagctccacgatcggcaacaactacgtgagctggtaccaggtcgtgcccgggaccgcgcccaagctcctgatctacaagatcaacgagcgcccgtccggcatccccgaccggttcagcgggtccaagagcggcacctccgccaccctgggcatcacggggctccagaccggcgacgaggccgactactactgcgggacctgggacaccagcctgtccggcgggggcgtgttcggccccgggacgaaggtcaccgtgctg

SEQ ID NO: 10208 - RNA, 333 nt, synthetic construct
  misc_feature 1..333: note = derived and/or modified sequence opt1 from anti-HIV_048-250757_VR-Chain
  source 1..333: mol_type = other RNA
cagagcgtgctgacccagcccccgtccgtcagcggcgcccccgggcagcgcgtgaccatctcctgcacgggcaccaccagcaacatcgggtccaactacgtggcctggtaccagcagctccccggcaccgcgcccaagctgctgatctacgacaacgacaagcggccgagcgggatccccgaccgcttctccggcagcaagtccggcacgagcgccaccctcgggatcaccggcctgcagaccggggacgaggccgactactactgcggcacgtgggacacctccctgagcgccgggggcgtcttcggcaccgggaccaaggtgacggtgctc

SEQ ID NO: 10209 - RNA, 333 nt, synthetic construct
  misc_feature 1..333: note = derived and/or modified sequence opt1 from anti-HIV_048-250716_VR-Chain
  source 1..333: mol_type = other RNA
cagagcgtgctgacccagcccccgtccgtcagcgccgcccccggccagaaggtgaccatctcctgcagcgggtccagctccaacatcggcaacaagtacgtgagctggtaccagcagctccccgggacggcgcccaagctgctgatctacgagaactccaagcgcccgagcggcatccccgaccggttctccgggagcaagtccggcaccagcgccaccctcggcatcaccgggctgcagacgggcgggcaggccgactactactgcggcacctgggacacctccctgagcgccgggggcgtcttcggctccgggaccaaggtgacggtgctc

SEQ ID NO: 10210 - RNA, 333 nt, synthetic construct
  misc_feature 1..333: note = derived and/or modified sequence opt1 from anti-HIV_048-250463_VR-Chain
  source 1..333: mol_type = other RNA
cagagcgtgctgacccagcccccgtccgtcagcgccgcccccggccagaaggtgaccatctcctgcagcgggtcccgcagcaacaacggcaacaactacgtgtcctggtaccagcagctccccgggacggcgcccaagctgctgatctacgagaacaacaagcggccgagcggcatccccgaccgcttctccgggagcaagtccggcaccagcgccaccctcgccatcaccggcctgcagacgggggacgaggccgactactactgcggcacctgggactccagcctgtccgggggcggggtcatcggcaccggcaccaagctcacggtgctg

SEQ ID NO: 10211 - RNA, 333 nt, synthetic construct
  misc_feature 1..333: note = derived and/or modified sequence opt1 from anti-HIV_048-248153_VR-Chain
  source 1..333: mol_type = other RNA
cagagcgccctgacccagcccgcctccgtgagcgcgtccttcggccagagcatcaccatctcctgcacgggggccgccagcgacgtcggctacaactacgtgtcctggtaccagcagctcccggggaccacccccaagctgctgatctaccgcaacaaccagcggcccagcggcatccccgaccgcttctccgggagcaagtccggcaccagcgccacgctcggcatcaccgggctgcagaccggcgacgaggccgactactactgcgggacctgggacacgtccctgagcgcgggcggggtgttcggcaccggcaccaaggtcaccgtgctc

SEQ ID NO: 10212 - RNA, 333 nt, synthetic construct
  misc_feature 1..333: note = derived and/or modified sequence opt1 from anti-HIV_048-247532_VR-Chain
  source 1..333: mol_type = other RNA
cagagcgtgctgacccagcccccgtccgtcagcgccgcccccggccagcaggtcaccatctcctgcagcgggacgacctccaacatcggcaccaactacgtgagctggtaccagcagatgccgcccgcggcccccaagctcctgatctacgacaacaagaagcgcccctccgacatccccgaccggttcagcgggtccaagagcggcacctccgccacgctggggatcaccggcctccagaccggcgacgaggccgactactactgcgggacctgggacacgagcctgtccgccggcggggtgttcggcaccgggaccaaggtgaccgtgctg

SEQ ID NO: 10213 - RNA, 333 nt, synthetic construct
  misc_feature 1..333: note = derived and/or modified sequence opt1 from anti-HIV_048-245846_VR-Chain
  source 1..333: mol_type = other RNA
cagagcgtgctgacccagcccccgtccgtcagcgccacccccggccagcgcgtgacgatctcctgcaccgggagctccagcaacatcggcgggtacgacgtgtcctggtaccaggtcctccccggcaccgcccccaagctgctgatctacgacagcgacaagcggccgtccgggatccccgaccgcttcagcggctcccagagcggcacctccgcgacgctcgggatcaccggcctgcagaccggggacgaggccgactactactgcggcacctgggacacgagcctgtccgggggcggcgtgttcgggaccggcaccaaggtgaccgtcctc

SEQ ID NO: 10214 - RNA, 333 nt, synthetic construct
  misc_feature 1..333: note = derived and/or modified sequence opt1 from anti-HIV_048-244016_VR-Chain
  source 1..333: mol_type = other RNA
cagagcgtgctgacccagcccccgtccgtcagcggcgcccccgggcagcgcgtgaccatctcctgcacgggcagctccagcaacatcgggggctacgacgtgcactggtaccagcagctccccgggaccgcccccaagctgctgatctacaagaacgacaagcggccgtccggcatccccgaccgcttcagcggctccaagagcgggacctccgcgatcctcggcatcaccgggctgcagacgggcgacgaggccgactactactgcggggcctgggacaccagcctgtccgccggcggcgtcttcgggaccggcaccaaggtgacggtgctc

SEQ ID NO: 10215 - RNA, 333 nt, synthetic construct
  misc_feature 1..333: note = derived and/or modified sequence opt1 from anti-HIV_048-243682_VR-Chain
  source 1..333: mol_type = other RNA
cagagcctgctcacccagcccccgtccgtgagcgccgcccccggccagaaggtcaccatctcctgcacggggagctccagcaacatcggcgggtacgacgtgcactggtaccagcagctgcccggcaccgcgcccaagctgctcatctacgagaacaacaagcgcccgtccgggatccccgaccggttcagcggctccaagagcggcacctccgccaccctggggatcacgggcctgcagaccggggacgaggccgactactactgcggcacctgggacagctccctcagcgccgggggcgtgttcggcaccgggacgaaggtcaccgtgctg

SEQ ID NO: 10216 - RNA, 333 nt, synthetic construct
  misc_feature 1..333: note = derived and/or modified sequence opt1 from anti-HIV_048-243588_VR-Chain
  source 1..333: mol_type = other RNA
cagagcctgctcacccagcccccgtccgtgagcgccccgcccggccagatggtctccatcagctgctccgggagctcccacaacatcggcgacaactacgtgagctggtaccagcacctccccgggaccgcccccaagctgctgatctacgacaacaactcccgccccagcggcatccccgaccggttctccgggagcaagtccggcacgagcgcgaccctgggcatcaccgggctgcagaccggcgacgaggccgactactactgcgggacgtgggacacctccctcagcggcgggggcgtgttcggcaccgggaccaaggtcacggtgctg

SEQ ID NO: 10217 - RNA, 333 nt, synthetic construct
  misc_feature 1..333: note = derived and/or modified sequence opt1 from anti-HIV_048-241775_VR-Chain
  source 1..333: mol_type = other RNA
cagagcgtgctggcccagcccccgtccgtcagcggcgcccccgggcagcgcgtgaccatctcctgcaccggcagctccagcaacatcggggagtacgacgtgcactggtaccagcagctccccggcacggcgcccaagctgctgatctacgagaacaacaagcggccgtccgggatccccgaccgcttcagcggctccaagagcggcacctccgccaccctcgggatcaccggcctgcagacgggggacgaggccgactactactgcggcacctgggacagctccctgagcgccgggggcgtcttcggcaccgggaccaaggtgacggtgctc

SEQ ID NO: 10218 - RNA, 333 nt, synthetic construct
  misc_feature 1..333: note = derived and/or modified sequence opt1 from anti-HIV_048-237996_VR-Chain
  source 1..333: mol_type = other RNA
cagagcgtgctgacccagcccccgtccgtcagcggcgcccccgggcagcgcgtgaccatctcctgcacgggcagctccagcaacatcgggggctacgacgtgcactggtaccggcagctccccgggaccgcccccaagctgctgatctacgacaccgtcaagcgcccgtccggcatccccgaccggttcagcggctccaagagcgggacctccgcgacgctcggcatcaccgggctgcagaccggcgacgaggccgactactactgcgggacctgggacacgagcctgtccgccggcggcgtgttcgggaccggcaccaaggtgaccgtcctc

SEQ ID NO: 10219 - RNA, 330 nt, synthetic construct
  misc_feature 1..330: note = derived and/or modified sequence opt1 from anti-HIV_048-237730_VR-Chain
  source 1..330: mol_type = other RNA
agcgtgctgacccagcccccgtccgtcagcggcgcccccgggcagcgcgtgaccatctcctgcacgggcaccaacagcaacttcgggtccaactacgcccactggtaccagcaggtccccggcaccgcgcccaagctcctgatctacagcaacaacgcccggccgtccgggatccccgaccgcttcagcggctccaagagcggcacctccgccacgctggggatcaccggcctccagaccggggacgaggccgactactactgcggcacctgggacacgagcctgtccgccgggggcgtgttcggcaccgggaccaaggtgaccgtgctg

SEQ ID NO: 10220 - RNA, 333 nt, synthetic construct
  misc_feature 1..333: note = derived and/or modified sequence opt1 from anti-HIV_048-237253_VR-Chain
  source 1..333: mol_type = other RNA
cagagcgtgctgacccagcccccgtccgtcagcgccgcccccggccagaaggtgaccgtgtcctgcagcgggtccagctccaacatcggcagcaacgacgtctcctggtaccagcagttccccggggcggcccccaagctcctgatctacaagaacaacgagcgcccgagcggcatccccgaccggttctccgggagcaagtccggcacgagcgccaccctgggcatcaccgggctccagaccggcgacgaggccgactactactgcgggacgtgggacacctccctgagcgccggcggggtgttcggcaccggcaccaaggtgacggtcctg

SEQ ID NO: 10221 - RNA, 333 nt, synthetic construct
  misc_feature 1..333: note = derived and/or modified sequence opt1 from anti-HIV_048-234100_VR-Chain
  source 1..333: mol_type = other RNA
cagagcatgctgacccagcccccgtccgtgagcgccgcccccggcgagaaggtcaccatctcctgcagcgggtccagctccaacatcggcaagacgttcgtgagctggtaccagcaggtccccgggaccgcgcccaagctcctgatctacaagaacgacaaccgcccgtccggcatccccgaccggttcagcgggtccaagagcggcacctccgccaccctgggcatcagcgggctccagacgggcgacgaggccgactactactgcgggacctgggacacctccctgagcggcgggggcgtgttcggcaccgggacgaaggtgaccgtgctg

SEQ ID NO: 10222 - RNA, 333 nt, synthetic construct
  misc_feature 1..333: note = derived and/or modified sequence opt1 from anti-HIV_048-230882_VR-Chain
  source 1..333: mol_type = other RNA
cagagcgtgctgacccagcccccgtccgtcagcgccgcccccggccagaaggtgaccatctcctgcagcgggaactccagcaacatcggctccaacttcgtgagctggtaccagcagctccccgggacggcgcccaagctgctgatctacgagaacaacaagcgcccgtccggcatccccgaccggttcagcgggtccaagagcggcacctccgccaccctcggcatcaccgggctgcagacgggcgacgaggccgactactactgcgggacctgggacaccagcctgtcccccggcggggtcttcggcaccggcacgaaggtgaccgtgctc

SEQ ID NO: 10223 - RNA, 333 nt, synthetic construct
  misc_feature 1..333: note = derived and/or modified sequence opt1 from anti-HIV_048-229473_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagttccccgggacggcgcccaagctcctgatctacgagaacaacaagcgcccgtccggcatccccgaccggttcagcgggtccaagagcggcaccaccgccaccctggccatcacgcgcctccagaccggcgacgaggccgactactactgcgggacctggggcgggtccctgagcgccggcggggtcttcggcaccggcacgaaggtgaccgtgctg

SEQ ID NO: 10224 - RNA, 333 nt, synthetic construct
  misc_feature 1..333: note = derived and/or modified sequence opt1 from anti-HIV_048-228238_VR-Chain
  source 1..333: mol_type = other RNA
cagagcgtgctgacccagcccccgtccgtcagcgccgcccccggccagaaggtgaccatctcctgcagcgggtccagctccaacatcggcatcaactacgtgagctggtaccagcagctccccgggacggcgcccaagctgctgatctacgacaacaccaagcgcccgcagggcatccccgaccggttctccgggagcaagtccggcaccagcgccaccctcgccatcacgggcctgcagaccggggacgaggccgactactactgcggcacctgggacgggtccctgagcaccggcggggtcatcggcacgggcaccaaggtgaccgtgctc

SEQ ID NO: 10225 - RNA, 333 nt, synthetic construct
  misc_feature 1..333: note = derived and/or modified sequence opt1 from anti-HIV_048-228027_VR-Chain
  source 1..333: mol_type = other RNA
cagagcctgctcacccagtcccccagcgcctccggcccgcccgggcagcgcgtgaccatcagctgctccggcagcaactccaacatcgggagcaacacggtcaactggtaccaccacctccccggcgccgcgcccaagctgctgatctacgagaactccaagcggccgagcgggatccccgaccgcttctccggcagcaagtccggcaccagcgccaccctggggatcaccggcctgcagacgggggacgaggccgactactactgcggcacctgggacacctccctcagcgccgggggcgtgttcggctccgggaccaaggtgacggtcctg

SEQ ID NO: 10226 - RNA, 333 nt, synthetic construct
  misc_feature 1..333: note = derived and/or modified sequence opt1 from anti-HIV_048-227795_VR-Chain
  source 1..333: mol_type = other RNA
cagagcgtgctgacccagcccccgtccgtcagcgccgcccccggccagaaggtgaccatctcctgcagcgggtccagctccaacatcgagagccgctccgtgcactggtaccagcagaagcccggccaggcgcccgtcctcgtgatctactacgacagcgaccggccgtccgggatccccgaccgcttcagcggctccaagagcgggacggccgccaccctgggcatcaccggcctgcagaccggggacgaggccgactactactgcggcacgtgggacacctccctcagcgccgggggcgtgttcgggaccggcaccaaggtcacggtgctg

SEQ ID NO: 10227 - RNA, 333 nt, synthetic construct
  misc_feature 1..333: note = derived and/or modified sequence opt1 from anti-HIV_048-227770_VR-Chain
  source 1..333: mol_type = other RNA
cagagcgtgctgacccagcccccgtccgtcagcggcgcccccgggcagcgcgtgaccatctcctgcacgggcagctccagcaacatcgggccccgggacgtgcactggtaccagcagctccccggcaccgtcccgaagctgctgatctacgacacctacacccgcccctccgggatccccgaccggttcagcggctccaagagcggcgcctccgcgacgctcgacatcaccgggctgcagaccggcgacgaggccgactactactgcgggatctgggacaccagcctgtccgccggcggggtgttcggcacgggcaccaaggtgaccgtcctc

SEQ ID NO: 10228 - RNA, 333 nt, synthetic construct
  misc_feature 1..333: note = derived and/or modified sequence opt1 from anti-HIV_048-225298_VR-Chain
  source 1..333: mol_type = other RNA
cagagcgccctgacccagccccgctccgtgagcggctccccggggcagagcgtcaccatctcctgcacgggcaccagcaacgacgtggggtacgactacgtgtcctggtaccagcagctccccggcaccgcccccaagctgctgatctacgacatcaacaagcggcccagcgggatcccggaccgcttctccggcagcaagtccggcaccagcgcgacgctcgggatcaccggcctgcagaccggggacgaggccgactactactgcggcacctgggacacgtccctgagcgccgggggcgtcttcggcaccgggaccaaggtgaccgtgctc

SEQ ID NO: 10229 - RNA, 327 nt, synthetic construct
  misc_feature 1..327: note = derived and/or modified sequence opt1 from anti-HIV_048-225090_VR-Chain
  source 1..327: mol_type = other RNA
gagctgacccagcccccgagcgtgtccggcgcccccgggcagcgcgtcaccatcagctgcacgggctccagctccaacatcgggggctacgacgtgcactggtaccagcagctccccgggaccgcccccaagctgctgatctacgacaacaacaagcggccgagcggcatccccgaccgcttctccggcagcaagtccgggaccagcgcgaccctcggcatcacggggctgcagaccggcgacgaggccgactactactgcgggacctgggacacctccctgagcacgggcggcgtgttcgggaccggcaccaaggtcaccgtgctc

SEQ ID NO: 10230 - RNA, 333 nt, synthetic construct
  misc_feature 1..333: note = derived and/or modified sequence opt1 from anti-HIV_048-224187_VR-Chain
  source 1..333: mol_type = other RNA
cagagcgtgctgacccagcccccgtccgccagcggcacccccgggcagcgcgtcacgatctcctgcagcggctccagcgccaacatcgggaccaactacgtgttctggtaccagcacctccccggcaccacgccccggctgctgatcttccgcaacaacgagcggccgtccgggatccccgaccgcttcagcggctccaagagcggcacctccgcgaccctcgggatcaccggcctgcagaccggggacgaggccgactactactgcggcacgtgggacaccagcctgtccgccgggggcgtgttcggcaccgggaccaaggtcacggtgctc

SEQ ID NO: 10231 - RNA, 333 nt, synthetic construct
  misc_feature 1..333: note = derived and/or modified sequence opt1 from anti-HIV_048-223055_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagttccccgggacggcgcccaaggtcctcatctacggcaactccaagcgcccgagcgggatccccgaccggttctccggcagcaagtccggcaccagcgccaccctggggatcaccggcctgcagacgggggacgaggccgactactactgcggcacctgggacacctccctcagcgccgggggcgtgttcggctccgggaccaaggtgacggtcctg

SEQ ID NO: 10232 - RNA, 333 nt, synthetic construct
  misc_feature 1..333: note = derived and/or modified sequence opt1 from anti-HIV_048-222711_VR-Chain
  source 1..333: mol_type = other RNA
cagcccgtgctgacccagccgcccagcgtctccggcgcccccgggcagcgcgtgaccatcagctgcacgggctccagctccaacatcgggggctacgacgtgcactggtaccagcaggtccccgggaccgccccgaagctcctgatcttcgagaacaaccggcgccccagcggcatccccgaccggttctccggcagcaagtccgggaccagcgcgaccctggccatcacgggcctccagaccggggacgaggccgactactactgcggcacctgggacgggtccctgagcaccggcggcgtgatcgggacgggcaccaaggtgaccgtcctg

SEQ ID NO: 10233 - RNA, 333 nt, synthetic construct
  misc_feature 1..333: note = derived and/or modified sequence opt1 from anti-HIV_048-221209_VR-Chain
  source 1..333: mol_type = other RNA
cagagcgtgctgacccagcccccgtccgtcagcggcgcccccgggcagcgcgtgaccatctcctgcacgggcaacagctccaacatcggggactacgacgtgcactggtaccagcaggtcgccggcaccgcgcccaagctcctgatcttcaagaacaacgagcggcccagcgggatcccggaccgcttctccggcagcaagtccggcaccagcgccaccctggggatcacgggcctccagaccggggacgaggccgactactactgcggcacctgggacacctccctgagcgccgggggcgtgttcggctccgggacgaaggtgaccgtcctg

SEQ ID NO: 10234 - RNA, 333 nt, synthetic construct
  misc_feature 1..333: note = derived and/or modified sequence opt1 from anti-HIV_048-220629_VR-Chain
  source 1..333: mol_type = other RNA
cagagcgccctgacccagcccgcctccgtgagcggctccctcgggcagagcatcaccatctcctgcacgggcaccagccgcgacgtcgggtactcctacgtgagctggtaccagcacctcccgggcaccgcgcccaagctgctgatctacgagaacaacaagcggccctccgggatccccgaccgcttcagcggctccaagagcggcacctccgccacgctggggatcaccggcctgcagaccggggacgaggccgactactactgcggcacctgggacagctccctcagcgccgggggcgtgttcggcacggggaccaaggtcaccgtgctg

SEQ ID NO: 10235 - RNA, 333 nt, synthetic construct
  misc_feature 1..333: note = derived and/or modified sequence opt1 from anti-HIV_048-219430_VR-Chain
  source 1..333: mol_type = other RNA
cagagcgtgctgacccagcccccgtccgtcagcgccgcccccggccagatggtgaccatctcctgcagcgggtccacgagcaacatcggcatcaactacgtgtcctggtaccagcacgtccccgggaccgcgcccaagctcctgatctacgacaacaacaagcgcccgagcggcatccccgaccggttctccgggagcaagtccggcaccagcgccaccctgggcatcacggggctccacaccggcgacgaggccgactactactgcgggacctgggacacctccctgagcgccggcggggtgttcggcacgggcaccaaggtgaccgtcctg

SEQ ID NO: 10236 - RNA, 333 nt, synthetic construct
  misc_feature 1..333: note = derived and/or modified sequence opt1 from anti-HIV_048-216250_VR-Chain
  source 1..333: mol_type = other RNA
cagagcgtgctgacccagcccccgtccgtcagcgccgcccccggccagaaggtgaccatctcctgcacggggaccaccagcgacttcggctacaactgcgtgtcctggtaccagcagcaccccgggcgcgcgcccaaggtcatcatcagcggcgtgaacaagcggccgtccgggatccccgaccgcttcagcggctccaagagcggcacctccgccacgctcgggatcaccggcctgcagaccggggacgaggccgactactactgcggcacctgggacagctccctgagcgccgggggcgtgttcggcacggggaccaaggtcaccgtgctc

SEQ ID NO: 10237 - RNA, 321 nt, synthetic construct
  misc_feature 1..321: note = derived and/or modified sequence opt1 from anti-HIV_048-216133_VR-Chain
  source 1..321: mol_type = other RNA
acccagcccccgagcctgtccgccacccccggccagcgcgtgagcatctcctgcagcgggggcgggtccaacatcggcaacaacgacgtcttctggttccagcagttccccggggccggcccccggctcctgatctacgacaaccacaagcgccactacggcacgccggaccggttcagcgggtccaagagcggcacctccgcgaccctggccatcaccgggctccagacgggcgacgaggccgcctactactgcgggacctgggacggcagcctgtccaccggcggggtgatcggcaccgggacgaaggtgaccgtcctg

SEQ ID NO: 10238 - RNA, 333 nt, synthetic construct
  misc_feature 1..333: note = derived and/or modified sequence opt1 from anti-HIV_048-214886_VR-Chain
  source 1..333: mol_type = other RNA
cagagcgccctgacccagccccgctccgtgagcggctccccggggcagagcgtcaccatctcctgcacgggcaccagctccgacgtggggtacaactacgtgagctggtaccagcaccaccccggcaccgcccccaagctcctgatctacaagaacaacaaccggccctccgggatcccggaccgcttcagcggctccaagagcggcacctccgcgacgctggggatcaccggcctccagaccggggacgaggccgactactactgcggcacctgggacacgagcctgtccgccgggggcgtcttcggcaccgggaccaaggtgaccgtgctg

SEQ ID NO: 10239 - RNA, 333 nt, synthetic construct
  misc_feature 1..333: note = derived and/or modified sequence opt1 from anti-HIV_048-214709_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgatctacgagaacgaccgccggccgtccggcatccccgaccgcttcagcgggtccaagagcggcacctccgccaccctcggcatcaccgggctgcagacgggcgacgaggccgactactactgcgggacctgggacaccagcctgtccgccggcggggtcttcggcaccggcacgaaggtgaccgtgctc

SEQ ID NO: 10240 - RNA, 333 nt, synthetic construct
  misc_feature 1..333: note = derived and/or modified sequence opt1 from anti-HIV_048-214001_VR-Chain
  source 1..333: mol_type = other RNA
cagagcgtgctgacccagcccccgtccgtcagcggcgcccccgggcagaccgtgacgatctcctgcagcggctccaacagcaacatcgggaaccacgacgtgcactggtaccagcacgtccccggcaccgcccccaagctcctgatctacgacaacaacaagcgcccgtccgggatccccgaccggttcagcggctccaagagcggcacctccgcgaccctggggatcacgggcctccagaccggggacgaggccgagtactactgcgccacctgggacgccagcctgtccggcgggggcgtgttccgcaccggcacgaaggtgaccgtcctg

SEQ ID NO: 10241 - RNA, 333 nt, synthetic construct
  misc_feature 1..333: note = derived and/or modified sequence opt1 from anti-HIV_048-213230_VR-Chain
  source 1..333: mol_type = other RNA
cagagcgtgctgacccagcccccgtccatgagcgccgcccccggccagaaggtcaccatctcctgcagcgggtccagcaacaacatcggcaagaacgtggtgtcctggtaccagcagctccccgggacggcgcccaaggtcctgatctacgagaacaacaagcgcctgagcggcatcccggaccggttctccgggagcaagtccggcaccagcgccaccctcgtgatcaccggcctgcagacgggggacgaggccgactactactgcggcacctgggactccagcctgtccgccgggggcgtgttcgggaccggcaccaaggtcacggtgctc

SEQ ID NO: 10242 - RNA, 333 nt, synthetic construct
  misc_feature 1..333: note = derived and/or modified sequence opt1 from anti-HIV_048-212574_VR-Chain
  source 1..333: mol_type = other RNA
cagagcgtgctgacccagcccccgtccgtcagcgccgcccccggccagcgcgtgaccgtgtcctgcagcgggtccacgagcaacatcgagtccaactacgtcagctggtaccagcaggtccccggcaccgcgcccaagctcctgatctacgagaacaacaagcggccgtccgggatccccgaccgcttcagcggctccaagagcgggacctccgccaccctggccatcacgggcctccagaccggcgacgaggccgcctactactgcgggacctgggacggcagcctgtccaccgggggcgtgatcgggacgggcaccaaggtgaccgtgctg

SEQ ID NO: 10243 - RNA, 333 nt, synthetic construct
  misc_feature 1..333: note = derived and/or modified sequence opt1 from anti-HIV_048-212207_VR-Chain
  source 1..333: mol_type = other RNA
cagagcgtgctgacccagcccccgtccctcagcgccgcccccggccagaaggtcaccatctcctgcagcgggggctccagcaacatcgggaacaactacgtgtcctggtaccagcacctccccggcacggcgcccaagctgctgatctacgacaactacaagcgcccgagcgggatccccgaccggttctccggcagcaagtccggcaccagcgccaccctggacatcaccgggctgcagacgggcgacgaggccgactactactgcgggacctgggacacctccctcagcgccggcggggtgttcggcaccggcacgaaggtcaccgtgctg

SEQ ID NO: 10244 - RNA, 333 nt, synthetic construct
  misc_feature 1..333: note = derived and/or modified sequence opt1 from anti-HIV_048-209146_VR-Chain
  source 1..333: mol_type = other RNA
cagagcgtgctgacccagcccccgtccgtcagcggcgcccccgggcagaagatcaccgtgtcctgcacgggcaccaccagcaacatcgggccccacgacgtgcactggtaccagctcgtccccggccgcccgcccaagctgctgatcttccacaacaacatccggccctccgggatccccgaccgcttcagcggctccaagagcggcatgtccgccaccctcgggatcacgggcctgcagaccggggacgaggcggactactactgcggcacctgggacagctccctgagcgccgggggcgtgttcggcaccgggacgaaggtgaccgtcctc

SEQ ID NO: 10245 - RNA, 333 nt, synthetic construct
  misc_feature 1..333: note = derived and/or modified sequence opt1 from anti-HIV_048-208206_VR-Chain
  source 1..333: mol_type = other RNA
cagagcgtgctgacccagcccccgtccgtcagcgccgcccccggccagaaggtgaccatctcctgcagcgggtccagctccaacatcggcagcaactacgtgtcctggtaccagcagttccccgggacggcgccccgcctcctgatctacgagaacgacaagcggccgagcgccatccccgaccgcttctccggcagcaagtccgggaccagcgccaccctgggcatcaccggcctccacacgggggacgaggccgactactactgcggcacctgggacgggtccctgagcaccggcggggtcatcggcaccggcacgaaggtgaccgtgctg

SEQ ID NO: 10246 - RNA, 333 nt, synthetic construct
  misc_feature 1..333: note = derived and/or modified sequence opt1 from anti-HIV_048-208194_VR-Chain
  source 1..333: mol_type = other RNA
cagagcgccctgacccagcccccgtccgccagcggctcccccgggcagagcgtgaccatctcctgcacgggcaccagctccgacatcgggtacaagtacgtcagctggtaccagctcctgcccggcacgcccccgaagctgctcatcttcaagaacaacgagcgcccctccgggatccccgaccggttcagcggctccaagagcggcacctccgcgaccctggggatcaccggcctgcagaccggggacgaggccgactactactgcggcgcctgggacaccagcctctccgccgggggcgtgttcggcacggggaccaaggtgaccgtcctg

SEQ ID NO: 10247 - RNA, 333 nt, synthetic construct
  misc_feature 1..333: note = derived and/or modified sequence opt1 from anti-HIV_048-207744_VR-Chain
  source 1..333: mol_type = other RNA
cagagcgccctgacccagcccgcctccgtgagcgcgtccttcggccagagcatcaccatctcctgcacgggggccgccagcaccatcggcaacaacctcgtctcctggtaccgcctgctgccggggaccgcccccaagctcctgatctacaagaacgacaaccggcccagcggcatccccgaccgcttctccgggagcaagtccggcaccagcgccacgctgggcatctccgggctccagaccggcgacgaggcggactactactgcgggacctgggacaccagcctgtccggcgggggcgtgttcggcacggggaccaaggtgaccgtcctg

SEQ ID NO: 10248 - RNA, 333 nt, synthetic construct
  misc_feature 1..333: note = derived and/or modified sequence opt1 from anti-HIV_048-206501_VR-Chain
  source 1..333: mol_type = other RNA
cagagcgtgctgacccagcccccgtccgtcagcggcgcccccgggcagcgcgtgaccatctcctgcagcggctccagctccaacatcgggaacaacgccgtgaactggtaccagcagctccccggcaaggcgcccaagctgctgatctacgagaacaacaagcggccgagcgggatccccgaccgcttctccggcagcaagtccggcacgagcgccaccctcgggatcaccggcctgcagaccggggacgaggccgactactactgcggcacgtgggactccagcctgtccgccgggggcgtcttcggcaccgggaccaaggtgaccgtgctc

SEQ ID NO: 10249 - RNA, 333 nt, synthetic construct
  misc_feature 1..333: note = derived and/or modified sequence opt1 from anti-HIV_048-204221_VR-Chain
  source 1..333: mol_type = other RNA
cagagcgtgctgacccagcccccgtccgccagcggcacccccgggcagcgcgtcacgatctcctgcttcggcagctccagcaacatcgcctccagcgcggtgaactggtaccagcagctccccgggaccgcccccaagctgctgatctacaagaacgacaagcggccgtccggcatccccgaccgcttcagcgggtccaagagcggcacctccgccaccctcggcatcacggggctgcagaccggcgacgaggccgactactactgcgggacctgggacaccagcctgtccgccggcggggtgttcggcacgggcaccaaggtcaccgtgctc

SEQ ID NO: 10250 - RNA, 333 nt, synthetic construct
  misc_feature 1..333: note = derived and/or modified sequence opt1 from anti-HIV_048-204015_VR-Chain
  source 1..333: mol_type = other RNA
cagagcgtgctgacccagcccccgtccgccagcggcacccccgggcagcgcgtcacgatctcctgcagcggctccagctccaacatcgggagcaagtacgtgtactggtaccagcagctccccggcaccgcccccaagctgctgatctacaagaacgacaaccggccgtccgggatccccgaccgcttcagcggctccaagagcggcacctccgcgaccctcgggatcagcggcctgcagacgggggacgaggccgactactactgcggcacctgggacacctccctgagcgggggcggcgtgttcgggaccggcacgaaggtcaccgtgctc

SEQ ID NO: 10251 - RNA, 333 nt, synthetic construct
  misc_feature 1..333: note = derived and/or modified sequence opt1 from anti-HIV_048-201240_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtggcgtggtaccagcagctccccgggacggcccccaagctgctgatcaaggagaacagccagcgcccgtccggcatccccgaccggttcagcgggtccaagagcggcacctccgccaccctcgccatcaccggcctgcagacgggggacgaggccgactactactgcggcacctgggacaccagcctgtccaccgggggcgtcttcgggacgggcaccaaggtgaccgtgctc

SEQ ID NO: 10252 - RNA, 333 nt, synthetic construct
  misc_feature 1..333: note = derived and/or modified sequence opt1 from anti-HIV_048-200455_VR-Chain
  source 1..333: mol_type = other RNA
cagagcgccctgacccagcccgcctccgtgagcggctccccggggcagagcatcaccatctcctgcacgggcaccagctccgacgtcgggtacaactacgtgagctggtaccaggtgctccccggcaccgcgcccaagctgctgatctacaagaacaccgagcgcccctccgggatcccggaccggttcagcggctccaagagcggcacgtccgccaccctcgacatcaccgggctgcagaccggcgacgaggccgactactactgcgggacgtgggacaccagcctgtccgccggcggggtcttcggcaccggcaccaaggtgacggtgctc

SEQ ID NO: 10253 - RNA, 333 nt, synthetic construct
  misc_feature 1..333: note = derived and/or modified sequence opt1 from anti-HIV_048-200319_VR-Chain
  source 1..333: mol_type = other RNA
cagagcgtggtcacccagcccccgtccgccagcggcacccccgggcagcgggtgacgatctcctgcagcggctccagctccaacatcgggagcaagtacgtgtactggtaccaccagcaccccggcaccgcccccaagctgctcatctacgacaacaacaaccggccgtccgggatccccgaccgcttcagcggctccaagagcggcacctccgcgaccctggggatcacgggcctgcagaccggggacgaggccgactactactgcggcacctgggacaccagcctctcccgcgggggcgtcttcggcacggggaccaaggtgaccgtgctg

SEQ ID NO: 10254 - RNA, 333 nt, synthetic construct
  misc_feature 1..333: note = derived and/or modified sequence opt1 from anti-HIV_048-197896_VR-Chain
  source 1..333: mol_type = other RNA
cagagcgtgctgacccagcccccgtccgtcagcgccgcccccggccagaaggtgaccatctcctgcagcggggcgtcctacaacatcggcaagaacagcgtgtcctggtaccagcagctccccgggacgcccccgaagctgctgatcttcaagaacaacgagcgccccagcggcatccccgaccggttctccgggagcaagtccggcaccagcgccaccctcggcatcaccgggctgcagacgggcgacgaggccgactactactgcgccacctgggacacctccctgagcgccgggggcgtcttcgggaccggcacgaaggtgaccgtgctc

SEQ ID NO: 10255 - RNA, 333 nt, synthetic construct
  misc_feature 1..333: note = derived and/or modified sequence opt1 from anti-HIV_048-193813_VR-Chain
  source 1..333: mol_type = other RNA
cagagcgtgctgacccagtcccccagcgtctccgccgccccgggccagaaggtgaccatcagctgctccgggagcaactccaacgtgggcaactactacgtcagctggtaccagcacctccccgggacggcgcccaaggtgctgatctacgagggcaacaagcgcccctccggggtgccggaccggttcagcggctccaagagcggcacctccgccagcctggccatcaccgggctccagaccggcgacgaggccgactactactgcgggacgtgggacacctccctgagcgccggcggggtcttcggctccggcaccaaggtgaccgtgctg

SEQ ID NO: 10256 - RNA, 333 nt, synthetic construct
  misc_feature 1..333: note = derived and/or modified sequence opt1 from anti-HIV_048-192098_VR-Chain
  source 1..333: mol_type = other RNA
cagagcgtgctgacccagcccccgtccgccagcggcacccccgggcagcgcgtcacgatctcctgcagcggctccaccagcaacatcgggtccaactacgtgtactggtaccagcagctccccggcaccacccccaagctgctgatctacgagaacaacaagcggccgagcgggatcacggaccgcttcttcggctccaagagcggcccctccgccaccctcgacatcaccgggctgcagaccggcgacgaggcggactactactgcgggacgtgggacgccagcctgtccgccggcggggtgttcggcaccggcaccaaggtcaccgtgctc

SEQ ID NO: 10257 - RNA, 333 nt, synthetic construct
  misc_feature 1..333: note = derived and/or modified sequence opt1 from anti-HIV_048-191786_VR-Chain
  source 1..333: mol_type = other RNA
cagagcgtgctgacccagcccccgtccgtcagcgccgcccccggccagaacgtgaacatctcctgcagcgggtccagctccaacatcgagaacaacttcgtgagctggtaccagaagctccccggcaccgcgcccaagctgctgatctacgacaacaacaagcgcccgtccgggatccgggaccgcttcagcggctccaagagcgggacgtccgccaccctcggcatcaccggcctgcagaccggggacgaggccgactactactgcggcacgtgggacaccagcctgtccgccgggggcgtcttcgggagcggcaccaaggtgaccgtgctc

SEQ ID NO: 10258 - RNA, 333 nt, synthetic construct
  misc_feature 1..333: note = derived and/or modified sequence opt1 from anti-HIV_048-188746_VR-Chain
  source 1..333: mol_type = other RNA
cagagcgtgctgacccagcccccgtccgccagcggcacccccgggcagaaggtcacgatctcctgcagcggctccaacagcaacatcgggtccaacttcgtgagctggtaccagctcctgcccggcaccacccccaagctgctcatctaccgcaacaaccagcggccgtccggggtgcccgaccgcttcagcggctccaagagcggcacctccgccacgctggggatcaccggcctgcagaccggggacgaggcggactactactgcggcacctgggacagctccctcagcgccgggggcgtcttcggcacggggaccaaggtgaccgtgctg

SEQ ID NO: 10259 - RNA, 333 nt, synthetic construct
  misc_feature 1..333: note = derived and/or modified sequence opt1 from anti-HIV_048-185937_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgatctacgagaacaacaagcgcccgtccggcatcccctaccccatcagcgggtccaagagcggcacctccgccaccctcggcatcaccgggctgcagacgggcgacgaggccgactactactgcgggacctgggacagctccctgagcgccggcggggtcttcggcaccggcaccaaggtgacggtgctc

SEQ ID NO: 10260 - RNA, 333 nt, synthetic construct
  misc_feature 1..333: note = derived and/or modified sequence opt1 from anti-HIV_048-184849_VR-Chain
  source 1..333: mol_type = other RNA
cagagcgtgctgacccaggccccctccgccagcggcaccccggggcagacggtcaccatctcctgcagcggctccagctccaacatcgggaccaagtacgtgtactggtaccagcagctccccggcaccgcgcccaagctgctgatctacaagaacaacgagcgccccagcgggatcccggaccggttctccggcagcaagtccggcacgagcgccaccctcgggatcaccggcctgcagaccggggacgaggccgactactactgcggcacgtgggacacctccctgagccccgggggcgtgttcggcaccgggaccaaggtcacggtgctc

SEQ ID NO: 10261 - RNA, 333 nt, synthetic construct
  misc_feature 1..333: note = derived and/or modified sequence opt1 from anti-HIV_048-183089_VR-Chain
  source 1..333: mol_type = other RNA
cagagcgtgctgacccagcccccgtccgccagcggcacccccgggcagcgcgtcacgatctcctgcagcggctccagctccaacatcgggagctcctacgtgtactggtaccagctcctgcccggcacgcccccgaagctgctcatcttcaagaacaacgagcggcccagcgggatccccgaccgcttctccggcagcaagtccggcaccagcgccaccctggggatcaccggcctgcagaccggggacgaggcggactactactgcggcacctgggacacctccctcagcgccgggggcgtgttcggcacggggaccaaggtcaccgtgctg

SEQ ID NO: 10262 - RNA, 333 nt, synthetic construct
  misc_feature 1..333: note = derived and/or modified sequence opt1 from anti-HIV_048-181509_VR-Chain
  source 1..333: mol_type = other RNA
cagagcgtgctgacccagcccccgtccgtcagcggcgcccccgggcagcgcgtgaccatctcctgcacgggcagctccagcaacatcgggggctacgacgtgcactggtaccaccagctccccggggccgcgcccaagctgctgatctacaagaacgacaaccggccgtccggcatccccgaccgcttcagcggctccaagagcgggacctccgccaccctcggcatcagcgggctgcagaccggcgacgaggccgactactactgcgggacgtgggacacctccctgagcggcggcggggtcttcggcaccgggaccaaggtgacggtgctc

SEQ ID NO: 10263 - RNA, 333 nt, synthetic construct
  misc_feature 1..333: note = derived and/or modified sequence opt1 from anti-HIV_048-180990_VR-Chain
  source 1..333: mol_type = other RNA
cagagcgtgctgacccagcccccgtccgtcagcgccgcccccggccagcgcgtgaccatctcctgcagcgggtccacgagcaacatcggcaacaactacgtgtcctggtaccagcacttccccgggaaggtccccaaggtggtgatcagcgagaccaccaagcggccgtccggcatccccgaccgcttcagcgggtccaagagcggcacctccgcgacgctcggcatcaccgggctgcagaccggcgacgaggccgactactactgcgggacctgggacagctccctgagcgccggcggggtcttcggcacgggcaccaaggtgaccgtgctc

SEQ ID NO: 10264 - RNA, 333 nt, synthetic construct
  misc_feature 1..333: note = derived and/or modified sequence opt1 from anti-HIV_048-177532_VR-Chain
  source 1..333: mol_type = other RNA
cagagcgccctgacccagcccccgtccgccagcggctccctcgggcagagcgtgaccatctcctgcacgggcaccagctccgacgtcgggaacaacttcgtgagctggtaccagaagaagcccggcaaggcgcccaagctgatcgtgtacgaggtcaacaagcgcccctccgggatcccggaccggttcagcggctccaagagcggcacctccgccaccctggggatcacgggcctccagaccggggacgaggccgactactactgcggcacctgggacaccagcctgtccaccgggggcgtgttcggcacggggaccaaggtgaccgtcctg

SEQ ID NO: 10265 - RNA, 324 nt, synthetic construct
  misc_feature 1..324: note = derived and/or modified sequence opt1 from anti-HIV_048-177426_VR-Chain
  source 1..324: mol_type = other RNA
ctgacccagccccacagcgtgtccgagagcccgggcaagaccgtcacgatctcctgcaccgggaccagctccgacgtgggctacaactacgtgagctggtaccagcaccaccccgggaaggcccccaagctcctgatctacgaggtcaccaagcgcccctccggcatcccggaccggttcagcgggtccaagagcggcacgtccgccaccctgggcatcaccgggctccagaccggcgacgaggcggactactactgcgggacgtgggacagctccctgagcgccggcggggtgttcggcaccggcaccaaggtgaccgtcctg

SEQ ID NO: 10266 - RNA, 333 nt, synthetic construct
  misc_feature 1..333: note = derived and/or modified sequence opt1 from anti-HIV_048-177389_VR-Chain
  source 1..333: mol_type = other RNA
cagagcgtgctgacccagcccccgtccatgagcgccgcccccggcgagcgcgtcaccatctcctgcagcgggtccagctccaacatcggcaaccaccacgtgagctggtaccagcagcggcccgggacggcgcccaagctcctgatctacgagaacaacgagcgcccgtccggcatccccgaccggttcagcgggtccaagagcggcacctccgccaccctgggcatcaccgggctccagacgggcgacgaggccgactactactgcgggacctgggacaccagcctgtccgccggcggggtgttcggcagcggcaccaaggtcacggtgctg

SEQ ID NO: 10267 - RNA, 333 nt, synthetic construct
  misc_feature 1..333: note = derived and/or modified sequence opt1 from anti-HIV_048-174266_VR-Chain
  source 1..333: mol_type = other RNA
cagagcgtgctgacccagcccccgtccgtcagcggcgcccccgggcagcgcgtgaccatctcctgcagcggctccagctccaacatcgggagccactacgtgtcctggtaccagcaggtccccggcacggcgccccggctcgtgatctacgacaccatcaagcgccacagcgggatcccggaccggttctccggcagcaagtccggcaccagcgccaccctggggatcacgggcctgcagaccggggacgaggccgactactactgcggcacctgggacacctccctcagcgccgggggcgtgttcggcacggggaccaaggtcaccgtgctg

SEQ ID NO: 10268 - RNA, 333 nt, synthetic construct
  misc_feature 1..333: note = derived and/or modified sequence opt1 from anti-HIV_048-172847_VR-Chain
  source 1..333: mol_type = other RNA
cagagcgtgctgacccagcccccgtccgtcagcgccgcccccggccagcgcgtgaccgtgtcctgcagcgggtccacgagcaacatcgagtccaactacgtcagctggtaccagcaggtccccggcaccgcgcccaagctcctgatctacgagaacaacaagcggccgtccgggatccccgaccgcttcagcggctccaagagcgggacctccgccaccctgggcatcacgggcctccagaccggggacgaggccgactactactgcggcacctgggacaccagcctgtccgccgggggcgtgttcgggacgggcaccaaggtgaccgtgctg

SEQ ID NO: 10269 - RNA, 333 nt, synthetic construct
  misc_feature 1..333: note = derived and/or modified sequence opt1 from anti-HIV_048-172845_VR-Chain
  source 1..333: mol_type = other RNA
cagagcgccctgacccagcccccgtccgccagcggctcccccgggcagagcgtgaccatctcctgcacgggcaccagctccgacgtcgggtacaactacgtgagctggtaccagcagctccccggcaccgcgcccaagctgctgatctaccgcaacaaccagcggccgtccggggtgcccgaccgcttcagcggctccaagagcggcacctccgccacgctcgggatcaccggcctgcagaccggggacgaggccgactactactgcgccacctgggacacgagcctgtccgccggcggggtcttcggcaccggcaccaaggtgaccgtgctc

SEQ ID NO: 10270 - RNA, 333 nt, synthetic construct
  misc_feature 1..333: note = derived and/or modified sequence opt1 from anti-HIV_048-172363_VR-Chain
  source 1..333: mol_type = other RNA
cagagcgtgctgacccagcccccgtccgtcagcgccgcccccggccagaaggtgaccatctcctgcagcgggtccggcagcaacatcgggaacacgtacgtgtcctggtaccagcagctccccggcaccgcgcccaagctgctgatcttcgaggacaacaagcgcccgagcgggatccccgaccggttctccggcagcaagtccggcaccagcgccaccctcgccatcacggggctgcagaccggcgacgaggccgactactactgcgggacctgggactccagcctgtccggcgggggcgtcatcggcaccgggacgaagctcaccgtgctg

SEQ ID NO: 10271 - RNA, 333 nt, synthetic construct
  misc_feature 1..333: note = derived and/or modified sequence opt1 from anti-HIV_048-171609_VR-Chain
  source 1..333: mol_type = other RNA
cagagcgtgctgacccagcccccgtccgtcagcgccgcccccggccaggaggtgaccatctcctgcagcgcgtccagctccagcatcgggaacgacttcgtgtcctggtaccagcagctccccggcacggcccccaagctgctgatctacgggaacagcaaccgcccgtccggcatccccgaccggttcagcgggtccaagagcggcacctccgccaccctcggcatcaccgggctgcagacgggcgacgaggccgactactactgcgggacctgggacaccagcctgtccaccggcggggtcttcggcacgggcaccaaggtgaccgtgctc

SEQ ID NO: 10272 - RNA, 333 nt, synthetic construct
  misc_feature 1..333: note = derived and/or modified sequence opt1 from anti-HIV_048-170705_VR-Chain
  source 1..333: mol_type = other RNA
cagagcgtgctgacccagcccccgtccgtcagcgccgcccccggccagatggtgaccatctcctgcagcgggtccacgagcaacatcggcatcaactacgtgtcctggtaccagcacgtccccgggaccgcgcccaagctcctgatctacgagaacgtggagcgccggagcggcatcccggaccgcttctccgccagcaagtccgccaccagcgccaccctggggatcacgggcctccagaccggcgacgaggccgactactactgcgggacctgggacacctccctgagcgcgggcggggtgttcggctccgggacgaaggtcaccgtgctg

SEQ ID NO: 10273 - RNA, 333 nt, synthetic construct
  misc_feature 1..333: note = derived and/or modified sequence opt1 from anti-HIV_048-168381_VR-Chain
  source 1..333: mol_type = other RNA
cagagcgccctgacccagcccgcctccgtgagcggctccccggggcagagcatcaccatctcctgcacgggcaccagctccaacatcgggagcaactacgtctcctggtaccagcagctccccggcaccgcgcccaagctgctgatctacgagaacaaccagcgccccagcgggatcccggaccggttctccggcagcaagtccggcaccagcgccacgctcgggatcaccggcctgcagaccggggacgaggccgactactactgcggcacctgggacacgtccctgagcgccgggggcgtgttcggctccgggaccaaggtgaccgtcctc

SEQ ID NO: 10274 - RNA, 333 nt, synthetic construct
  misc_feature 1..333: note = derived and/or modified sequence opt1 from anti-HIV_048-166619_VR-Chain
  source 1..333: mol_type = other RNA
cagagcgtgctgacccagcccccgtccgtcagcggcgcccccgggcagcgcgtgaccatctcctgcacgggcagctccagcaacatcgggggctaccacacccactggtaccagcagctccccgggaccgcccccaagctgctgatctacgagaactccaagcggccgagcggcatccccgaccgcttctccggcagcaagtccgggaccagcgcgacgctcggcatcaccgggctgcagaccggcgacgaggccgactactactgcgggacctgggacacgtccctgagcgccggcggcgtgttcgggtccggcaccaaggtcaccgtgctc

SEQ ID NO: 10275 - RNA, 333 nt, synthetic construct
  misc_feature 1..333: note = derived and/or modified sequence opt1 from anti-HIV_048-162036_VR-Chain
  source 1..333: mol_type = other RNA
cagagcgtgctggcccagcccccgtccgtcagcggcgcccccgggcagaccgtgaccatctcctgcacgggcagctccagcaacatcgggggctacgacgtgcactggtaccagcagctccccgggaccgcgcccaagctgctgatctacaaggacgacaagcgcccgtccggcatccccgaccggttcagcggctccaagagcgggacctccgccaccctcggcatcacggggctgcagaccggcgacgaggccgactactactgcgggacctgggacaccagcctgaaccgcggcggcgtcttcgggacgggcaccaaggtgaccgtgctc

SEQ ID NO: 10276 - RNA, 333 nt, synthetic construct
  misc_feature 1..333: note = derived and/or modified sequence opt1 from anti-HIV_048-160042_VR-Chain
  source 1..333: mol_type = other RNA
cagagcgtgctgacccagcccccgtccgtcagcgccgcccccggccagaaggtgaccatctcctgcagcgggtccagctccaacatcggcatcaactacatcagctggtaccagcagctccccgggacggcgcccaagatcctgatctacgacaacgacaagcgcccgctgggcatccccgaccggttctccgggagcaagtccggcaccagcgccaccctcggcatcaccgggctgcagacgggcgacgaggccgactactactgcgggacctgggacgcctccctgagcgccggcggggtgttcggcaccggcaccaaggtcacggtgctc

SEQ ID NO: 10277 - RNA, 333 nt, synthetic construct
  misc_feature 1..333: note = derived and/or modified sequence opt1 from anti-HIV_048-159676_VR-Chain
  source 1..333: mol_type = other RNA
cagagcgtgctgacccagcccccgtccgtcagcgcctcccccggccagaaggtgaccatcagctgctccgggagctccagcgacatcggctccaactacgtgagctggtacgtccagctccccgggacggcccccaagctgctgatctacaagaacaacgagcgcccgtccggcatccccgaccggttcagcgggtccaagagcggcacctccgcgaccctcggcatcaccgggctgcagacgggcgacgaggccgactactactgcgggacctgggacaccagcctgtccgccggcggggtgttcggcaccggcacgaaggtgaccgtcctc

SEQ ID NO: 10278 - RNA, 333 nt, synthetic construct
  misc_feature 1..333: note = derived and/or modified sequence opt1 from anti-HIV_048-159500_VR-Chain
  source 1..333: mol_type = other RNA
cagagcgtgctgacccagcccccgtccgtcagcgccgcccccggccagaacgtgaccatctcctgcagcgggtcctggagcaacatcggcgcgaactacgtgtcctggtaccagcagctccccgggacggcccccaagctgctgatctacgagaacaacaagcgcccgagcggcatccccgaccggttctccgggagcaagtccggcaccagcgccaccctcggcttcaccgggctgcagacgggcgacgaggccgactactactgcgggacctgggacacctccctgagcgccggcggggtcttcggcaccggcacgaaggtgaccgtgctc

SEQ ID NO: 10279 - RNA, 333 nt, synthetic construct
  misc_feature 1..333: note = derived and/or modified sequence opt1 from anti-HIV_048-159421_VR-Chain
  source 1..333: mol_type = other RNA
cagagcctgctcacccaggccccctccgtgagcgccgcgccgggccagaccgtcacgatctcctgcagcgggtccaacgccgacatcggcaagaacttcgtgagctggtaccagcagtcccccggggccgcccccaagctgctgatctacgagaacgaccgccggcccagcggcatcccggaccgcttctccgggagcaagtccggcaccagcgccaccctcggcatcaccgggctgcagacgggcgacgaggcggagtactactgcgccacctgggacgcctccctgagcgggggcggggtgttcggcaccggcaccaaggtcacggtgctc

SEQ ID NO: 10280 - RNA, 333 nt, synthetic construct
  misc_feature 1..333: note = derived and/or modified sequence opt1 from anti-HIV_048-159333_VR-Chain
  source 1..333: mol_type = other RNA
cagagcgtgctgacccagcccccgtccgccagcggcacccccgggcagcgcgtcacgatctcctgcagcggctccaacagcaacatcgggtccgacagcgtgtactggtaccagcagctccccggccggtcccccaagctgctgatctaccgcaacaacgagcggccgagcgggatccccgaccgcttctccggcagcaagtccggcaccagcgccaccctcgggatcaccggcctgcagacgggggacgaggcggactactactgcggcacctgggacacctccctgagcgccgggggcgtgttcggcaccgggacgaaggtcaccgtgctc

SEQ ID NO: 10281 - RNA, 333 nt, synthetic construct
  misc_feature 1..333: note = derived and/or modified sequence opt1 from anti-HIV_048-158932_VR-Chain
  source 1..333: mol_type = other RNA
cagagcgtgctgacccagcccgcctccgtcagcggctccccggggcagagcatcaccatctcctgcagcggctccagctccaacatcggggacatcttcgtgagctggtaccagcaggtccccggcgccgcgcccaagctcctgatctacgacaacgacaagcgcccctccgggatcccggaccggttcagcggctccaagagcggcacgtccgccaccctggacatcaccgggctccagaccggcgacgaggccgactactactgcgggacgtgggacaccagcctgtccgccggcggggtgttcggcaccggcaccaaggtgacggtgctg

SEQ ID NO: 10282 - RNA, 333 nt, synthetic construct
  misc_feature 1..333: note = derived and/or modified sequence opt1 from anti-HIV_048-155811_VR-Chain
  source 1..333: mol_type = other RNA
cagagcgccctgacccagcccgcctccgtgagcggctccccggggcagagcatcaccatctcctgcacgggcaccagctccgacgtcgggtacgactacgtgagctggtaccagctcctgcccggcaccccgcccaagctgctcatcttcaagaacaacgagcgcccctccgggatccccgaccggttcagcggctccaagagcggcacctccgcgacgctggggatcaccggcctgcagaccggggacgaggccgactactactgcgccacctgggacacgagcctctccgccggcggggtgttcggcaccggcaccaaggtcaccgtgctg

SEQ ID NO: 10283 - RNA, 333 nt, synthetic construct
  misc_feature 1..333: note = derived and/or modified sequence opt1 from anti-HIV_048-155464_VR-Chain
  source 1..333: mol_type = other RNA
cagagcgccctgacccagcccgcctccgtgagcggctccccggggcagagcatcaccatctcctgcacgggcgcgaccggggacagcggccacacctacgtctcctggtaccagcagctccccgggaccgcccccaagctgctgatctacagcaacaacgagcgcccctccggcgtgccggaccggttcagcggctccaagagcgggacgtccgccaccctcggcatcaccgggctgcagaccggcgacgaggccgactactactgcgggacgtgggacaccagcctgtccgccggcggcgtgttcgggagcggcaccaaggtcaccgtgctc

SEQ ID NO: 10284 - RNA, 333 nt, synthetic construct
  misc_feature 1..333: note = derived and/or modified sequence opt1 from anti-HIV_048-155392_VR-Chain
  source 1..333: mol_type = other RNA
cagagcgtgctgacccagcccccgtccgtcagcgccgcccccggccagatggtgaccatctcctgcagcgggtccagctccaacatcggcgacaactacgtgagctggtaccagcagctccccgggcgcggccccaagctgctggtctacgacacgtacaagcggtacctcgagaccccggaccgcttctccgggagcaagtccggcaccagcgcgaccctgggcatcacggggctgcagaccggcgacgaggccgactactactgcgggacctgggacacctccctcagcgccggcggggtgttcggcacgggcaccaaggtgaccgtcctg

SEQ ID NO: 10285 - RNA, 333 nt, synthetic construct
  misc_feature 1..333: note = derived and/or modified sequence opt1 from anti-HIV_048-155389_VR-Chain
  source 1..333: mol_type = other RNA
cagagcgtgctgacccagcccccgtccgtcagcgccgcccccggccagaaggtgaccatctcctgcagcgggatctccagcaacatcggcaacaaccccgtgtcctggtaccagcagttccccgggacggcgccgaagctcctgatctacaagaacgacaagcgccccagcggcatccccgaccggttctccgggagcaagtccggcaccagcgccaccctgggcatcaccgggctccagacgggcgacgaggccgactactactgcgggacctgggacacctccctgagcaccggcggggtcttcggcacgggcaccaaggtgaccgtgctg

SEQ ID NO: 10286 - RNA, 333 nt, synthetic construct
  misc_feature 1..333: note = derived and/or modified sequence opt1 from anti-HIV_048-154449_VR-Chain
  source 1..333: mol_type = other RNA
cagagcgtgctgaagcagcccccgtccgtcagcggcgcccccgggctccgcgtgaccatctcctgcaccggcgggagctccaacatcggcgggttcgacgtgcactggtaccagcacttccccggcacggcccccaagctgctgatctacgacaacgaccagcggccgagcggcatccccgaccgcttctccgggagcaagtccggcaccagcgcgaccctcgggatcaccggcctgcagacgggggacgaggccgactactactgcggcacctgggactccagcctgtccgccggcggggtcttcggcaccgggaccaaggtgacggtgctc

SEQ ID NO: 10287 - RNA, 333 nt, synthetic construct
  misc_feature 1..333: note = derived and/or modified sequence opt1 from anti-HIV_048-153379_VR-Chain
  source 1..333: mol_type = other RNA
cagagcgtgctgacccagcccccgtccgtcagcgccacccccggccagaaggtgacgatctcctgcagcgggtcccgcagcaacatcggctcccactacgtgagctggtaccagcagttccccgagtccgcccccaagctcctgatctacaagaacgacaaccggccgagcgggatccccgaccgcttctccggcagcaagtccgggaccagcgcgaccctgggcatctccggcctccagaccggggacgaggccgactactactgcggcacgtgggacaccagcctgtccgggggcggggtcttcggcaccggcaccaaggtgacggtgctg

SEQ ID NO: 10288 - RNA, 333 nt, synthetic construct
  misc_feature 1..333: note = derived and/or modified sequence opt1 from anti-HIV_048-153171_VR-Chain
  source 1..333: mol_type = other RNA
cagagcgtgctgacccagcccccgtccgtcagcgccgcccccggccagaaggtgaccatctcctgcagcgggtccacgagcaacatcgaggacatctacgtgtcctggtaccagcacctccccggcaccgcgcccaagctgctgatctacgacaacaacaagcgcccgagcgggatccccgaccggttctccggcagcaagtccgggaccagcgccaccctcgccatcacgggcctgcagaccggcgacgaggccgactactactgcgggacctgggacacctccctgagcgccggcggggtcttcggcacggggaccaaggtgaccgtgctc

SEQ ID NO: 10289 - RNA, 333 nt, synthetic construct
  misc_feature 1..333: note = derived and/or modified sequence opt1 from anti-HIV_048-152324_VR-Chain
  source 1..333: mol_type = other RNA
cagagcatggtgacccagtcccccagcgtctccgccgccccgggccagaaggtgaccatcagctgctccgggacgagctccaacatcggccagaactacgtgagctggtaccagcagctgcccgggaccgcgcccaagctcctgatctacgagaactccaagcgccccagcggcatcccggaccggttctccgggagcaagtccggcaccagcgccaccctgggcatcacggggctccagaccggcgacgaggccgactactactgcgggacctgggacacctccctgagcgccggcggggtcttcggctccggcacgaaggtgaccgtgctg

SEQ ID NO: 10290 - RNA, 333 nt, synthetic construct
  misc_feature 1..333: note = derived and/or modified sequence opt1 from anti-HIV_048-146102_VR-Chain
  source 1..333: mol_type = other RNA
cagagcgtgctgacccagcccccgtccgtcagcgccgcccccggccagaaggtgaccatctcctgcagcgggtccagctccacgatcggcaacaactacatcagctggtaccagctcctgcccgggacgcccccgaagctgctcatctacaagaacaacgagcgcccctccggcatccccgaccggttcagcgggtccaagagcggcacctccgcgaccctgggcatcaccgggctgcagaccggcgacgaggccgactactactgcgggacctgggacaccagcctctccgccggcggggtgttcggcacgggcaccaaggtcaccgtgctg

SEQ ID NO: 10291 - RNA, 333 nt, synthetic construct
  misc_feature 1..333: note = derived and/or modified sequence opt1 from anti-HIV_048-145984_VR-Chain
  source 1..333: mol_type = other RNA
cagagcgtgctgacccagcccctctccgtcagcggcgccccggggcagcgcgtgaccatctcctgcacgggcagctccagcaacatcgggtccaacttcgtgagctggtaccaggtcctgcccggcaccacccccaagctgctcatcttcaagaacaacgagcggccctccgggatcccggaccgcttcagcggctccaagagcggcacctccgccacgctggggatcaccggcctgcagaccggggacgaggcggactactactgcggcgcctgggacaccagcctctccgccgggggcgtgttcggcacggggaccaaggtgaccgtcctg

SEQ ID NO: 10292 - RNA, 333 nt, synthetic construct
  misc_feature 1..333: note = derived and/or modified sequence opt1 from anti-HIV_048-145371_VR-Chain
  source 1..333: mol_type = other RNA
cagagcgtgctgacccagcccccgtccgtcagcgccgcctccggccagaaggtgagcatcccctgctccgggggcaccagcaacatcggggacaactacgtgtcctggttccagcagttccccggcagcgcgcccaagatcctcatctacgactccgacaagcgcccgagccggatctccgaccgcttcagcgcctccaagagcgggacgtccgccaccctggacatcacccggctgcagaccggcgacgaggccgactactactgcggcacgtgggacaccagcctctccgccgggggcgtcttcgggaccggcaccaaggtgacggtgctg

SEQ ID NO: 10293 - RNA, 333 nt, synthetic construct
  misc_feature 1..333: note = derived and/or modified sequence opt1 from anti-HIV_048-144907_VR-Chain
  source 1..333: mol_type = other RNA
cagagcgccctgacccagcccgcctccgtgagcggctccccggggcagagcatcaccatctcctgcacgggcacccgccgggacgtcgggttcaactacgtgagctggtaccagcagcaccccggcaccgcgcccaagctcctgatctacgagaacaacaagcgcccctccgggatcccggaccggttcagcggctccaagagcggcacctccgccacgctggggatcaccggcctccagaccggggacgaggccgactactactgcggcacctgggacagctccctgagcgccgggggcgtgttcggcacggggaccaaggtcaccgtgctg

SEQ ID NO: 10294 - RNA, 333 nt, synthetic construct
  misc_feature 1..333: note = derived and/or modified sequence opt1 from anti-HIV_048-142298_VR-Chain
  source 1..333: mol_type = other RNA
cagagcgtgctgacccagcccccgtccgccagcggcacccccgggcagcgcgtcacgatctcctgcagcggctccagctccaccatcgggaacaactacatcagctggtaccagctcctgcccggcacgcccccgaagctgctcatcttcaagaacaacgagcggccctccgggatccccgaccgcttcagcgcctccaagagcggcacctccgcgaccctgggcatcaccgggctgcagaccggcgacgaggccgactactactgcgggacctgggacacgagcctctccgccggcggggtgttcggcaccggcaccaaggtgaccgtcctg

SEQ ID NO: 10295 - RNA, 333 nt, synthetic construct
  misc_feature 1..333: note = derived and/or modified sequence opt1 from anti-HIV_048-142277_VR-Chain
  source 1..333: mol_type = other RNA
cagagcgtgctgacccagcccccgtccgtcagcggcgcccccgggcagcgcatcaccatctcctgcacgggcagctccagcaacatcggggcctacgacgtgcagtggtaccagcacctccccggcaccgcgcccaagctgctgatctacaagaacaccgagcggccgtccgggatccccgaccgcttcagcggctccaagagcggcacctccgccacgctcgacatcaccgggctgcagaccggcgacgaggccgactactactgcgggacctgggacacgagcctgtccgccggcggggtgttcggcaccggcaccaaggtcaccgtgctc

SEQ ID NO: 10296 - RNA, 333 nt, synthetic construct
  misc_feature 1..333: note = derived and/or modified sequence opt1 from anti-HIV_048-141934_VR-Chain
  source 1..333: mol_type = other RNA
cagagcgtgctgacccagcccccgtccgtcagcggcgcccccgggcagcgcgtgaccatctcctgcacgggcaacagctccaacatcggggcctacgacgtgcactggtaccagcagctccccggcaccgcgcccaagctgatgatctacgaggtcagcaagcggccgtccgggatccccgaccgcttcagcggctccaagagcggcacctccgccaccctggggatcacgggcctccagaccggggacgaggccgactactactgcggcacctgggacaccagcctgtccgccgggggcgtgttcggcagcgggacgaaggtgaccgtcctg

SEQ ID NO: 10297 - RNA, 333 nt, synthetic construct
  misc_feature 1..333: note = derived and/or modified sequence opt1 from anti-HIV_048-141207_VR-Chain
  source 1..333: mol_type = other RNA
cagagcgtgctgacccagcccccgtccgtcagcgccgcccccggccagaaggtgaccatcgcgtgctccgggagctccagcaacatcggcaacaactacgtgtcctggtaccagcagctccccgggacggcccccaagctgctgatctacgccaacaaccgccggccgagcggcatccccgaccgcttctccgccagcaagtccgggaccagcgccaccctcggcatcaccggcctgcagacgggggacgaggcggactactactgcggcacctgggacacctccctgagcgccgggggcgtcttcgggaccggcacgaaggtgaccgtgctc

SEQ ID NO: 10298 - RNA, 333 nt, synthetic construct
  misc_feature 1..333: note = derived and/or modified sequence opt1 from anti-HIV_048-140796_VR-Chain
  source 1..333: mol_type = other RNA
cagagcgtgctgacccagcccccgtccgtcagcgccacccccggccagaaggtgacgatctcctgcagcgggacccgctccaacatcggcaacaactacgtgagctggtaccggcagttccccgggaccgcccccaagctcctgatctacgaggacaacaagcgcccgtccggcatccccgcgcggttcagcgggtccaagagcggcacctccgccacgctgggcatcaccgggctccagaccggcgacgaggccgactactactgcgggacctgggacacgagcctgtccgccggcggggtcttcggcaccggcaccaaggtgaccgtgctg

SEQ ID NO: 10299 - RNA, 333 nt, synthetic construct
  misc_feature 1..333: note = derived and/or modified sequence opt1 from anti-HIV_048-139893_VR-Chain
  source 1..333: mol_type = other RNA
cagagcgtgctgacccagcccccgtccgtcagcgccacccccggccagaaggtgacgttctcctgcagcgggtccagctccaccatcggcaagaactacgtgagctggtaccaggtcctccccgggaccgcccccaagctgctgatctacaagaacaacaagcgcccgtccggcatccccgaccggttcagcgggtccaagagcggcacctccgcgacgctcggcatcaccgggctgcagaccggcgacgaggccgactactactgcgggacctgggacagctccctgagcgccggcggggtgttcggcacgggcaccaaggtgaccgtcctc

SEQ ID NO: 10300 - RNA, 333 nt, synthetic construct
  misc_feature 1..333: note = derived and/or modified sequence opt1 from anti-HIV_048-138820_VR-Chain
  source 1..333: mol_type = other RNA
cagagcgtgctgacccagcccccgtccgtcagcggcgcccccgggcagaaggtgaccatctcctgcagcggctccgggagcaacatcggcaacacgtacgtgtcctggtaccagcacctccccgggaccgcccccaagctgctgatctacgagaacaacaagcgcccgagcggcatccccgaccggttctccggcagcaagtccgcgaccagcgccaccctcgggatcacgggcctgcagaccggggacgaggccgactactactgcggcacctgggacacctccctgagcgccgggggcgtcttcggcacggggaccaaggtgaccgtgctc

SEQ ID NO: 10301 - RNA, 333 nt, synthetic construct
  misc_feature 1..333: note = derived and/or modified sequence opt1 from anti-HIV_048-135858_VR-Chain
  source 1..333: mol_type = other RNA
cagagcgtgctgacccagcccccgtccgccagcggcacccccgggcagcgcgtcacgatctcctgcagcggctccagctccaacatcgggagctcctacgtgtactggtaccagcagttccccggccggagcccccgcctcctgatctaccggaacaacgagcgcccgtccgggatccccgaccggttcagcggctccaagagcggcacctccgccaccctggggatcaccggcctccagacgggggacgaggcggactactactgcggcacctgggacaccagcctgtccgccgggggcgtgttcggcaccgggacgaaggtcaccgtgctg

SEQ ID NO: 10302 - RNA, 333 nt, synthetic construct
  misc_feature 1..333: note = derived and/or modified sequence opt1 from anti-HIV_048-134968_VR-Chain
  source 1..333: mol_type = other RNA
cagagcgtgctgacccagcccccgtccgtcagcgccgcccccggccagaaggtgaccatcttctgctccgggagctccagcaacatcggcaagaactacgtgtcctggtaccagcagctccccgggacggcgcccaagctgctgatctacgagaacagcaagcgcccgtccggcatccccgaccggttcagcgggtccaagagcggcacctccgccaccctcggcatcaccgggctgcagacgggcgacgaggccgactactactgcgggacctgggacaccagcctgtccgccggcggggtcttcggcagcggcaccaaggtgacggtgctc

SEQ ID NO: 10303 - RNA, 333 nt, synthetic construct
  misc_feature 1..333: note = derived and/or modified sequence opt1 from anti-HIV_048-134312_VR-Chain
  source 1..333: mol_type = other RNA
cagagcgtgctgacccagcccccgtccgccagcggcacccccgggcagcgcgtcacgatctcctgcagcggctccagctccaacatcgggaacaactacgtgagctggtaccggctcctgcccggcaccgcccccaagctgctcatctacaagaacgacaaccgcccgtccgggatccccgaccggttcagcggctccaagagcggcacctccgcgaccctggggatcagcggcctgcagacgggggacgaggccgactactactgcggcacctgggacacctccctcagcgggggcggcgtgttcgggaccggcacgaaggtcaccgtgctg

SEQ ID NO: 10304 - RNA, 330 nt, synthetic construct
  misc_feature 1..330: note = derived and/or modified sequence opt1 from anti-HIV_048-132253_VR-Chain
  source 1..330: mol_type = other RNA
agcgccctgacccagcccgcctccgtgagcggctccccggggcagagcatcgcgatctcctgcaccggcacgagctccgacgtcgggtacgacctcgtgagctggtaccagcagcaccccggcaccgcccccaagctgctgatctacgacaacaacaagcgcccctccgggatcccggaccggttcagcggctccaagagcggcacctccgccaccctcgggatcacgggcctgcagaccggggacgaggccgactactactgcggcacctgggacaccagcctgtccgccgggggcgtgttcggcagcgggacgaaggtcaccgtgctc

SEQ ID NO: 10305 - RNA, 333 nt, synthetic construct
  misc_feature 1..333: note = derived and/or modified sequence opt1 from anti-HIV_048-130710_VR-Chain
  source 1..333: mol_type = other RNA
cagagcgtgctgacccagcccccgtccgtcgccggcgcccccgggcagcgcgtgaccatcagctgcacgggcaacacctccaacatcgggggctacgacgtgcactggtaccagcagctccccgggacgcccccgaagctgctgatcttcaagaacaacgagcggcccagcggcatccccgaccgcttctccggcagcaagtccgggaccagcgcgaccctcggcatcaccgggctgcagaccggcgacgaggccgactactactgcgggacctgggacacgtccctgagcgccggcggcgtcttcgggaccggcaccaaggtgaccgtgctc

SEQ ID NO: 10306 - RNA, 333 nt, synthetic construct
  misc_feature 1..333: note = derived and/or modified sequence opt1 from anti-HIV_048-128564_VR-Chain
  source 1..333: mol_type = other RNA
cagagcgtgctgacccagcccccgtccgccagcggcacccccgggcagcgcgtcacgatctcctgcagcggctccagctccaacatcgggagcaacaccgtgaactggtaccagcagctccccggcaccgcccccaagctgctgatctacaagaacaccgagcggccgtccgggatccccgaccgcttcagcggctccaagagcggcacgtccgcgaccctcgacatcaccgggctgcagaccggcgacgaggccgactactactgcgggacgtgggacaccagcctgtccgccggcggggtgttcggcaccggcaccaaggtcacggtgctc

SEQ ID NO: 10307 - RNA, 333 nt, synthetic construct
  misc_feature 1..333: note = derived and/or modified sequence opt1 from anti-HIV_048-126702_VR-Chain
  source 1..333: mol_type = other RNA
cagagcgtgctgacccagcccccgtccgcgagcgccgcgcccggccagcgcgtcaccatctcctgcagcgggtccaacagcaacatcggcaacaactacgtgtcctggtaccagcagctccccgggacggcccccaagctgctgatctacgacaacagcaagcggccgtccggcatccccgaccgcttcagcgcctccaagagcgggacctccgccaccctcggcatcaccggcctgcagacgggggacgaggccgactactactgcggcacctgggacaccagcctgtccgccgggggcgtgttcgggaccggcacgaaggtcaccgtgctc

SEQ ID NO: 10308 - RNA, 333 nt, synthetic construct
  misc_feature 1..333: note = derived and/or modified sequence opt1 from anti-HIV_048-124521_VR-Chain
  source 1..333: mol_type = other RNA
cagagcgtgctgacccagcccccgtccgtcagcggcgcccccgggcagcgcgtgaccatctcctgcacgggcagctccagcaccttcgggggctacgacgtgtactggtaccagcagatccccgggaccgcccccaagctcctgatctacgagaacaacaagcggccgtccggcatccccgaccgcttcagcggctccaagagcgggacctccgcgacgctggccatcaccggcctccagaccggggacgaggccgactactactgcggcacctgggacgggagcctgtccacgggcggcgtcatcgggaccggcaccaaggtgaccgtgctg

SEQ ID NO: 10309 - RNA, 333 nt, synthetic construct
  misc_feature 1..333: note = derived and/or modified sequence opt1 from anti-HIV_048-122740_VR-Chain
  source 1..333: mol_type = other RNA
cagagcgtgctgacccagcccccgtccatgagcgccgcccccggccagtccgtcaccatcagctgctccgggagcacgttcaacatcgagaagcaccaggtgacctggctccgccacctccccggcaccgcgcccacctccgtgatcatcatgaacagccagcggccgtccgggacgcccgaccgcttcagcggctccaagagcgggacctccgccaccctggccatcaccggcctgcagacgggcgacgaggccgactactactgcgggacctgggacggcagcctgtccaccgggggcgtcatcgggaccggcacgaaggtgaccgtgctg

SEQ ID NO: 10310 - RNA, 327 nt, synthetic construct
  misc_feature 1..327: note = derived and/or modified sequence opt1 from anti-HIV_048-119536_VR-Chain
  source 1..327: mol_type = other RNA
gagctgacccagagcccctccgtgagcgccgccccgggcgagaaggtcaccatctcctgcagcgggacgaactccaacatcggctactactacgtgagctggtaccagcagttccccgggaccgcgcccaaggtggtcatctacgagaacaccaagcgcccctccggcatcccggaccggttcagcgggtccaagagcggcacctccgccacgctcggcatcaccgggctgcagaccggcgacgaggccgactactactgcgggacctgggacacgagcctgtccgccggcggggtgttcggcagcggcaccaaggtgaccgtcctc

SEQ ID NO: 10311 - RNA, 333 nt, synthetic construct
  misc_feature 1..333: note = derived and/or modified sequence opt1 from anti-HIV_048-116929_VR-Chain
  source 1..333: mol_type = other RNA
cagagcgtgctgacccagcccccgtccgtcagcggcgcccccgggcagcgcgtgaccatctcctgcacgggcagctccagcaacatcggggactacgacgtgcactggtaccagcagctccccggcaccgcccccaagctgctgatctaccggaacaaccagcgcccgtccggggtccccgaccggttcagcggctccaagagcggcacctccgcgaccctcgggatcacgggcctgcagaccggggacgaggccgactactactgcggcacctgggacgccagcctgtccgccgggggcgtgttcggcaccgggacgaaggtgaccgtcctc

SEQ ID NO: 10312 - RNA, 333 nt, synthetic construct
  misc_feature 1..333: note = derived and/or modified sequence opt1 from anti-HIV_048-116577_VR-Chain
  source 1..333: mol_type = other RNA
cagagcgtgctgacccagcccccgtccgccagcggcacccccgggcagcgcgtcacgatctcctgcagcggctccagctccaacatcgggagcaactacgtgtcctggtaccaggtgctccccggcaccgcccccaagctgctgatctacaagaacaacaagcggccgagcgggatccccgaccgcttctccggcagcaagtccggcaccagcgcgaccctcgggatcacgggcctgcagaccggggacgaggccgactactactgcgccacctgggacacctccctgagcgccggcggggtcttcggcacgggcaccaaggtgaccgtgctc

SEQ ID NO: 10313 - RNA, 333 nt, synthetic construct
  misc_feature 1..333: note = derived and/or modified sequence opt1 from anti-HIV_048-116046_VR-Chain
  source 1..333: mol_type = other RNA
cagagcgtgctgacccagcccccgtccgtcagcggcgcccccgggcagcgcgtgaccatctcctgcacgggcagctccagcaacatcgggggctacgacgtgcactggtaccagcagttccccgggaccgcccccaagctcctgatctacgacaacgacaagcggccgtccggcatccccgaccgcttcagcggctccaagagcgggacctccgcgaccctgggcatcacggggctccagaccggcgacgaggccaactactactgcggggcctgggacaccagcctgtccgccggcggcgtcttcgggaccggcacgaaggtgaccgtgctg

SEQ ID NO: 10314 - RNA, 333 nt, synthetic construct
  misc_feature 1..333: note = derived and/or modified sequence opt1 from anti-HIV_048-115875_VR-Chain
  source 1..333: mol_type = other RNA
cagagcgtgctgacccagcccccgtccgtcagcgccgcccccggccagcgcgtgaccgtgtcctgcagcgggtccagctccaacatcggcaacaacttcgtcagctggtaccagcacctccccgggacggcgcccaagctgctgatctacgacaactccaaccggccgagcggcatccccgaccgcttctccgggagcaagtccggcaccagcgccaccctcggcatcaccgggctgcacacgggcgacgaggccgactactactgcgggacctgggacacctccctgagcgccggcggggtgttcggctccggcaccaaggtgacggtcctc

SEQ ID NO: 10315 - RNA, 333 nt, synthetic construct
  misc_feature 1..333: note = derived and/or modified sequence opt1 from anti-HIV_048-115599_VR-Chain
  source 1..333: mol_type = other RNA
cagagcgtgctgacccagcccccgtccgtcagcgccgcccccggccagatggtgaccatctcctgcagcgggtccagctccaacatcggcagccactccgtgagctggtaccagcacttccccgggacggcgcccaagctcgtcatcgaggagaacgaccagcgcccgtccggcatccccgaccggttcagcgggtccaagagcggcacctccgccaccctgggcatcaccgggctgcagacgggcgacgagggggactactactgcggcacctgggacaccagcctctccgggggcggcgtgttcgggaccggcacgaaggtgaccgtcctg

SEQ ID NO: 10316 - RNA, 333 nt, synthetic construct
  misc_feature 1..333: note = derived and/or modified sequence opt1 from anti-HIV_048-113988_VR-Chain
  source 1..333: mol_type = other RNA
cagagcgtgctgacccagcccccgtccgtcagcgccgcccccggccagatggtgaccatctcctgcagcgggtccagccacaacatcggcgagaactacgtgtcctggtaccagcacctccccgggacggcgcccaagctgctgatcttcaagaacaacgagcgcccgagcggcatccccgaccggttctccgggagcaagtccggcaccagcgccaccctcggcatcaccgggctgcagacgggcgacgaggccgactactactgcgggacctgggacacctccctgagcgccggcggggtcttcggcaccggcacgaaggtgaccgtgctc

SEQ ID NO: 10317 - RNA, 333 nt, synthetic construct
  misc_feature 1..333: note = derived and/or modified sequence opt1 from anti-HIV_048-112989_VR-Chain
  source 1..333: mol_type = other RNA
cagagcgtgctgacccagcccccgtccgccagcggcacccccgggcagcgcgtcacgctctcctgcagcggcgggtccagcaacatcggcaacgacaacgtgtactggtaccagcagcggcccgggaccacccccaagctgctgatctacaacgacaaccgccggccgtccggcacccccgaccgcttcagcggctccaagagcgggacgtccgccaccctcgcgatcaccggcctgcagaccggggacgaggccgactactactgcggcacgtgggacgggagcctgtccaccggcggcgtgatcgggaccggcaccaaggtcacggtgctc

SEQ ID NO: 10318 - RNA, 333 nt, synthetic construct
  misc_feature 1..333: note = derived and/or modified sequence opt1 from anti-HIV_048-112435_VR-Chain
  source 1..333: mol_type = other RNA
cagagcgtgctgacccagcccccgtccgtcagcgccgcccccggccagaaggtgtccatcagctgctccgggagctccagcaacatcggcaagaactacgtgtcctggtaccagcagctccccgggaccgcgcccaagctgctgatcttcaagaacaacgagcgcccgagcggcatccccgaccggttctccgggagcaagtccggcacgagcgccaccctcggcatcaccgggctgcagaccggcgacgaggccgactactactgcgccacgtgggacacctccctgagcgccgggggcgtcttcgggaccggcaccaaggtgacggtgctc

SEQ ID NO: 10319 - RNA, 333 nt, synthetic construct
  misc_feature 1..333: note = derived and/or modified sequence opt1 from anti-HIV_048-111339_VR-Chain
  source 1..333: mol_type = other RNA
cagagcgtgctgacccagcccccgtccgtcagcgccgcccccggccagaaggtgaccatctcctgcacggggagctccagcaacatcggcgggtacgcggtgcactggtaccagcaggtccccgccaccgcccccaagctcctgatctacgagaacaacgagcgcccgtccggcatccccgaccggttcagcgggtccaagagcggcacctccgccaccctgggcatcacggggctccagaccggcgacgaggccgactactactgcgggacctgggacaccagcctgtccgcgggcggggtgttcggcacgggcaccaaggtgaccgtcctg

SEQ ID NO: 10320 - RNA, 333 nt, synthetic construct
  misc_feature 1..333: note = derived and/or modified sequence opt1 from anti-HIV_048-111055_VR-Chain
  source 1..333: mol_type = other RNA
cagagcgccctgacccagcccgcctccgtgagcggctccccggggcagagcatcaccatctcctgcacgggcacccgcagcgacgtcgggtacaactacgtgtcctggtaccagcagcaccccggcaaggcgcccaagctcctgatctacgagaacaccaagcggcccagcgggatcccggaccgcttctccggcagcaagtccggcaccagcgccacgctggggatcaccggcctccagaccggggacgaggccgactactactgcggcacctgggacacgtccctgagcgccgggggcgtgttcggctccgggaccaaggtcaccgtgctg

SEQ ID NO: 10321 - RNA, 333 nt, synthetic construct
  misc_feature 1..333: note = derived and/or modified sequence opt1 from anti-HIV_048-111027_VR-Chain
  source 1..333: mol_type = other RNA
cagagcgtgctgacccagcccccgtccgtcagcgccgcccccggccagaaggtgaccatctcctgcagcgggtccaacagcaacctcggcaacaactacgtgtcctggtaccagcacctccccgggacggcgccccgcctgctgatctacgaggacaagaagcggccgagcggcatccccgaccgcttctccgggagcaagtccggcgccagcgccaccctggacatcaccggcctgcagaccggggacgaggccgactactactgcggcatctgggacacgtccctcagcgccgggggcgtcttcgggaccggcaccaaggtgaccgtgctg

SEQ ID NO: 10322 - RNA, 333 nt, synthetic construct
  misc_feature 1..333: note = derived and/or modified sequence opt1 from anti-HIV_048-109721_VR-Chain
  source 1..333: mol_type = other RNA
cagagcgtgctgacccagcccccgtccgtcagcgccgcccccggccagaaggtgaccatctcctgcagcgggtccagctccgacatcggcagcaacttcgtgtcctggtaccagcacctccccgggacggcgccccgcctgctgatctacgagaacaaccggcgcccgagcggcatccccgaccggttctccgggagcaagtccggcaccagcgccaccctcgccatcaccggcctgcagacgggggacgaggccgactactactgcggcacctgggacacctccctgaaccgcgggggcgtcttcgggaccggcacgaaggtgaccgtgctc

SEQ ID NO: 10323 - RNA, 333 nt, synthetic construct
  misc_feature 1..333: note = derived and/or modified sequence opt1 from anti-HIV_048-109666_VR-Chain
  source 1..333: mol_type = other RNA
cagagcgtgctgacccagcccccgtccatgagcgccgcccccggcgagcgcgtcaccatctcctgcagcgggtccagctccaacatcggcaaccaccacgtgagctggtaccagcagcggcccgggacggcgcccaagctcctgatctacgagaacaacgagcgcccgtccggcatccccgaccggttcagcgggtccaagagcggctccagcgccaccctggccatcaccggcctccagaccggggacgaggccgactactactgcggcacgtgggacgggcgcctgaacatcggcggggtgatcggcaccggcaccaaggtcaccgtgctg

SEQ ID NO: 10324 - RNA, 333 nt, synthetic construct
  misc_feature 1..333: note = derived and/or modified sequence opt1 from anti-HIV_048-109196_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgatctacgagaccaacaagcgcccgtccggcatccccgaccggttcagcgggtccaagagcggcacctccgccaccctcgccatcacgggcctgcagaccggggacgaggccgactactactgcggcacctgggacaccagcctgtccgggggcggggtcttcggcacgggcaccaaggtgaccgtgctc

SEQ ID NO: 10325 - RNA, 333 nt, synthetic construct
  misc_feature 1..333: note = derived and/or modified sequence opt1 from anti-HIV_048-109051_VR-Chain
  source 1..333: mol_type = other RNA
cagagcgtgctgacccagcccccgtccgtcagcgccgcccccggccagaaggtgaccatctcctgcagcgggaacaactccaacatggtgaacaactacatcagctggtaccagctcctgcccggcacgcccccgaagctgctcatcttcaagaacaacgagcgcccctccgggatccccgaccggttcagcggctccaagagcgggacctccgcgaccctgggcatcaccggcctgcagacgggggacgaggccgactactactgcggcacctgggacaccagcctctccgccgggggcgtcttcgggaccggcacgaaggtgaccgtgctg

SEQ ID NO: 10326 - RNA, 333 nt, synthetic construct
  misc_feature 1..333: note = derived and/or modified sequence opt1 from anti-HIV_048-108570_VR-Chain
  source 1..333: mol_type = other RNA
cagagcgccctgacccagcccccgtccgtgagcgccgcgcccggccagaaggtcaccatctcctgcagcgggaagtccagcaacatcggcacgaacttcgtgtcctggtaccagcagttccccgaggccgcccccaagctcctgatctacgacaacaacaagcgcccgagcgggatccccgaccggttctccggcagcaagtccgggaccagcgccaccctgggcatcaccggcctccagacgggggacgaggccgactactactgcggcacctgggacgggtccctgagcaccggcggggtgatcggcaccggcacgaaggtcaccgtgctg

SEQ ID NO: 10327 - RNA, 327 nt, synthetic construct
  misc_feature 1..327: note = derived and/or modified sequence opt1 from anti-HIV_048-108033_VR-Chain
  source 1..327: mol_type = other RNA
gagctgacccagagcccctccgtgagcgccgccccgggccagcgcgtcaccatctcctgcagcgggaactccagcaacatcggcaacaactacgtgtcctggtaccagctcctgcccgggacggcgcccaagctgctcatctacaagaacgacaagcggcccagcggcatcccggaccgcttctccgggagcaagtccggcaccagcgccaccctgggcatcaccgggctgcagacgggcgacgaggccgactactactgcgggacctgggacacctccctcagcaccggcggggtgttcggcacgggcaccaaggtcaccgtgctg

SEQ ID NO: 10328 - RNA, 333 nt, synthetic construct
  misc_feature 1..333: note = derived and/or modified sequence opt1 from anti-HIV_048-107279_VR-Chain
  source 1..333: mol_type = other RNA
cagagcgtgctgacccagcccccgtccgtcagcgccgcccccggccagaaggtgatcatctcctgcagcgggtccagctccaacatcggcaagaactacgtgagctggtaccagcacctccccgggaccgcgcccaagctgctgatctacgagaacaacaagcgcccgtccggcatccccgaccggttcagcgggtccaagagcggcacgtccgccaccctcggcatcaccgggctgcagaccggcgacgaggccgactactactgcgggacgtgggacgccagcctgtccgccggcggggtcctcggcaccggcaccaaggtgaccgtgctg

SEQ ID NO: 10329 - RNA, 333 nt, synthetic construct
  misc_feature 1..333: note = derived and/or modified sequence opt1 from anti-HIV_048-106271_VR-Chain
  source 1..333: mol_type = other RNA
cagagcgtgctgacccagcccccgtccgtcagcgccgcccccggccagaaggtgaccatctcctgcagcgggtcccgcagcaacatcggctccaactacatcagctggtaccagcagctccccgggacggcgcccaagctgctgatctacaagaacgacaagcggccgtccggcatccccgaccgcttcagcgggtccaagagcggcacctccgccatcctcggcatcaccgggctgcagaccggcgacgaggccgactactactgcggggcctgggacacgagcctgtccgccggcggggtgttcggcaccggcaccaaggtcaccgtgctc

SEQ ID NO: 10330 - RNA, 333 nt, synthetic construct
  misc_feature 1..333: note = derived and/or modified sequence opt1 from anti-HIV_048-106054_VR-Chain
  source 1..333: mol_type = other RNA
cagagcgtgctgacccagcccccgtccgtcagcgccgcccccggccagcaggtcaccatctcctgcagcgggtccacgagcaacatcggcaacaactacgtgtcctggtaccagcaggtccccgggaccgcgcccaagctcctgatctacgacaacaacaaccgcccgagcggcatccccgaccggttctccgggagcaagtccggcaccagcgccaccctgggcatctccgggctccagacgggcgacgaggccgactactactgcgggacctgggacaccagcctgtccggcgggggcgtgttcggcaccgggacgaaggtgaccgtgctg

SEQ ID NO: 10331 - RNA, 333 nt, synthetic construct
  misc_feature 1..333: note = derived and/or modified sequence opt1 from anti-HIV_048-104848_VR-Chain
  source 1..333: mol_type = other RNA
cagagcgccctgacccagcccgcctccgtgagcggctccccggggcagagcatcaccatctcctgcacgggcaccagctccgacgtcgggtacaactacgtgagctggtaccagcagctccccggcaccgcgcccaagctgctgatcttcgacaacgacgaccgcccctccgagatcccggaccggttcagcgggtccaagagcggcacctccgccacgctcggcatcaccgggctgcagcccggcgacgaggccgactactactgcgggacctgggacagctccctgagcgccggcggggtgttcggcaccggcacgaaggtcaccgtgctc

SEQ ID NO: 10332 - RNA, 333 nt, synthetic construct
  misc_feature 1..333: note = derived and/or modified sequence opt1 from anti-HIV_048-104638_VR-Chain
  source 1..333: mol_type = other RNA
cagagcgtgctgacccagcccccgtccgccagcggcacccccgggcaccgcgtcacgatctcctgcagcggcaactccagcaacatcgggggcaaccacgtgtactggtaccagcaggtccccgggaccacccccaagctcctgatctaccggaacaacgagcgcccgtccggcatccccgaccggttcagcggctccaagagcgggacctccgccacgctgggcatcaccgggctccagaccggcgacgaggcggactactactgcgggacctgggacacgagcctgtccgccggcggcgtgttcgggaccggcaccaaggtgaccgtgctg

SEQ ID NO: 10333 - RNA, 333 nt, synthetic construct
  misc_feature 1..333: note = derived and/or modified sequence opt1 from anti-HIV_048-104567_VR-Chain
  source 1..333: mol_type = other RNA
cagagcgtgctgacccagcccccgtccgccagcggcacccccgggcagcgcgtcacgatctcctgcagcggctccaacagcaacatcgggaccaacttcgtgaactggtaccagcacgtgcccggccgggcccccaagctcctgatctacaagaacaccgagcgcccgtccgggatccccgaccggttcagcggctccaagagcggcacctccgcgacgctggacatcaccgggctccagaccggcgacgaggccgactactactgcgggacctgggacacgagcctgtccgccggcggggtcttcggcaccggcaccaaggtgaccgtgctg

SEQ ID NO: 10334 - RNA, 333 nt, synthetic construct
  misc_feature 1..333: note = derived and/or modified sequence opt1 from anti-HIV_048-102804_VR-Chain
  source 1..333: mol_type = other RNA
cagagcgtgctgacccagcccccgtccgtcagcaccgcccccggccagaaggtgacgatctcctgcagcgggtccagctccaacatcggctacagctacgtgtcctggttccagcacctccccgggaccgcccccaagctgctgatctacggcaacagcaaccgcccgtccggggtccccgaccggttcagcggctccaagagcggcacctccgcgagcctcgccatcaccgggctgcagacgggcgacgaggccgactactactgcgggacctgggactccagcctgtccgccggcggggtgttcggcaccggcaccaaggtgacggtcctc

SEQ ID NO: 10335 - RNA, 333 nt, synthetic construct
  misc_feature 1..333: note = derived and/or modified sequence opt1 from anti-HIV_048-101676_VR-Chain
  source 1..333: mol_type = other RNA
cagagcgtgctgacccagcccccgtccgtcagcggcgcccccgggcagtccgtgaccatcagctgcacgggcacctccagcaacatcggggacttcgacgtgcactggtaccagcagctccccggcaccgcccccaagctgctgctctacgagaacaacaagcgcccgtccgggatccccgaccggttcagcggctccaagagcggcacctccgcgacgctggccatcaccgggctgcagaccggcgacgaggccgactactactgcgggacctgggacggcagcctctccaccgggggcgtcatcggcacggggaccaaggtgaccgtgctg

SEQ ID NO: 10336 - RNA, 333 nt, synthetic construct
  misc_feature 1..333: note = derived and/or modified sequence opt1 from anti-HIV_048-097603_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgatctacgacaccgtcaagcgcccgtccggcatccccgaccggttcagcgggtccaagagcggcacctccgccaccctcggcatcacggggctgcagaccggcgacgaggccgactactactgcgggacctgggacagctccctgagcggcgggggcgtgttcggcaccgggacgaaggtgaccgtcctc

SEQ ID NO: 10337 - RNA, 333 nt, synthetic construct
  misc_feature 1..333: note = derived and/or modified sequence opt1 from anti-HIV_048-097107_VR-Chain
  source 1..333: mol_type = other RNA
cagagcgtgctgacccagcccccgtccgtcagcgccgcccccggccagaaggtgaccatctcctgcagcgggtccagctccaacatcgagaacaactacgtgagctggtaccgccaggtccccggcacggcgcccaagctcctgatctacaagaacgacaaccggccgtccgggatccccgaccgcttcagcggctccaagagcgggacctccgccaccctgggcatcaccggcctccagacgggggacgaggccgactactactgcggcatctgggacaccagcctgtccgccgggggcgtgttcgggaccggcaccaaggtgacggtcctg

SEQ ID NO: 10338 - RNA, 333 nt, synthetic construct
  misc_feature 1..333: note = derived and/or modified sequence opt1 from anti-HIV_048-096871_VR-Chain
  source 1..333: mol_type = other RNA
cagcccgtgctgacccagccgcccagcgcctccggcacccccgggcagcgcgtcacgatcagctgctccggcagctccagcaacatcgggtccaactacgtgtactggtaccagcagctccccggcaccaccccgaagctgctgatctaccggaacaaccagcgccccagcgggatccccgaccggttctccggcagcaagtccggcaccagcgccacgctcgggatcaccggcctgcagaccggggacgaggcggactactactgcggcacctgggacacgtccctgagcaccgggggcgtgttcggcaccgggaccaaggtcacggtgctc

SEQ ID NO: 10339 - RNA, 333 nt, synthetic construct
  misc_feature 1..333: note = derived and/or modified sequence opt1 from anti-HIV_048-096668_VR-Chain
  source 1..333: mol_type = other RNA
cagagcgtgctgacccagcccccgtccgtcagcgccgcccccggccagaaggtgaccatctcctgcagcgggtccggcagcaacatcgggaacaactacgtgtcctggtaccagcagctccccggcacggcgcccaagctgctgatctacaagaacaccgagcgcccgagcgggatccccgaccggttctccggcagcaagtccggcaccagcgccaccctcgacatcacggggctgcagaccggcgacgaggccgactactactgcgggacctgggacacctccctgagcgccggcggggtcttcggcacgggcaccaaggtgaccgtgctc

SEQ ID NO: 10340 - RNA, 333 nt, synthetic construct
  misc_feature 1..333: note = derived and/or modified sequence opt1 from anti-HIV_048-095236_VR-Chain
  source 1..333: mol_type = other RNA
cagagcgtgctgacccagcccccgtccgtcagcgccccgcccggccagaaggtgaccatctcctgcagcgggacgacctccaacatcggcagcaactacgtggcctggtaccagcagctccccgggaccgcgcccaagctggtcatctacgagaactccaagcgccccagcggcatccccgaccggttctccgggagcaagtccggcaccagcgccacgctgggcatcaccgggctccagaccggcgacgaggccgactactactgcgggacctgggacacgtccctgagcgccggcggggtgttcggctccggcaccaaggtgaccgtcctg

SEQ ID NO: 10341 - RNA, 333 nt, synthetic construct
  misc_feature 1..333: note = derived and/or modified sequence opt1 from anti-HIV_048-094155_VR-Chain
  source 1..333: mol_type = other RNA
cagagcgtgctgacccagcccccgtccgtcagcgccgcccccggccagaaggtgaccgtgtcctgcagcgggtccagctccgacatcggcgagaactacgtcagctggtaccagcagttccccgagacggcgcccaagctcctgatctacgacaacaacaagcgcccgtccgggatccccgaccggttcagcggctccaagagcgggacctccgccaccctggccatcaccggcctccagacgggcgacgaggccgactactactgcgggacctgggacagctccctgagcgccggcggggtgttcggcaccgggaccaaggtgacggtcctg

SEQ ID NO: 10342 - RNA, 333 nt, synthetic construct
  misc_feature 1..333: note = derived and/or modified sequence opt1 from anti-HIV_048-093219_VR-Chain
  source 1..333: mol_type = other RNA
cagcccctgctcacccagccgcccgccgtgagcgccacccccggccagcgcgtcacgatctcctgcaccgggagctccagcaacatcggccggaccttcgtgaactggtaccagcagctgcccgggaccgcgccgaagctgctcatctacgagaactccaagcgccccagcggcatccccgaccggttctccgggagcaagtccggcacgagcgccaccctgggcatcaccgggctgcagaccggcgacgaggccgactactactgcgggacgtgggacacctccctcagcgccggcggggtgttcggctccggcaccaaggtcaccgtgctg

SEQ ID NO: 10343 - RNA, 333 nt, synthetic construct
  misc_feature 1..333: note = derived and/or modified sequence opt1 from anti-HIV_048-092976_VR-Chain
  source 1..333: mol_type = other RNA
cagagcgtgctgacccagcccccgtccgtcagcgccgcctccggccagaaggtgaccatcagctgctccgggagctccagcaacatcggcaacaactacgtgtcctggtaccagcacctccccgggacggcgcccaagctgctgatctacaagaacgacaagcgccccagcggcatcccggaccggttctccgggagcaagtccggcaccagcgccaccctcggcatcaccgggctgcagacgggcgacgaggccgactactactgcgggacctgggacacctccctgagcgccggcggggtcttcggcaccggcacgaaggtgaccgtgctc

SEQ ID NO: 10344 - RNA, 333 nt, synthetic construct
  misc_feature 1..333: note = derived and/or modified sequence opt1 from anti-HIV_048-090866_VR-Chain
  source 1..333: mol_type = other RNA
cagagcgtgctgacccagcccccgtccgtcagcgccgcccccggccagaaggtgaccatctcctgcagcgggtcccgcagcaacatcggctccaactacatcagctggtaccagcagctccccgggacggcgcccaagctgctgatctacgacaacaacaagcggccgtccggcatccccgaccgcttcagcgggtccaagagcggcacctccgccaccctcggcatcaccgggctgcagacgggcgacgaggcctactactactgcgggacctgggacaccagcctgtccgccggcggggtgttcggcagcggcaccaaggtcacggtgctc

SEQ ID NO: 10345 - RNA, 333 nt, synthetic construct
  misc_feature 1..333: note = derived and/or modified sequence opt1 from anti-HIV_048-090650_VR-Chain
  source 1..333: mol_type = other RNA
cagagcgccctgacccagcccgcctccgtgagcggctccctcgggcagagcatcaccatctcctgcagcggctccagctccacgatcgggaacaactacgtcagctggtaccaggtgctgccgggcgcggcccccaagctgctcatctgcaagaacaacgagcgcccctccgggatccccgaccggttcagcggctccaagagcggcacctccgccaccctggggatcaccggcctgcagacgggggacgaggccgactactactgcggcacctgggacaccagcctctccgccgggggcgtgttcggcaccgggacgaaggtcaccgtgctg

SEQ ID NO: 10346 - RNA, 333 nt, synthetic construct
  misc_feature 1..333: note = derived and/or modified sequence opt1 from anti-HIV_048-089009_VR-Chain
  source 1..333: mol_type = other RNA
cagagcgtgctgacccagcccccgtccgtcagcgccgcccccggccagaaggtgaccatctcctgcagcgggggctccagcaacatcgggaacaactacgtgtcctggtaccagcagctccccgagacggcgcccaagctgatcatctacgacaacaacaagcgcccgagcggcatccacgaccggttctccgggagcaagtccggcaccagcgccaccctggacatcaccgccctccagacgggcgacgaggccgactactactgcgggacctgggacacctccctgagcgccggcggggtcttcggcaccgggacgaaggtgaccgtgctg

SEQ ID NO: 10347 - RNA, 333 nt, synthetic construct
  misc_feature 1..333: note = derived and/or modified sequence opt1 from anti-HIV_048-088654_VR-Chain
  source 1..333: mol_type = other RNA
cagagcgccctgacccagccccgctccgtgagcgccgcgccgggccagaaggtctccatcagctgctccgggcggagcaccaacctcggctacaactacgtgtcctggtaccagcacctccccggggccgcccccaaggtgctgatctacgagaacaacaagcgccccagcggcatcccggaccggttctccgggagcaagtccggcacgagcgccaccctgggcatcaccgggctgcagaccggcgacgaggccgactactactgcgggacgtgggacacctccctgagcgcgggcggggtcttcggctccggcaccaaggtgaccgtgctc

SEQ ID NO: 10348 - RNA, 333 nt, synthetic construct
  misc_feature 1..333: note = derived and/or modified sequence opt1 from anti-HIV_048-086513_VR-Chain
  source 1..333: mol_type = other RNA
cagagcgccctgacccagcccccgtccgtgagcgccgcgcccggccagaaggtcaccatctcctgcagcgggtccacgagcaacatcggcaacaactacgtgtcctggtaccagcagctccccgggaccgcccccaagctgctgatctacaagaacgacaaccgcccgagcggcatccccgaccggttctccagctccaagagcgggacctccgccaccctcggcatcacgggcctgcagaccggggacgaggccgactactactgcggcatctgggacaccagcctgtccgccgggggcgtgttcgggaccggcacgaaggtcaccgtgctc

SEQ ID NO: 10349 - RNA, 324 nt, synthetic construct
  misc_feature 1..324: note = derived and/or modified sequence opt1 from anti-HIV_048-086024_VR-Chain
  source 1..324: mol_type = other RNA
ctggcccagcccccgagcgtgtccggcacccccgggcagcgcgtcaccatcagctgctccggcagctccagcaacatcgggtccaacgccgtgaactggtaccagcagttccccggcacggcgcccaagctcctgatctacgacaccgacaagcggccgagcgggatccccgaccgcttctccggcagcaagtccggcaccagcgccatcctggggatcaccggcctccagacgggggacgaggccgactactactgcggcgcctgggacacctccctgagcgccgggggcgtgttcggcaccgggaccaaggtcacggtgctg

SEQ ID NO: 10350 - RNA, 333 nt, synthetic construct
  misc_feature 1..333: note = derived and/or modified sequence opt1 from anti-HIV_048-085857_VR-Chain
  source 1..333: mol_type = other RNA
cagagcgccctgacccagccccgctccgtgagcggctccctcgggcagagcgtcaccatctcctgcacgggcaccaccagcgacgtggggttcgactacgtgtcctggtaccaggtcctgccgggcaccgcccccaagctgctcatctacaagaacgacaagcggcccagcgggatccccgaccgcttctccggcagcaagtccggcacgagcgcgaccctggggatcaccggcctgcagaccggggacgaggccgactactactgcggcacgtgggacacctccctcagcaccgggggcgtgttcggcaccgggacgaaggtgaccgtcctg

SEQ ID NO: 10351 - RNA, 333 nt, synthetic construct
  misc_feature 1..333: note = derived and/or modified sequence opt1 from anti-HIV_048-084277_VR-Chain
  source 1..333: mol_type = other RNA
cagagcgtgctgcgccagcccccgtccctcagcggcgcccccgggcagcgggtcaccctgtcctgcaccggcagctccagcaacatcgggggctacgacgtgcactggtaccagcacgtgcccgggacggcccccaagctgctcatctacgagaacaccaagcgcccgtccggcatccccgaccggttcagcggctccaagagcgggacctccgcgaccctgggcatcacggggctgcagaccggcgacgaggccgactactactgcgggacctgggacaccagcctctccgccggcggcgtcttcgggagcggcacgaaggtgaccgtgctg

SEQ ID NO: 10352 - RNA, 333 nt, synthetic construct
  misc_feature 1..333: note = derived and/or modified sequence opt1 from anti-HIV_048-084245_VR-Chain
  source 1..333: mol_type = other RNA
cagagcaccctgacccagcccccgtccgtgagcgccgcccccggccagaaggtcacgatctcctgcagcgggtccaacagcaacatcggcaagcactacgtgtcctggtaccagcagttccccggggcggtgcccaagctcctgatctacgagaacaagaagcgcccgagcggcatccccgaccggttctccgggagcaagtccgacaccagcgccaccctggacatcaccggcctccagacgggcgacgaggccgactactactgcgggacctgggacacctccctgagcgccggcggggtcttcggctccgggaccaaggtgacggtgctg

SEQ ID NO: 10353 - RNA, 333 nt, synthetic construct
  misc_feature 1..333: note = derived and/or modified sequence opt1 from anti-HIV_048-082487_VR-Chain
  source 1..333: mol_type = other RNA
cagagcctgctcacccagcccccgtccgtgagcgccgcccccggccagaaggtcaccatctcctgcagcgggtccagctccacgatcggcaacaactacgtgagctggtaccaggtgctgcccggggcggcccccaagctgctcatctgcaagaacaacgagcgcccgtccggcatccccgaccggttcagcgggtccaagagcggcacctccgccaccctgggcatcaccgggctgcagacgggcgacgaggccgactactactgcgggacctgggacaccagcctctccgccggcggggtcttcggcagcggcaccaaggtgacggtgctg

SEQ ID NO: 10354 - RNA, 333 nt, synthetic construct
  misc_feature 1..333: note = derived and/or modified sequence opt1 from anti-HIV_048-081787_VR-Chain
  source 1..333: mol_type = other RNA
cagagcgtgctgacccagcccccgtccgtcagcggcgcccccgggcagcgcgtgaccatctcctgcacgggcagctccagcaacatcgggtcctacgacgtgcactggtaccagcagctccccggcaccgcccccaagctgctgatctacgagaacagcaagcggccgtccgggatccccgaccgcttcagcggctccaagagcggcacctccgcgaccctcgggatcacgggcctgcagaccggggacgaggccgactactactgcggcacctgggacaccagcctgtccgggggcggcgtcttcgggacgggcaccaaggtgaccgtgctc

SEQ ID NO: 10355 - RNA, 333 nt, synthetic construct
  misc_feature 1..333: note = derived and/or modified sequence opt1 from anti-HIV_048-081062_VR-Chain
  source 1..333: mol_type = other RNA
cagagcgtgctgacccagcccccgtccgtcagcgccgcccccggccagaaggtgaccatctcctgcagcgggacgtccagcaacatcggcgcgaactacgtgtcctggtaccagcaggtccccgggaccgcccccaagctcctgatctacgagaacaacaagcgcccgagcggcacccccgaccggttctccgggagcaagtccggcaccagcgccacgctgggcatcaccgggctccagaccggcgacgaggccgactactactgcgggacctgggacacgtccctgagcgccggcggggtgttcggctccggcaccaaggtgaccgtcctg

SEQ ID NO: 10356 - RNA, 333 nt, synthetic construct
  misc_feature 1..333: note = derived and/or modified sequence opt1 from anti-HIV_048-079639_VR-Chain
  source 1..333: mol_type = other RNA
cagagcgtgctgacccagcccccgtccgtcagcgccgcccccggccagaaggtgaccatctcctgcagcgggtccagctccaacatcggcaagaactacgtgagctggtaccagcacctccccgggacggcgcccaagctgctgatctacgagaacaacaagcgcccgtccggcatccccgaccggttcagcgggtccaagagcggcaccgccgccaccctcggcatcaccgggctgcagacgggcgacgaggccgggtactactgcggcacctgggacacctccctgagcgccgggggcgtcttcggcaccgggacgaaggtgaccgtgctc

SEQ ID NO: 10357 - RNA, 333 nt, synthetic construct
  misc_feature 1..333: note = derived and/or modified sequence opt1 from anti-HIV_048-079126_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcacctccccgggacgcccccgaagctgctgatcttcaagaacaacgagcgcccctccggcatccccgaccggttcagcgggtccaagagcggcacctccgcgaccctcggcatcaccgggctgcagacgggcgacgaggccgactactactgcgggacctgggacaccagcctgtccgccggcggggtcttcggcaccggcacgaaggtgaccgtgctc

SEQ ID NO: 10358 - RNA, 333 nt, synthetic construct
  misc_feature 1..333: note = derived and/or modified sequence opt1 from anti-HIV_048-073118_VR-Chain
  source 1..333: mol_type = other RNA
cagagcgtgctgacccagcccccgtccgtcagcgccgcgccccgccacaacgtgaccatctcctgcagcggcgggtccagcaacatcggcaacaacttcgtgtcctggtaccagtacctccccgggacggcccccaagctgctgatctacgacaacaacaagcggccgagcggcatccccgaccgcttctccgggagcaagtccggcaccagcgccaccctcggcatcaccgggctgcagacgggcgacgaggccgactactactgcgccacctgggacacctccctgagcgccgggggcgtcttcgggaccggcacgaaggtgaccgtgctc

SEQ ID NO: 10359 - RNA, 333 nt, synthetic construct
  misc_feature 1..333: note = derived and/or modified sequence opt1 from anti-HIV_048-070264_VR-Chain
  source 1..333: mol_type = other RNA
cagagcgtgctgacccagtcccccagcgtctccgccgccccgggccagaaggtgaccatcagctgctccgggacgagctccaacatcggcaacacctacgtgagctggtaccagcagctccccgggaccgcgcccaagctgctgatctacaagaacgacaagcgcccctccggcatcccggaccggttcagcgggtccaagagcggcacctccgccacgctcggcatcaccgggctgcagaccggcgacgaggccgactactactgcgggacctgggacagctccctgagcgccggcggggtcttcggcacgggcaccaaggtgaccgtgctc

SEQ ID NO: 10360 - RNA, 333 nt, synthetic construct
  misc_feature 1..333: note = derived and/or modified sequence opt1 from anti-HIV_048-069426_VR-Chain
  source 1..333: mol_type = other RNA
cagagcgtgctgacccagcccccgtccgtcagcgccgcccccggccagaaggtgaccatctcctgcagcgggtccagctccacgatcggcaacaactacgtgagctggtaccagcagctccccgggaccgcgcccaagctgctgatctacaagaacaacaagcgcccgtccggcgtccccgaccggttcagcgggtccaagagcggcacctccgccacccccggcatcacggggctccagaccggcgacgaggccgactactactgcgggacctgggacaccagcctgtccgccggcggggtgttcggcacgggcaccaaggtgaccgtcctg

SEQ ID NO: 10361 - RNA, 333 nt, synthetic construct
  misc_feature 1..333: note = derived and/or modified sequence opt1 from anti-HIV_048-068564_VR-Chain
  source 1..333: mol_type = other RNA
cagagcgccctgacccagccccgctccgtgagcggctccccggggcagagcgtcgccatctcctgcaccggcacgagctccgacgtggggtacaactacgtgagctggtaccaggtcctccccggcaccgcgcccaagctgctgatctacaagaacaacgagcggccctccgggatcccggaccgcttcagcggctccaagagcggcacctccgccaccctcgggatcacgggcctgcagaccggggacgaggccgactactactgcggcacctgggacaccagcctgtccgccgggggcgtgttcggcacggggaccaaggtgaccgtcctc

SEQ ID NO: 10362 - RNA, 333 nt, synthetic construct
  misc_feature 1..333: note = derived and/or modified sequence opt1 from anti-HIV_048-068345_VR-Chain
  source 1..333: mol_type = other RNA
cagagcgtgctgacccagaccccctccgtcagcgccgccccgggccagcgcgtgacgatctcctgcagcgggtccaccagcaacatcggcaacaactacgtgtcctggtaccagcagctccccgggaccgcgcccaagctgctgatctacgagaacaacaagcggcccagcggcatccgcgaccggttctccgccagcaagtccgggaccagcgccacgctcggcatcaccggcctgcagaccggggacgaggccgactactactgcggcacctgggacacgtccctgagcgccgggggcgtcttcgggaccggcaccaaggtgaccgtgctc

SEQ ID NO: 10363 - RNA, 333 nt, synthetic construct
  misc_feature 1..333: note = derived and/or modified sequence opt1 from anti-HIV_048-067337_VR-Chain
  source 1..333: mol_type = other RNA
cagagcgtgctgacccagcccccgtccgtcagcgcggcccccggccagaaggtgaccatctcctgcagcggggcgtcctacaacatcggcaagaacagcgtgtcctggtaccagcagctccccgggacggcccccaagctgctgatctacaagaacgacaagcgcccgagcggcatccccgaccggttctccgggagcaagtccggcgccagcgccaccctcgacatcaccggcctgcagaccggggacgaggccgactactactgcggcatctgggacacgtccctgagcgccgggggcgtcttcgggaccggcaccaaggtgaccgtgctc

SEQ ID NO: 10364 - RNA, 333 nt, synthetic construct
  misc_feature 1..333: note = derived and/or modified sequence opt1 from anti-HIV_048-067180_VR-Chain
  source 1..333: mol_type = other RNA
cagagcgtgctgacccagcccccgtccgtcagcgccgcccccggccagaaggtgaccatctcctgcagcgggtccagccccaacatcggcaacaactacgtgtcctggtaccagcgcctccccgggacggcgccgaagctgctgatctacgagaacgaccagcggcccagcggcatccccgaccgcatctccgggagcaagtccggcaccagcgccaccctcggcatcaccgggctgcagacgggcgacgaggccgactactactgcgggacctgggacacctccctgagcaccggcggggtcttcggcacgggcaccaaggtgaccgtgctc

SEQ ID NO: 10365 - RNA, 333 nt, synthetic construct
  misc_feature 1..333: note = derived and/or modified sequence opt1 from anti-HIV_048-063017_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcaccaccccgggaaggcgcccaagctcatgatctacgaggtctccaagcgcccgagcggcatccccgaccggttctccgggagcaagtccggcacgagcgccaccctgggcatcaccgggctgcagaccggcgacgaggccgactactactgcgggacgtgggacacctccctcaaccgcggcggggtgttcggcaccggcaccaaggtgacggtcctg

SEQ ID NO: 10366 - RNA, 333 nt, synthetic construct
  misc_feature 1..333: note = derived and/or modified sequence opt1 from anti-HIV_048-061885_VR-Chain
  source 1..333: mol_type = other RNA
cagagcgtgctgacccagcccccgtccgtcagcgcggcccccggccagaaggtgaccatctcctgcagcgggtccagctccaacatcggcagccactacatctcctggtaccagcagttccccggggcggcccccaagctcctgatctacgagaacgacaagcgcccgagcggcatccccgaccggttctccgccagcaagtccgggacgagcgccaccctgggcatcaccggcctccagaccggggacgaggccgactactactgcggcacgtgggacacctccctgagcgccgggggcgtgttcgggaccggcaccaaggtcacggtgctg

SEQ ID NO: 10367 - RNA, 333 nt, synthetic construct
  misc_feature 1..333: note = derived and/or modified sequence opt1 from anti-HIV_048-061671_VR-Chain
  source 1..333: mol_type = other RNA
cagagcgtgctgacccagcccccgtccgccagcggcacccccgggcagcgcgtcacgatctcctgcagcggctcccggagcaacatcgggtccaactacgtgtactggtaccagcagttccccggcaccgcccccaagctcctgatctacgagaacaacaagcgcccgagcgggatccccgaccggttctccggcagcaagtccggcaccagcgcgaccctggggatcacgggcctccagaccggggacgaggccgactactactgcgccacctgggacacctccctgagcgccggcggggtgttcggcacgggcaccaaggtcaccgtgctg

SEQ ID NO: 10368 - RNA, 333 nt, synthetic construct
  misc_feature 1..333: note = derived and/or modified sequence opt1 from anti-HIV_048-060700_VR-Chain
  source 1..333: mol_type = other RNA
cagagcgtgctgacccagctcccctccctgagcgccgccccgggccagaaggtcaccatctcctgcagcgggtccagctccaacatcggcaacaactacgtgagctggtaccagcagctgcccgggacggcgcccaagctcctgatctacgagaacaacaagcgcccctccggcatcccggaccggttcagcgggtccaagagcggcacctccgccaccctgggcatcaccgggctccagacgggcgacgaggccgagtactactgcgccacctgggacgccagcctgtccgggggcggggtgttcggcaccggcaccaaggtcacggtgctg

SEQ ID NO: 10369 - RNA, 333 nt, synthetic construct
  misc_feature 1..333: note = derived and/or modified sequence opt1 from anti-HIV_048-060592_VR-Chain
  source 1..333: mol_type = other RNA
cagagcgtgctgacccagcccccgtccgtcagcgcggcccccggccagaaggtgaccatctcctgcagcgggtccagctccaacatcggcaagaactacgtgagctggtaccagcagttccccgggacggcgcccaagctcctgatctacgagaacaacaagcgcccgtccggcatccccgaccggttcagcgcctccaagagcgccacctccgccaccctggtcatcaccgggctccagacgggcgacgaggccgtgtactactgcggcacctgggacaccagcctgtccgccgggggcgtgttcgggagcggcaccaaggtcacggtgctg

SEQ ID NO: 10370 - RNA, 333 nt, synthetic construct
  misc_feature 1..333: note = derived and/or modified sequence opt1 from anti-HIV_048-060300_VR-Chain
  source 1..333: mol_type = other RNA
cagcccgtgctgacccagccgcccagcgcctccggcacccccgggcagcgcgtcacgatcagctgctccggcagctccagcaacatcgggaccaacaccgtgaactggtaccagcagttccccggcaccgccccgaagctcctgatctacaagaacaacgagcggccctccgggatccccgaccgcttcagcggctccaagagcggcacgtccgcgaccctggggatcaccggcctccagaccggggacgaggccgactactactgcggcacgtgggacaccagcctgtccgggggcggcgtgttcgggaccggcaccaaggtcacggtgctg

SEQ ID NO: 10371 - RNA, 333 nt, synthetic construct
  misc_feature 1..333: note = derived and/or modified sequence opt1 from anti-HIV_048-059141_VR-Chain
  source 1..333: mol_type = other RNA
cagcccgtgctgacccagccgcccagcgcctccggcacccccgggcagcgcgtcagcatctcctgcagcggcaacttctccaacatcgggagcaagtacgtgtactggtaccagcagatccccggcacggccccgaacgtgatcatctaccggaccaacctccgcccctccgggatccccgaccggttcagcgcgtccaagagcggcacctccgccaccctgggcatcacggggctgcagaccggcgacgaggccgactactactgcgggacctgggacaccagcctctccgccggcggggtcttcggcacgggcaccaaggtgaccgtgctg

SEQ ID NO: 10372 - RNA, 333 nt, synthetic construct
  misc_feature 1..333: note = derived and/or modified sequence opt1 from anti-HIV_048-057777_VR-Chain
  source 1..333: mol_type = other RNA
cagagcgtgctgacccagcccccgtccctcagcgcggcccccggccagcgcgtcaccatctcctgcagcgggtccagctccaacatcggcaacaactacgtgagctggtaccagcagttccccgggacggcgcccaccctgctgatctacgagaacgacaagcggccgtccggcatccccgaccgcttcagcgcctccaagagcgggacctccgccaccctcggcatcacgggcctgcaggccggggacgaggccgactactactgcggcacctgggacaccagcctgtccgccgggggcgtgttcgggaccggcacgaaggtcaccgtgctc

SEQ ID NO: 10373 - RNA, 333 nt, synthetic construct
  misc_feature 1..333: note = derived and/or modified sequence opt1 from anti-HIV_048-056928_VR-Chain
  source 1..333: mol_type = other RNA
cagagcgtgctgacccagcccccgtccgtcagcgccgcccccggccagaaggtgaccatctcctgcagcgggtccagctccacgatcggcaacaactacgtgagctggtaccagctcctgcccgggaccgcgcccaagctgctcatctacgacaacgacaaccgcccgtccgacatccccgaccggttcagcggctccaagagcgggacctccgccaccctgggcatcacgggcctgcagaccggggacgaggccgactactactgcggcgcctgggacaccagcctctccgccgggggcgtcttcgggaccggcacgaaggtgaccgtgctg

SEQ ID NO: 10374 - RNA, 333 nt, synthetic construct
  misc_feature 1..333: note = derived and/or modified sequence opt1 from anti-HIV_048-056131_VR-Chain
  source 1..333: mol_type = other RNA
cagttcgtgctgacccagcccgccagcgtctccggcagcccggggcagtccatcaccatcagctgctccggcacgagctccgacgtggggtacaactacgtgagctggtaccagcagctccccggcaccgcccccaagctgctgatctacgagaacaccaagcgcccctccgggatcccggaccggttcagcggctccaagagcggcacctccgcgacgctcgggatcaccggcctgcagaccggggacgaggccgactactactgcggcacctgggacacgagcctgtccgccgggggcgtcttcggcagcgggaccaaggtgaccgtgctc

SEQ ID NO: 10375 - RNA, 333 nt, synthetic construct
  misc_feature 1..333: note = derived and/or modified sequence opt1 from anti-HIV_048-055864_VR-Chain
  source 1..333: mol_type = other RNA
cagagcgtgctgacccagcccccgtccgtcagcgtggcccccggccagaaggtgaccatctactgctccgggagctccagcaacatcggcaagaactccgtcagctggtacgtccaggtgcccgggacggcccccaagttcctcatctacgagaacaaccagcgcccgtccggcatcagcgaccggttctccgggagcaagtccggcaccagcgcgaccctgggcatctccgggctgcagaccggcgacgaggccgactactactgcgggacgtgggacaccagcctctccggcgggggcgtgttcggcaccgggaccaaggtgacggtgctg

SEQ ID NO: 10376 - RNA, 333 nt, synthetic construct
  misc_feature 1..333: note = derived and/or modified sequence opt1 from anti-HIV_048-055094_VR-Chain
  source 1..333: mol_type = other RNA
cagagcgtgctgacccagcccccgtccgtcagcggcgcccccgggcagcgcgtgaccatctcctgcagcgcctccagctccagcatcggcaacgacttcgtgtcctggtaccagcagctccccgggacggcgcccaagctgctgatcagcgagaacaacaagcggccgtccggcatccccgaccgcttcagcgggtccaagagcggcacctccgccaccctcggcatcaccgggctgcagacgggcgacgaggccgactactactgcgggacctgggacagctccctgagcgccggcggggtcttcggcaccggcaccaaggtgacggtgctc

SEQ ID NO: 10377 - RNA, 333 nt, synthetic construct
  misc_feature 1..333: note = derived and/or modified sequence opt1 from anti-HIV_048-054343_VR-Chain
  source 1..333: mol_type = other RNA
cagagcgtgctgacccagcccccgtccgtcagcggcgcccccgggcagcgcgtgaccatctcctgcacgggcagctccagcaacatcgggggctacgacgtgaactggtaccagcagctccccgggaccgcccccaagctgctgatcttcaagaacaacgagcggccgtccggcatccccgaccgcttcagcggctccaagagcgggacctccgcgaccctcggcatcacggggctgcagaccggcgacgaggccgactactactgcgggacctgggacaccagcctgtccgccggcggcgtcttcgggacgggcaccaaggtgaccgtgctc

SEQ ID NO: 10378 - RNA, 333 nt, synthetic construct
  misc_feature 1..333: note = derived and/or modified sequence opt1 from anti-HIV_048-054193_VR-Chain
  source 1..333: mol_type = other RNA
cagagcgtgctgacccagcccccgtccgtcagcgccgcccccggccagaaggtgaccatctcctgcagcgggggctccagcaacatcgggaacaactacgtgtcctggtaccaccaggtccccggcacggcgcccaagctcctgatcttcgagaacaacaagcgcccgagcgggatccccgaccggttctccggcagcaagtccggcaccagcgccaccctggggatcaccggcctccagacgggggacgaggccgactactactgcggcacctgggacacctccctgagcgggggcggcgtgttcgggaccggcacgaaggtgaccgtcctg

SEQ ID NO: 10379 - RNA, 333 nt, synthetic construct
  misc_feature 1..333: note = derived and/or modified sequence opt1 from anti-HIV_048-052521_VR-Chain
  source 1..333: mol_type = other RNA
cagagcgtgctgacccagcccccgtccgtcagcgccgcccccggccagaaggtgaccatctcctgcagcgggtccagctccaacatcggccgccacagcgtgtcctggtaccagcagctccccgggacggcgcccaagctgctgatctacgacaccgacaagcggccgagcggcatccccgaccgcttctccgggagcaagtccggcaccagcgccaccctcggcatcacggggctgcagaccggcgacgaggccgactactactgcgggacctgggacacctccctgagcggcgggggcgtcttcggcacggggaccaaggtgaccgtgctc

SEQ ID NO: 10380 - RNA, 333 nt, synthetic construct
  misc_feature 1..333: note = derived and/or modified sequence opt1 from anti-HIV_048-049037_VR-Chain
  source 1..333: mol_type = other RNA
cagagcgtgctgacccagcccccgtccgtcagcgcggcccccggccagaaggtgaccatctcctgcagcgggtccagcttcaacatcggcaacaactacgtgtcctggtaccagcacctccccgggacggcgcccaagctgctgatctacgccgccgtcacccgcccgagcggcatccccgaccggttctccgggagcaagtccggcaccagcgccaccctcgacatcacgggcctgcagaccggggacgaggccgactactactgcggcacctgggacacctccctgagcgccgggggcgtgttcgggacgggcaccaaggtgaccgtcctc

SEQ ID NO: 10381 - RNA, 333 nt, synthetic construct
  misc_feature 1..333: note = derived and/or modified sequence opt1 from anti-HIV_048-048720_VR-Chain
  source 1..333: mol_type = other RNA
cagagcgtgctgacccagcccccggccgtctccgccgcccccggccagcgcgtggccatcagctgctccgggaccagctccaacatcggcagcaacctcgtgtcctggtaccagcagctgcccgggaaggcgccccggctgctcatctacgacaactacaagcgcccgagcggcatccccgaccggttctccgggagcaagtccggcacgagcgccaccctgggcatcaccgggctgcagaccggcgacgaggccgactactactgcgggacgtgggacacctccctcagcaccggcggggtcttcggcaccggcacgaaggtgaccgtgctg

SEQ ID NO: 10382 - RNA, 333 nt, synthetic construct
  misc_feature 1..333: note = derived and/or modified sequence opt1 from anti-HIV_048-048542_VR-Chain
  source 1..333: mol_type = other RNA
cagagcgtgctgacccagcccccgtccgtcagcgcggcccccggccagaaggtgaccatctcctgcagcgggtccagctccaacatcggcaacaacttcgtgagctggtaccagcagctccccgggacggcgcccaagctgctgatctacaacaacgaccgccggccgtccggcgtccccgaccgcttcagcgcctccaagttcgggaccgccgccaccctcggcatcaccggcctgcagacgggggacgaggccgactactactgcggcacctgggacagctccctgagcgccgggggcgtgttcgggaccggcaccaaggtgacggtcctc

SEQ ID NO: 10383 - RNA, 333 nt, synthetic construct
  misc_feature 1..333: note = derived and/or modified sequence opt1 from anti-HIV_048-047777_VR-Chain
  source 1..333: mol_type = other RNA
cagagcgtgctgacccagcccccgtccgccagcggcacccccgggcagcgcgtcacgatctcctgcagcggctccagcgccaacatcgggaccaactacgtgttctggtaccagcacctccccggcaccgcgcccaagctgctgatctacgagaacaacaagcggccgtccgggatccccgaccgcttcagcggctccaagagcggcacctccgccacgctcgggatcaccggcctgcagaccggggacgaggccgactactactgcggcacctgggacagctccctgagcgccgggggcgtgttcggcacggggaccaaggtcaccgtgctc

SEQ ID NO: 10384 - RNA, 333 nt, synthetic construct
  misc_feature 1..333: note = derived and/or modified sequence opt1 from anti-HIV_048-046841_VR-Chain
  source 1..333: mol_type = other RNA
cagagcgtgctgacccagcccccgtccgtcagcgcggccctcggccagaaggtgaccatcacgtgctccggggacaacggcaacatcgggtaccactacgtgagctggtaccagcaggtcggccgcgcggcccccaagctgctgatctacgccaacaacaagcggccctccgggatccccgaccgcttcagcggctccaagagcggcacctccgccaccctcgggatcaccggcctgcagacgggggacgaggccgactactactgcggcacctgggacaccagcctgtccgccgggggcgtgttcggcagcgggaccaaggtgacggtcctc

SEQ ID NO: 10385 - RNA, 333 nt, synthetic construct
  misc_feature 1..333: note = derived and/or modified sequence opt1 from anti-HIV_048-046202_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcacctccccgggacggcgcccaagctgctgatctacgacacctacaagcgccactccggcgtcccggaccggttcagcaactccaagagcgggacctccgccaccctcgccatcacgggcctgcagaccggcgacgagggggactactactgcggcgcctgggacaccagcctgtccgccgggggcgtgttcgggaccggcacgaaggtgaccgtcctc

SEQ ID NO: 10386 - RNA, 333 nt, synthetic construct
  misc_feature 1..333: note = derived and/or modified sequence opt1 from anti-HIV_048-046059_VR-Chain
  source 1..333: mol_type = other RNA
cagagcgtgctgacccagcccccgtccgtcagcgccgcccccggccagaacgtgaccatctcctgcagcgggacgtccagcaacatcgagaacaactacgtgtcctggtaccagaccctccccggcaccgcgcccaagctgctgatctacgacaacaacaagcgcccgagcgggatccccgaccggttctccggcagcaagtccgggaccagcgccacgctcggcatcaccggcctgcagaccggggacgaggccgactactactgcggcacctgggactccagcctgtccgccgggggcgtcttcgggacgggcaccaaggtgaccgtgctc

SEQ ID NO: 10387 - RNA, 333 nt, synthetic construct
  misc_feature 1..333: note = derived and/or modified sequence opt1 from anti-HIV_048-043568_VR-Chain
  source 1..333: mol_type = other RNA
cagagcgtgctgacccagcccccgtccgtcagcgccgcccccggccagaaggtgaccatctcctgcagcgggtccgacagcaacatcggctccaactacgtgagctggtaccagcagctccccggggcggcccccaagctgctgatctacaagaacaacaaccgcccgtccggcatccccgaccggttcagcgggtccaagagcggcacgtccgccaccctcggcatcagcgggctgcagaccggcgacgaggccgactactactgcgggacctgggacacgtccctgagcggcgggggcgtcttcggcaccgggaccaaggtgaccgtgctc

SEQ ID NO: 10388 - RNA, 333 nt, synthetic construct
  misc_feature 1..333: note = derived and/or modified sequence opt1 from anti-HIV_048-042713_VR-Chain
  source 1..333: mol_type = other RNA
cagagcgtgctgacccagcccccgtccgtcagcgccgcccccggccagaaggtgaccatctcctgcagcgggtccagctccaacatcggccgccactacgtgagctggtaccagcagctccccgggacggcgcccaagctgctgatctacgacaacaactcccggccgagcggcatccccgaccgcttctccgggagcaagtccggcaccagcgccaccctcggcatcaccgggctgcagacgggcgacgaggccgactactactgcgggacctgggacacctccctgaaccggggcggggtcttcggcaccggcacgaaggtgaccgtgctc

SEQ ID NO: 10389 - RNA, 333 nt, synthetic construct
  misc_feature 1..333: note = derived and/or modified sequence opt1 from anti-HIV_048-042440_VR-Chain
  source 1..333: mol_type = other RNA
cagagcgtgctgacccagcccccgtccgccagcggcacccccgggcagcgcgtcacgatctcctgcagcggctccagctccaacatcgggaccaacaccgtgaactggtaccagcagctccccggcaccgcccccaagctgctgatctacgagaacagcaagcggccgtccgggatccccgaccgcttcagcggctccaagagcggcacgtccgcgaccctcgggatcaccggcctgcagaccggggacgaggccgactactactgcggcacgtgggacaccagcctgtccgccgggggcgtgttcggcagcgggaccaaggtcaccgtgctc

SEQ ID NO: 10390 - RNA, 333 nt, synthetic construct
  misc_feature 1..333: note = derived and/or modified sequence opt1 from anti-HIV_048-040511_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcacctccccgggacggcgcccaagctgctgatctacgagaacaacaagcgctccagcggcatcccggagcggttctccgggagccagtccggcaccagcgccaccctcggcatcaccgggctgcagacgggcgacgaggccgactactactgcgggacctgggacacctccctgagcaccggcggggtcttcggcacgggcaccaaggtgaccgtgctc

SEQ ID NO: 10391 - RNA, 333 nt, synthetic construct
  misc_feature 1..333: note = derived and/or modified sequence opt1 from anti-HIV_048-039195_VR-Chain
  source 1..333: mol_type = other RNA
cagagcgtgctgacccagcccccgtccgtcagcgccgcccccggccagcgcgtgaccatctcctgcagcgggtccacgagcaacatcggcaaccactacgtgtcctggtaccagcagctccccgggaccgcgcccaagctgctgatctacgacaacggcaaccggccgagcgggatccccgaccgcttctccggcagcaagtccggcaccagcgccaccctcgacatcacggggctgcagaccggcgacgaggccgactactactgcgggacctgggacacctccctgaaccggggcggggtcttcggcacgggcaccaaggtgaccgtgctc

SEQ ID NO: 10392 - RNA, 333 nt, synthetic construct
  misc_feature 1..333: note = derived and/or modified sequence opt1 from anti-HIV_048-036935_VR-Chain
  source 1..333: mol_type = other RNA
cagagcgtgctgacccagcccccgtccatgagcgccgcccccggcgagcgcgtcaccatctcctgcacggggagctccagcaacatcggcgggtacgacgtgcactggtaccagcagctccccggcatcgcgcccaagatcctgatctaccggaactccatccgcccgagcgggatccccgaccggttctccggcagcaagtccggcaccagcgccaccctggggatcaccggcctccagacgggggacgaggccgactactactgcggcacctgggacacctccctgagcaccgggggcgtgttcggcacggggaccaaggtcaccgtgctg

SEQ ID NO: 10393 - RNA, 333 nt, synthetic construct
  misc_feature 1..333: note = derived and/or modified sequence opt1 from anti-HIV_048-034478_VR-Chain
  source 1..333: mol_type = other RNA
cagagcgtgctgacccagcccccgtccgtcagcgccgcccccggccagaaggtgaccatctcctgcacggggagcggctccaacatcgggaacaacgacgtgagctggtaccagcagctccccggcaccgcgccccgcctgctgatctacggggacaacaagcggccgtccggcatccccgaccgcttcagcggctccaagagcgggacctccgccaccctcggcatcacggggctgcagaccggcgacgaggccgactactactgcgggacctgggacaccagcctgtccgccggcggcgtcttcgggacgggcaccaaggtgaccgtgctc

SEQ ID NO: 10394 - RNA, 333 nt, synthetic construct
  misc_feature 1..333: note = derived and/or modified sequence opt1 from anti-HIV_048-031641_VR-Chain
  source 1..333: mol_type = other RNA
cagagcgtgctgacccagcccccgtccgtcagcgccgcccccggccagaaggtgaccatctcctgcagcgggaacaactccaacatcggcaacaactacgtgagctggtaccagcagctccccgggacggcgcccaagctgctgatctacgagaactccaagcgcccgagcggcatccccgaccggttctccgggagcaagtccggcaccagcgccaccctcggcatcaccgggctgcagacgggcgacgaggccgactactactgcgggacctgggacacctccctgagcgccggcggggtcttcggctccggcaccaaggtgacggtgctc

SEQ ID NO: 10395 - RNA, 333 nt, synthetic construct
  misc_feature 1..333: note = derived and/or modified sequence opt1 from anti-HIV_048-029760_VR-Chain
  source 1..333: mol_type = other RNA
cagagcgccctgacccagcccgcctccgtgagcggctccagcgggcagtccatcaccatcagctgcacgggcaccaactccgacgtcgggtacgactacgtgtgctggtaccagcagctcccgggcaccgcgcccaagctgctgatctacgagaacaacaagcgccccagcgggatccccgaccggttctccggcagcaagtccggcaccagcgccacgctcgggatcaccggcctgcagaccggggacgaggccgactactactgcggcacctgggacacgtccctgagcgccgggggcgtgttcggcaccgggaccaaggtcaccgtgctc

SEQ ID NO: 10396 - RNA, 333 nt, synthetic construct
  misc_feature 1..333: note = derived and/or modified sequence opt1 from anti-HIV_048-027970_VR-Chain
  source 1..333: mol_type = other RNA
cagagcgtgctgacccagcccccgtccgtcagcgccccgcccggccagaaggtgaccatctcctgcagcgggacgacctccaacatcggcagcaactacgtggcctggtaccagcagttccccgggaccgcgcccaagctcctgatctacgagaacaacaagcgcccctccggcatccccgaccggttcagcgggtccaagagcggcacctccgccacgctgggcatcaccgggctccagaccggcgacgaggccgactactactgcgccacctgggacacgagcctgtccgccgggggcgtcttcgggaccggcaccaaggtgaccgtgctg

SEQ ID NO: 10397 - RNA, 333 nt, synthetic construct
  misc_feature 1..333: note = derived and/or modified sequence opt1 from anti-HIV_048-027337_VR-Chain
  source 1..333: mol_type = other RNA
cagagcgtgctgacccagcccccgtccgtcagcgccgcccccggccagaaggtgaccatctcctgcagcgggtcctacagcaacatcggcaacaactacctctcctggtaccagcagctgcccgggacggcgcccaagctgctcatctacaagaacaacaagcgcccgagcggcgtgcccgaccggttctccgggagcaagtccggcgccagcgccaccctggacatcaccggcctgcagaccggggacgaggccgactactactgcggcatctgggacacgtccctcagcgccgggggcgtcttcgggaccggcaccaaggtgaccgtgctg

SEQ ID NO: 10398 - RNA, 333 nt, synthetic construct
  misc_feature 1..333: note = derived and/or modified sequence opt1 from anti-HIV_048-027217_VR-Chain
  source 1..333: mol_type = other RNA
cagagcgtgctgacccagcccccgtccgtcagcgccgcccccggccagaaggtgaccatctcctgcagcgggtccagctccatcatcggcaacaactacgtgagctggtaccagcagctccccgggacggcgcccaagctgctgatctacgagaacaacaagcgcccgtccggcatccccgaccggttcagcgggtccaagagcggcacctccgccaccctcgccatcgccggcctgcagaccggggacgaggccgactactactgcgcgacgtgggacaccagcctgtccgccggcggggtcttcggcaccgggaccaaggtgacggtgctc

SEQ ID NO: 10399 - RNA, 333 nt, synthetic construct
  misc_feature 1..333: note = derived and/or modified sequence opt1 from anti-HIV_048-026760_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcacctccccgggacggcgcccaagctgctgatctacgacaccgtcaagcgccactccggcgtgccggaccggttcagcgggtccaagagcggcacctccgccaccctcggcatcagcgggctgcagacgggcgacgaggccgactactactgcgggacctgggacacctccctgagcgccggcggggtgttcggctccggcaccaaggtcacggtgctc

SEQ ID NO: 10400 - RNA, 333 nt, synthetic construct
  misc_feature 1..333: note = derived and/or modified sequence opt1 from anti-HIV_048-024800_VR-Chain
  source 1..333: mol_type = other RNA
cagagcgtgctgacccagcccccgtccgtcagcgccgcccccggccagaaggtgaccatctcctgcagcgggtcctacagcaacatcggcaacaactacgtgtcctggtaccaggtcctccccgggacggcgcccaagctgctgatctacaagaacaacgagcgcccgagcggcatccccgaccggttctccgggagcaagtccggcaccagcgccaccctcggcatcaccgggctgcagacgggcgacgaggccgactactactgcgggacctgggacacctccctgagcgccggcggggtgttcggcaccggcacgaaggtgaccgtcctc

SEQ ID NO: 10401 - RNA, 333 nt, synthetic construct
  misc_feature 1..333: note = derived and/or modified sequence opt1 from anti-HIV_048-024313_VR-Chain
  source 1..333: mol_type = other RNA
cagagcgtgctgacccagcccccgtccgtcagcgccgcccccggccagaaggtgaccatctcctgcagcgggtccagctccacgatcggcaacagccacgtgtcctggtaccagatcctccccgggaccgcgcccaagctgctgatctacaaggacgacaagcgcccgagcggcatccccgaccggttctccgggagcaagtccggcaccagcgccaccctcggcatcacggggctgcagaccggcgacgaggccgactactactgcgggacctgggacacctccctgaaccgcggcggggtcttcggcacgggcaccaaggtgaccgtgctc

SEQ ID NO: 10402 - RNA, 333 nt, synthetic construct
  misc_feature 1..333: note = derived and/or modified sequence opt1 from anti-HIV_048-021748_VR-Chain
  source 1..333: mol_type = other RNA
cagagcgtgctgacccagcccccgtccgtcagcgccgcccccggccagcgcgtgaccatctcctgcagcgggtccacgagcaacatcggcaacaactacgtgtcctggtaccagcagctccccgggaccgcgcccaagctgctgatctacgagaacaacaagcggccgagcggcatccccgaccgcttctccgggagcaagtccggcaccagcgccaccctcggcatctccgggctgcagacgggcgacgaggccgactactactgcgggacctgggacagctccctgagcggcgggggcgtcttcggcaccgggaccaaggtgacggtgctc

SEQ ID NO: 10403 - RNA, 333 nt, synthetic construct
  misc_feature 1..333: note = derived and/or modified sequence opt1 from anti-HIV_048-020991_VR-Chain
  source 1..333: mol_type = other RNA
cagagcgtgctgacccagcccccgtccgccagcggcacccccgggcagaaggtcacgatctcctgcagcggctccagctccaccatcgggaacaactacgtgagctggtaccaggtgctccccggcaccgcccccaagctgctgatctacaagaacgacaagcgcccgtccgggatccccgaccggttcagcggctccaagagcggcacctccgcgacgctcgggatcaccggcctgcagaccggggacgaggccgactactactgcggcacctgggacacgagcctgtccaccgggggcgtcttcggcaccgggaccaaggtgacggtgctc

SEQ ID NO: 10404 - RNA, 333 nt, synthetic construct
  misc_feature 1..333: note = derived and/or modified sequence opt1 from anti-HIV_048-020340_VR-Chain
  source 1..333: mol_type = other RNA
cagagcgtgctgacccagcccccgtccgtcagcgccgcccccggccagcgcgtgaccatctcctgcagcgggtccagctccaacgtgggcaacaactacgtcagctggtaccagcagctccccgggacggcgcccaagctgctgatctacgagaacaacaagcggccgtccggcatccccgaccgcttcagcgggtccaagagcggcacctccgccaccctcggcatcaccgggctgcagacgggcgacgaggccgactactactgcgggacctgggacgccagcctgtccgccggcggggtgttcggcaccggcaccaaggtgacggtcctc

SEQ ID NO: 10405 - RNA, 333 nt, synthetic construct
  misc_feature 1..333: note = derived and/or modified sequence opt1 from anti-HIV_048-019993_VR-Chain
  source 1..333: mol_type = other RNA
cagagcgtgctgacccagcccccgtccgtcagcggcgcccccgggcagcgcgtgaccatctcctgcacgggcagctccagctccatcgggggcttcgacgtgcactggtaccagcggctccccgggaccgcgccccgcctgctgatctacgagaacaacaagcggccgagcggcatccccgaccgcttctccggcagcaagtccgggaccagcgccaccctcggcatcacggggctgcagaccggcgacgaggccgactactactgcgggacctgggactccagcctgtccgccggcggcgtcttcgggaccggcacgaaggtgaccgtgctc

SEQ ID NO: 10406 - RNA, 333 nt, synthetic construct
  misc_feature 1..333: note = derived and/or modified sequence opt1 from anti-HIV_048-019947_VR-Chain
  source 1..333: mol_type = other RNA
cagagcgtgctgacccagcccccgtccgtcagcgccgcccccggccagcgcgtgaccatctcctgcagcgggtccagctccaacatcggcagcaagtacgtgtcctggtaccagcagctccccgggacggcgcccaagctgctgatctacgagaacagcaagcggccgtccggcatccccgaccgcttcagcgggtccaagagcggcacctccgccaccctcggcatcaccgggctgcagacgggcgacgaggccgactactactgcgggacctgggacaccagcctgtccaccggcggggtcttcggcacgggcaccaaggtgaccgtgctc

SEQ ID NO: 10407 - RNA, 333 nt, synthetic construct
  misc_feature 1..333: note = derived and/or modified sequence opt1 from anti-HIV_048-017871_VR-Chain
  source 1..333: mol_type = other RNA
cagagcgtgctgacccagcccccgtccgtcagcgccgcccccggccagaaggtgaccatctcctgcagcgggtccagctccaacatcggcaaccgctacgtgagctggtaccagcagctccccgggacggcgcccaagctgctgatctacaagaacaacaagcggccgtccggcatccccgaccgcttcagcgggtccaagagcggcacctccgccaccctcggcatcaccgggctgcagacgggcgacgaggccgactactactgcgggacctgggacggcagcctgtccaccgggggcgtcatcggcaccgggacgaaggtgaccgtgctc

SEQ ID NO: 10408 - RNA, 333 nt, synthetic construct
  misc_feature 1..333: note = derived and/or modified sequence opt1 from anti-HIV_048-015931_VR-Chain
  source 1..333: mol_type = other RNA
cagagcgtgctgacccagcccccgtccgtcagcgccgcccccggccagaaggtgaccatctcctgcagcgggggctccagcaacatcgggtccacgtacgtgagctggtaccagcaggtccccggcaccgcgcccaagctcctgatctacgagaacaacaagcgcccgtccgggatccccgaccggttcagcggctccaagagcggcacctccgccaccctggacatcacggggctccagaccggcgacgaggccgactactactgcgggacctgggacaccagcctgtccggcgggggcgtgttcggcacggggaccaaggtgaccgtcctg

SEQ ID NO: 10409 - RNA, 333 nt, synthetic construct
  misc_feature 1..333: note = derived and/or modified sequence opt1 from anti-HIV_048-015920_VR-Chain
  source 1..333: mol_type = other RNA
cagagcctgctcacccagcccccgtccgtgagcgccgcccccggccagaaggtcaccatctcctgcagcgggtccagctccacgatcggcaacaactacgtgagctggtaccaggtgctgcccgggaccgcgcccaagctgctcatctacaagaacaacgagcgcccgtccggcatccccgaccggttcagcgggtccaagagcggcacctccgccaccctgggcatcacggggctgcagaccggcgacgaggccgagtactactgcgccacctgggacgccagcctctccgggggcggggtcttcggcaccggcacgaaggtgaccgtgctg

SEQ ID NO: 10410 - RNA, 333 nt, synthetic construct
  misc_feature 1..333: note = derived and/or modified sequence opt1 from anti-HIV_048-013898_VR-Chain
  source 1..333: mol_type = other RNA
cagagcgtgctgacccagcccccgtccgtcagcgccgcccccggccagaaggtgaccatctcctgcagcgggtccagctccaacatcggcaagcacagcgtgtcctggtaccagcagctccccgggacggcgcccgagctgctgatctacgacaacaacaaccgcccgagcggcatccccgaccggttctccgggagcaagtccggcaccagcgccaccctcggcatcaccgggctgcagacgggcgacgaggccgactactactgcgggacctgggacacctccctgagcgccggcggggtcttcggcaccggcacgaaggtgaccgtgctc

SEQ ID NO: 10411 - RNA, 333 nt, synthetic construct
  misc_feature 1..333: note = derived and/or modified sequence opt1 from anti-HIV_048-013429_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaccctgctgatctacgagaacgacaagcgcccgtccggcatccccgaccggttcagcgggtccaagagcggcacctccgccaccctcggcatcacggggctgcagaccggcgacgaggccgactactactgcgggacctgggacagctccctgagcgccggcggggtcttcggcaccggcacgaaggtgaccgtgctc

SEQ ID NO: 10412 - RNA, 333 nt, synthetic construct
  misc_feature 1..333: note = derived and/or modified sequence opt1 from anti-HIV_048-012358_VR-Chain
  source 1..333: mol_type = other RNA
cagagcgtgctgacccagcccccgtccgtcagcgccgcccccggccagaaggtgaccatctcctgcagcgggtccaacagcgcgatcggcaacaactacgtgtcctggtaccaggtcctccccgggacggcccccaagctgctgatctacaagaacaacgagcgcccgagcggcatccccgaccggttctccgggagcaagtccggcaccagcgccaccctcgacatcaccggcctgcagacgggggacgaggccgactactactgcggcacctgggacacctccctgagcgccgggggcgtgttcgggaccggcacgaaggtgaccgtcctc

SEQ ID NO: 10413 - RNA, 333 nt, synthetic construct
  misc_feature 1..333: note = derived and/or modified sequence opt1 from anti-HIV_048-011158_VR-Chain
  source 1..333: mol_type = other RNA
cagagcgtgctgacccagcccccgtccgtcagcgccgcccccggccagaaggtgaccatctcctgcagcgggatctccagcaacatcggcaacaacgacgtgtcctggtaccagcagctccccgggacggcgcccaagctgctgatctacgacaacgacaagcgcccgagcggcatccccgaccggttctccgggagcaagtccggcaccagcgccaccctcggcatcaccgggctgcagacgggcgacgaggccgactactactgcgggacctgggactccagcctgtccgccggcggggtcttcggcaccggcaccaaggtgacggtgctc

SEQ ID NO: 10414 - RNA, 333 nt, synthetic construct
  misc_feature 1..333: note = derived and/or modified sequence opt1 from anti-HIV_048-010720_VR-Chain
  source 1..333: mol_type = other RNA
cagagcgtgctgacccagcccccgtccgtcagcgccgcccccggccagaaggtgaccatctcctgcagcgggtccagctccaacatcggcagccactacgtgtcctggtaccagcaggtccccgggacggcgccccgcctcgtgatctacgagaacagcaagcggccgtccggcatccccgaccgcttcagcgggtccaagagcggcacctccgccaccctgggcatcaccgggctgcagacgggcgacgaggccgactactactgcgggacctgggacaccagcctctccgccggcggggtgttcggcagcggcaccaaggtcacggtgctg

SEQ ID NO: 10415 - RNA, 333 nt, synthetic construct
  misc_feature 1..333: note = derived and/or modified sequence opt1 from anti-HIV_048-009445_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggtccccaagctgctgatctacgacacctacacccgcccgtccggcacccccgaccggttcagcgggtccaagagcggcacgtccgcgaccctcgccatcaccggcctgcagaccggggacgaggccgactactactgcggcacgtgggacgggagcctgtccaccggcggggtgatcggcaccggcaccaaggtgacggtcctc

SEQ ID NO: 10416 - RNA, 324 nt, synthetic construct
  misc_feature 1..324: note = derived and/or modified sequence opt1 from anti-HIV_048-006126_VR-Chain
  source 1..324: mol_type = other RNA
cagagcgtgctgacccagcccccgtccgtcagcggcgcccccgggcagaaggtgaccatctcctgcagcggcatctccagcaacttcgggatctcctggtaccagcaggtccccggcacggcccccaagctcctgatctacgagaacgacaagcgcccgagcgggatccccgaccggttctccggcagcaagtccggcaccagcgcgaccctggggatcaccggcctccagacgggggacgaggccgactactactgcggcacctgggacacctccctgagcgccgggggcgtgttcggcaccgggacgaaggtgaccgtgctg

SEQ ID NO: 10417 - RNA, 333 nt, synthetic construct
  misc_feature 1..333: note = derived and/or modified sequence opt1 from anti-HIV_048-005652_VR-Chain
  source 1..333: mol_type = other RNA
cagagcgtgctgacccagcccccgtccgtcagcgccgcccccggccagaaggtgaccatctcctgcagcgggtccaacagcgcgatcggcaacaactacgtgtcctggtaccaggtcctccccgggacggcccccaagctgctgatctacgacacctacaagcgcgccagcggcatcccggaccggttctccgggagcaagtccggcaccagcgccaccctcggcatcacggggctgcagaccggcgacgaggccgactactactgcgggacctgggacacctccctgagcggcgggggcgtgttcggcacggggaccaaggtgaccgtcctc

SEQ ID NO: 10418 - RNA, 333 nt, synthetic construct
  misc_feature 1..333: note = derived and/or modified sequence opt1 from anti-HIV_048-005532_VR-Chain
  source 1..333: mol_type = other RNA
cagagcgtgctgacccagcccccgtccgtcagcgccgcccccggccagaaggtgaccatctcctgcagcgggacgtccagcaacatcggcaacacctacgtgtcctggtaccagcagctccccgggaccgcgcccaactacctgatctacaagatcgacaagcgcccgagcggcatccccgaccggttctccgggagcaagtccggcaccagcgccacgctgggcatcaccgggctccagaccggcgacgaggccgactactactgcgggacctgggacacgtccctgagcgccggcggggtcttcggcaccggcaccaaggtgaccgtgctg

SEQ ID NO: 10419 - RNA, 333 nt, synthetic construct
  misc_feature 1..333: note = derived and/or modified sequence opt1 from anti-HIV_048-005189_VR-Chain
  source 1..333: mol_type = other RNA
cagagcgtgctgacccagcccccgtccgtcagcgccgcccccggccagaaggtgaccatctcctgcagcgggtccggcagcacgatcgggaacaacgacgtgtcctggtaccagcagctccccggcgcggcccccaagctgctgatctacgaggacaacaagcgcccgagcgggatccccgcccggttctccggcagcaagtccggcaccagcgccaccctccgcatcaccgggctgcagacgggcgacgaggccgactactactgcgggacctgggactccagcctgtccgcgggcggggtcttcggcaccggcacccgggtgagcgtgctc

SEQ ID NO: 10420 - RNA, 333 nt, synthetic construct
  misc_feature 1..333: note = derived and/or modified sequence opt1 from anti-HIV_048-005088_VR-Chain
  source 1..333: mol_type = other RNA
cagagcgtgctgacccagcccccgtccgtcagcgccgcccccggccagaaggtgaccatctcctgcagcgggtccagctccaacatcggcaagaactacgtgagctggtaccagcagctccccgggacggcgcccaagctgctgatctacgacaacaacaaccgcccgtccggcatccccgaccggttcagcgggtccaagagcggcacctccgccaccctcggcatcaccgggctgcagacgggcgacgaggccgactactactgcggggcctgggacaccagcctgtccgccggcggggtcttcggcaccggcaccaaggtgacggtgctc

SEQ ID NO: 10421 - RNA, 333 nt, synthetic construct
  misc_feature 1..333: note = derived and/or modified sequence opt1 from anti-HIV_048-004023_VR-Chain
  source 1..333: mol_type = other RNA
cagagcgtgctgacccagcccccgtccgtcagcgccacccccggccagaaggtgacgatctcctgcagcgggggctccagcaacatcgggaagaacgacgtgtcctggtaccagcagctccccggcaccgcccccaagctgctgatctacgacaccaacaagcgcccgagcgggatccccgaccggttctccgcggcccgcagcggcacctccgccacgctcgacatcaccggcctgcagaccggggacgaggccgactactactgcggcacctgggacacgagcctgtccgccgggggcgtcttcgggaccggcaccaaggtgaccgtgctc

SEQ ID NO: 10422 - RNA, 333 nt, synthetic construct
  misc_feature 1..333: note = derived and/or modified sequence opt1 from anti-HIV_048-001580_VR-Chain
  source 1..333: mol_type = other RNA
cagagcgtgctgacccagcccccgtccgtcagcgccgcccccggccagaaggtgaccatctcctgcagcgggtccagctccaacatcggcaacaactacgtgagctggtaccagcagctccccgggacggcgcccaagctgctgctctacgagaacaacaagcgcccgtccggcatccccgaccggttcagcgggtccaagagcggcacctccgccaccctggccatcaccggcctgcagacgggggacgaggccgcctactactgcggcacctgggacgggagcctctccaccggcggggtcatcggcaccggcacgaaggtgaccgtgctg

SEQ ID NO: 10423 - RNA, 333 nt, synthetic construct
  misc_feature 1..333: note = derived and/or modified sequence opt1 from anti-HIV_038-221120_VR-Chain
  source 1..333: mol_type = other RNA
cagagcgtgctgacccagcccccgtccgtcagcgccgcccccggccagaaggtgaccatctcctgcagcgggtccacgagcaacatcggcaagaactacgtgtcctggtaccagcagctccccgggaccgcgcccaagctgctgatctacgacaacaacgagcgcccgagcggcatccccgaccggttctccgggagcaagtccggcaccagcgccaccctcggcatcacggggctgcagaccggcgacgaggccgactactactgcgccacctgggactccagcctgtccgggggcggggtcttcggcaccggcacgcgcgtgaccgtgctc

SEQ ID NO: 10424 - RNA, 333 nt, synthetic construct
  misc_feature 1..333: note = derived and/or modified sequence opt1 from anti-HIV_038-197677_VR-Chain
  source 1..333: mol_type = other RNA
cagagcgtgctgacccagcccccgtccgtcagcgccgcccccggccagaaggtgaccgtgtcctgcagcgggtccaacagcaacatcggcaaccactacgtctcctggtaccagcagctccccgggacggcgcccaagctgctgatctacgacaacaacaagcgcccgagcggcatccccgaccggttctccgggagcaagtccggcaccagcgccaccctcggcatcaccgggctgcagacgggcgacgaggccgactactactgcgggacctgggactccagcctgtccgccggcggggtgttcggcaccggcaccaaggtgacggtcctc

SEQ ID NO: 10425 - RNA, 333 nt, synthetic construct
  misc_feature 1..333: note = derived and/or modified sequence opt1 from anti-HIV_038-196765_VR-Chain
  source 1..333: mol_type = other RNA
cagagcgccctgacccagcccgcctccgtgagcggctccccggggcagagcatcaccatctcctgcacgggcaccagcggggacgtcggctacaacctcgtgtcctggtaccagcagctgcccgggaccgcgcccaaggtgctgatctacgagaacaacaagcgccccagcggcatcccggaccggttctccggcagcaagtccgggaccagcgccacgctcggcatcaccgggctgcagaccggcgacgaggccgactactactgcgggacctgggactccagcctgtccgccggcggcgtcttcgggacgggcaccaaggtgaccgtgctc

SEQ ID NO: 10426 - RNA, 333 nt, synthetic construct
  misc_feature 1..333: note = derived and/or modified sequence opt1 from anti-HIV_038-186200_VR-Chain
  source 1..333: mol_type = other RNA
cagagcgtgctgacccagcccccgtccgccagcggcacccccgggcagcgcatcacgatctcctgcagcggcacctccagcaacatcgggtccaacatcgtcagctggtaccagcacctccccggcaccacccccaagctggtgatcttccggaacaaccagcgcccgtccgggatccccgaccggttcagcggctccaagagcggcacgtccgccaccctggggatcaccggcctccagaccggggacgaggcggactactactgcggcacgtgggacagctccctgagcgccgggggcgtgttcggcaccgggaccaaggtcaccgtgctg

SEQ ID NO: 10427 - RNA, 333 nt, synthetic construct
  misc_feature 1..333: note = derived and/or modified sequence opt1 from anti-HIV_038-126170_VR-Chain
  source 1..333: mol_type = other RNA
cagagcgtgctgacccagcccccgtccgtcagcgccccgcccggccagaaggtgaccatctcctgcagcgggacgacctccaacatcggcagcaactacgtggcctggtaccagcagctccccgggaccgcgcccaagctgctgatctacgacaacgtcaagcgccccaccaacatccccgaccggttctccggcagcaagtccgggacgagcgccaccctcggcatcaccggcctgcagaccggggacgaggccgactactactgcggcacgtgggactccagcctgtccgccgggggcgtgttcgggaccggcaccaaggtgaccgtcctc

SEQ ID NO: 10428 - RNA, 333 nt, synthetic construct
  misc_feature 1..333: note = derived and/or modified sequence opt1 from anti-HIV_038-108545_VR-Chain
  source 1..333: mol_type = other RNA
cagagcgtgctgacccagcccccgtccgccagcggcacccccgggcagcgcgtcacgatctcctgcagcggctccagctccaacatcgggtacaacaccgtgagctggtaccagcagctccccggcaccgcccccaagctgctgatctacgagaacaacaagcggccgtccgggatccccgaccgcttcagcggctccaagagcggcacctccgcgacgctcgggatcaccggcctgcagaccggggacgaggccgactactactgcggcacctgggacagctccctgagcgccgggggcgtgttcggcacggggaccaaggtcaccgtgctc

SEQ ID NO: 10429 - RNA, 333 nt, synthetic construct
  misc_feature 1..333: note = derived and/or modified sequence opt1 from anti-HIV_038-107263_VR-Chain
  source 1..333: mol_type = other RNA
cagagcgtgctgacccagcccccgtccgccagcggcacccccgggcagcgcgtcacgatctcctgcagcggctccagctccaacatcgggagcaacaccgtgaactggtaccagcaggtccccggcaccgcccccaacctcctgatctactccaacgaccagcggccgagcgggatccccgaccgcttctccggcagcaagtccggcaccagcgcgacgctggggatcaccggcctccagaccggggacgaggccgactactactgcggcacctgggactccagcctgtccgccgggggcgtgttcggcacggggaccaaggtgaccgtgctg

SEQ ID NO: 10430 - RNA, 333 nt, synthetic construct
  misc_feature 1..333: note = derived and/or modified sequence opt1 from anti-HIV_038-104530_VR-Chain
  source 1..333: mol_type = other RNA
cagagcgtgctgacccagcccccgtccgtcagcgccgcccccggccagaaggtgaccatctcctgcagcgggtccagctccaacatcggcagcaactacgtgtcctggtaccagcacctccccgggaaggcgcccaagctgctgatctacgacaacaacaagcgcccgagcggcatccccgaccggttctccgggagcaagtccggcacgagcgccaccctcggcatcaccgggctgcagaccggcgacgaggccgactactactgcgggacgtgggactccagcctgtccgccggcggggtcttcggcaccggcaccaaggtgaccgtgctc

SEQ ID NO: 10431 - RNA, 333 nt, synthetic construct
  misc_feature 1..333: note = derived and/or modified sequence opt1 from anti-HIV_038-099169_VR-Chain
  source 1..333: mol_type = other RNA
cagagcgtgctgacccagcccccgtccgccagcggcacccccgggcagcgcgtctccatcagctgctccggcatcacgagctccctcgggagcaaccacatgtcctggtaccagcagctgcccggcaccgcccccaagctgctcatctacgagaacaacaagcggccgagcgggatccccgaccgcttctccggcagcaagtccggcaccagcgcgaccctggggatcacgggcctgcagaccggggacgaggccgactactactgcggcacctgggactccagcctctccgccgggggcgtgttcggcaccgggacgaaggtgaccgtcctg

SEQ ID NO: 10432 - RNA, 333 nt, synthetic construct
  misc_feature 1..333: note = derived and/or modified sequence opt1 from anti-HIV_038-075067_VR-Chain
  source 1..333: mol_type = other RNA
cagagcgtgctgacccagcccccgtccgtcagcggcgcccccgggcagcgcgtgaccatctcctgcagcggctccagctccacgatcgggaacaactacgtgagctggtaccagctcctgcccggcaccgcccccaagctgctcatctacaagaacaacaagcggccgtccgggatccccgaccgcttcagcggctccaagagcggcacctccgcgaccctggggatcacgggcctgcagaccggggacgaggccgactactactgcggcacctgggacaccagcctctccgccgggggcgtcttcggcacggggaccaaggtgaccgtgctg

SEQ ID NO: 10433 - RNA, 333 nt, synthetic construct
  misc_feature 1..333: note = derived and/or modified sequence opt1 from anti-HIV_038-072368_VR-Chain
  source 1..333: mol_type = other RNA
cagagcgtgctgacccagtcccccagcgcctccggcaccccggggcagcgcgtcacgatcagctgctccggcagctccagcaacatcgggaacaactacgtgtcctggtaccagcagctccccggcaccgcccccaagctgctgatctacgagaacaacaagcggcccagcgggatcccggaccgcttctccggcagcaagtccggcaccagcgcgaccctcgggatcacgggcctgcagaccggggacgaggccgactactactgcggcacctgggactccagcctgtccgccgggggcgtgttcggcaccgggacgaaggtcaccgtgctc

SEQ ID NO: 10434 - RNA, 333 nt, synthetic construct
  misc_feature 1..333: note = derived and/or modified sequence opt1 from anti-HIV_038-068503_VR-Chain
  source 1..333: mol_type = other RNA
cagagcgtgctgacccagcccccgtccgtcagcgccgcccccggccagatggtgaccatctcctgcagcgggtcccgcagcaacatcgagaaccactacgtgtcctggtaccagcacctccccggcgcggcccccaagctgctgatctacgacaacgggaagcggccgagcggcatccccgaccgcttctccgggagcaagtccggcacgagcgccaccctcggcatcaccgggctgcagaccggcgacgaggccgactactactgcgggacgtgggactccagcctgtccgccggcggggtcttcggcaccggcaccaaggtgaccgtgctc

SEQ ID NO: 10435 - RNA, 333 nt, synthetic construct
  misc_feature 1..333: note = derived and/or modified sequence opt1 from anti-HIV_038-068016_VR-Chain
  source 1..333: mol_type = other RNA
cagagcgtgctgacccagcccccgtccgccagcggcacccccgggcagcgcgtcacgatctcctgcagcggctccagctccaacatcgagagcaacttcgtgtactggtaccagcagttccccgggaccacccccaagctcctgatctaccgggacggccagcgcccgtccgggatccccgaccggttcagcggctccaagagcggcacctccgccacgctggggatcaccggcctccagaccggggacgaggcggactactactgcggcacctgggacagctccctgagcgccgggggcgtgttcggcacggggaccaaggtcaccgtgctg

SEQ ID NO: 10436 - RNA, 333 nt, synthetic construct
  misc_feature 1..333: note = derived and/or modified sequence opt1 from anti-HIV_038-063958_VR-Chain
  source 1..333: mol_type = other RNA
cagagcgtgctgacccagcccccgtccgtcagcggcgcccccgggcagcgcgtgaccatctcctgcacgggcagctccagcaacatcgggaactccggcgtgcactggtaccagcagctccccgggaccgcccccaagctgctgatctacgagaacaacaagcggccgagcggcatccccgaccgcttctccggcagcaagtccgggaccagcgcgaccctcggcatcacggggctgcagaccggcgacgaggccgactactactgcgggacctgggactccagcctgtccgccggcggcgtcttcgggaccggcacgaaggtgaccgtgctc

SEQ ID NO: 10437 - RNA, 333 nt, synthetic construct
  misc_feature 1..333: note = derived and/or modified sequence opt1 from anti-HIV_038-033733_VR-Chain
  source 1..333: mol_type = other RNA
cagagcgtgctgacccagcccccgtccgccagcggcacccccgggcagcgcgtcacgatctcctgcagcggctccagctccaacatcgggagcaagtacgtgtactggtaccagcagctccccggcaccgcccccaagctgctgatctacgacaacgacaagcggccgtccgggatccccgaccgcatcagcgcgtccaagagcggcacctccgccaccctcgacatcacgcggctgcagaccggcgacgaggccgactactactgcgggacctgggacagctccctgagcgccggcggggtgttcggcaccgggacgaaggtcaccgtgctc

SEQ ID NO: 10438 - RNA, 333 nt, synthetic construct
  misc_feature 1..333: note = derived and/or modified sequence opt1 from anti-HIV_038-030557_VR-Chain
  source 1..333: mol_type = other RNA
cagagcgtgctgacccagcccccgtccgtcagcgccgcccccggccagaaggtgaccatctcctgcagcgggtccagctccacgatcggcaacaactacgtgagctggtaccagctcctgcccgggaccgcgcccaagctgctcatctacaagaacaacaagcgcccgtccggcatccccgaccggttcagcgggtccaagagcggcacctccgccaccctgggcatcacggggctgcagaccggcgacggggccgactactactgcggcacctgggacaccagcctctccgccgggggcgtcttcggcacggggaccatcgtgaccgtgctg

SEQ ID NO: 10439 - RNA, 333 nt, synthetic construct
  misc_feature 1..333: note = derived and/or modified sequence opt1 from anti-HIV_038-024298_VR-Chain
  source 1..333: mol_type = other RNA
cagagcgtgctgacccagcccccgtccgtcagcgccgcccccggccagaaggtgaccatctcctgcagcgggtccagctccaacatcggcaacagccacgtgtcctggtaccagcagttccccgggacgggccccaagctcctgatctacgagaacgcgaagcgcccgagcgggatccccgaccggatctccggcagcaagtccgacaccagcgccaccctgggcatcaccgggctccagacgggcgacgaggccgactactactgcgggacctgggactccagcctgtccgccggcggggtcttcggcaccggcaccaaggtgacggtgctg

SEQ ID NO: 10440 - RNA, 333 nt, synthetic construct
  misc_feature 1..333: note = derived and/or modified sequence opt1 from anti-HIV_038-011154_VR-Chain
  source 1..333: mol_type = other RNA
cagagcgtgctgacccagcccccgtccgtcagcgccgcccccggccagcgcatcaccatctcctgcagcgggtccagctccaacatcggcaacaactacgtgagctggtaccagcagctccccgggacggcgcccaagctgctgatctacaagaacaacaagcggccgtccggcatccccgaccgcttcagcgggtccaagagcggcacctccgccaccctcggcatcaccgggctgcagacgggcgacgaggccgactactactgcgggacctgggacaccagcctgtccgccggcggggtgttcggcaccggcacgaaggtcaccgtgctc

SEQ ID NO: 10441 - RNA, 318 nt, synthetic construct
  misc_feature 1..318: note = derived and/or modified sequence opt1 from anti-HIV-1_LightChain
  source 1..318: mol_type = other RNA
gagatcgtgctgacccagagccccggcaccctctccctgagcccgggggagcgcgccacgctgtcctgccgggccagccagtccgtcagcaacaacttcctcgcgtggtaccagtacaagcccggccagccgccccgcgtgctgatctacgggacctcccggcgcgccagcggcatccccgaccggttctccgggagcggctccggcaccgacgggagcctgaccatctcccgcctcgaggccgaggacttcgccgtgtactactgccagcagtacgagttcttcggccaggggacgcggctggagatgaagcgcacc

SEQ ID NO: 10442 - RNA, 318 nt, synthetic construct
  misc_feature 1..318: note = derived and/or modified sequence opt1 from anti-HIV-1_LightChain
  source 1..318: mol_type = other RNA
gaggtggtcctgacccagagccccggcaccctctccctgagcccgggggagcgcgccacgctgtcctgccgggccagccagtccgtgagccgcaactacctcgcgtggtaccagcagaagctgggccacgggccccggctgctcgtgtacgccacctcccgccgggccaccggcatccccgaccgcttcatcgggagccagtccggcaccgagtacaacctgacgatcacccggctggaccccggcgacttcgcccagtacttctgccagcagtacgagttcttcgggccgggcacccgcctcgacatcaagcggacc

SEQ ID NO: 10443 - RNA, 309 nt, synthetic construct
  misc_feature 1..309: note = derived and/or modified sequence opt1 from anti-HIV-1_LightChain
  source 1..309: mol_type = other RNA
gaggtggtcctgacccagagccccggcaccctctccctgagcccgggggagcgcgcctccttcagctgcaagtccagccagtacggccacacggcctggtaccagcagaagctggggcacggcccccggctcctgatctacgcgacctcccgccgggccaccgggatccccgaccgcttcatcggcagccagtccggcaccgagtacaacctgacgatcacccggctcgaccccggggacttcgcccactacttctgccagcagaacgagttcttcggcccggggacccgcctggacatgaagcggacc

SEQ ID NO: 10444 - RNA, 306 nt, synthetic construct
  misc_feature 1..306: note = derived and/or modified sequence opt1 from anti-HIV-1_LightChain
  source 1..306: mol_type = other RNA
gagatcgtgctgacccagagcccctccagcctctccctgagcccgggcgagcgcgcctccctgagctgccgggggtcccacggccacgtcgcctggtaccagcacaagcccgggcagatcccccgcctcctgatctacgcgaccagcaagcgggcctccggcatcagcgaccgcttctccgggagcggctccggcacggacgccaccctgagcatctcccggctcgagcccgaggacttcgccgtgtacttctgccagcagtacgagttcttcgggcagggcacccgcctggagatcaagcggacc

SEQ ID NO: 10445 - RNA, 306 nt, synthetic construct
  misc_feature 1..306: note = derived and/or modified sequence opt1 from anti-HIV-1_LightChain
  source 1..306: mol_type = other RNA
gagatcatgctgacccagagccccggcaccctctccctgagcccgggggagcgcgccacgctgtcctgccggggcagccacgggcacgtggcctggtaccagcagaagcccggccgcatcccccggctcctgatctacgggacctccaagcgcgcgagcggcatccccgaccggttctccggcagcgggtccggcaccgacgccaccctgacgatcagccgcctcgagtccgaggacttcgccgtctacttctgccagcagtacgagttcttcgggcagggcacccggctggacatcaaccgcacc

SEQ ID NO: 10446 - RNA, 309 nt, synthetic construct
  misc_feature 1..309: note = derived and/or modified sequence opt1 from anti-HIV-1_LightChain
  source 1..309: mol_type = other RNA
gagagcgtgctgacccagtcccccggcaccctcagcctgtccccgggggagacggccagcctgtcctgcaccgccgcgctctacggccacatgacctggtaccagaagaagcccgggcagccgcccaagctgctgctctacgccagctccaagcgcgccagcggcatccccgaccggttctccgggagccagttcggcaagcagtacaccctgatcatcacgaagatggagcccgaggacttcgccgagtactactgccagcagttcgaggtcttcggccaggggacccgcctggacatgcggcgcacc

SEQ ID NO: 10447 - RNA, 306 nt, synthetic construct
  misc_feature 1..306: note = derived and/or modified sequence opt1 from anti-HIV-1_LightChain
  source 1..306: mol_type = other RNA
gaggtggtcctgacccagagccccggcaccctctccctgagcccgggggagcgcgccacgctgtcctgccggggcagccacgggcacctctcctggtaccagtacaagcccggccagccgccccgcgtgctgatctacgggaccagccggcgcgcctccggcatccccgaccggttcagcggctccgggagcggcaccgacgggtccctgaccatcagccgcctcgaggcggaggacttcgccgtgtactactgccagcagtacgagttcttcggccaggggacgcggctggagatgaagcgcacc

SEQ ID NO: 10448 - RNA, 309 nt, synthetic construct
  misc_feature 1..309: note = derived and/or modified sequence opt1 from anti-HIV-1_LightChain
  source 1..309: mol_type = other RNA
gaggtggtcctgacccagagccccggcaccctctccctgagcccgggggagcgcgcctccctgagctgcaagtccagccagtacggccacacggcctggtaccagcagaagctcgggcagggcccccggctgctgatctacgcgacctcccgccgggccaccgggatccccgaccgcttcagcggctcccagagcggcaccgagtacaacctcacgatcacccggctggaccccggggacttcgcccagtacttctgccagcagtacgagttcttcggcccggggacccgcctggacatcaagcggacc

SEQ ID NO: 10449 - RNA, 306 nt, synthetic construct
  misc_feature 1..306: note = derived and/or modified sequence opt1 from anti-HIV-1_LightChain
  source 1..306: mol_type = other RNA
gagatcatgctgacccagagccccggcaccctctccctgagcccgggggagcgcgccacgctgtcctgccggggcagccacgggcacgtggcctggtaccagcagaagcccggccgcatcccccggctcctgatctacgggacctccaagcgcgcgagcggcatccccgaccggttctccggcagcgggtccggcaccgacgccaccctgacgatcagccgcctcgagtccgaggacttcgccgtctactactgccagcagtacgagttcttcgggcagggcacccggctggacatcaagcgcacc

SEQ ID NO: 10450 - RNA, 309 nt, synthetic construct
  misc_feature 1..309: note = derived and/or modified sequence opt1 from anti-HIV-1_LightChain
  source 1..309: mol_type = other RNA
gagagcgtgctgacccagtcccccggcaccctcagcctgtccccgggggagacggccagcctgtcctgcaccgccgcgagctacggccacatgacctggtaccagaagaagcccgggcagccgcccaagctcctgatcttcgccacctccaagcgcgccagcggcatccccgaccggttctccgggagccagttcggcaagcagtacacgctgaccatcacccgcatggagcccgaggacttcgccggctactactgccagcaggtcgagttcttcgggcagggcacccggctcgagatccgccggacg

SEQ ID NO: 10451 - RNA, 309 nt, synthetic construct
  misc_feature 1..309: note = derived and/or modified sequence opt1 from anti-HIV-1_LightChain
  source 1..309: mol_type = other RNA
gacatccagatgacccagagcccctccagcctgtccgccagcgtgggcgaccgcgtcaccatcacgtgccaggcctcccaggacatcagcaactacctcaactggtaccagcagaagccggggaaggcgcccaagctgctgatctacgacgcctccaacctcgagaccggcgtgcccagccggttctccgggagcggcttccacaccaccttctccctgacgatcagcgggctgcagcgcgacgacttcgccacctacttctgcgccgtgctcgagttcttcggccccggcaccaaggtcgacttcaac

SEQ ID NO: 10452 - RNA, 309 nt, synthetic construct
  misc_feature 1..309: note = derived and/or modified sequence opt1 from anti-HIV-1_LightChain
  source 1..309: mol_type = other RNA
gacatccagatgacccagagcccctccagcctgtccgccagcgtgggcgaccgcgtcaccatcacgtgccaggcctcccaggacatcaccaactacctcaactggtaccagcagaagccggggcgggcgcccaagctgctggtgcacggcgccagcaacctccagcgcggggtgccctcccggttcagcggctccgggttccacaccaccttcacgctgaccatcagctccctgcagcccgacgacgtcgccacctacttctgcgaggtgttccagtggttcggcccgggcacccgcgtggacttcaac

SEQ ID NO: 10453 - RNA, 309 nt, synthetic construct
  misc_feature 1..309: note = derived and/or modified sequence opt1 from anti-HIV-1_LightChain
  source 1..309: mol_type = other RNA
ggcttccagctgacccagagcccctccagcctctccgccagcgtgggggaccgcgtctccatcaactgccaggccggcgaggggatcggcagctccctgaactggtaccagcagaagccggggcgggcgcccaagctgctcgtgcacggcgccagcaacctgcagcgcggcgtgccctcccggttcagcgggtccggcttccacaccacgttcaccctgaccatcagctccctccagcccgacgacgtcgccacctacttctgcgaggtgttccagtggttcgggccgggcacgcgcgtggacttcaac

SEQ ID NO: 10454 - RNA, 309 nt, synthetic construct
  misc_feature 1..309: note = derived and/or modified sequence opt1 from anti-HIV-1_LightChain
  source 1..309: mol_type = other RNA
ggcatccagctgacccagagcccctccagcctctccgtgagcgtcggggaccgcgtgaccatcacgtgccgggcctcccagggcatcgggaacagcctgaactggtaccagcagaagccgggcaaggcccccaacctgatggtgttcgggaccaccaagctcaaccgcggcgtcccctcccggttcagcggctccgggagcggcaccacggcgaccctgaccatcaactccctgcagcccgaggacatcgccacctacttctgccaggtgttcgagttcctcgggccgggcacgaagctggacatgaag

SEQ ID NO: 10455 - RNA, 309 nt, synthetic construct
  misc_feature 1..309: note = derived and/or modified sequence opt1 from anti-HIV-1_LightChain
  source 1..309: mol_type = other RNA
gacatccagatgacccagagcccctccagcctgtccgccagcgtgggcgaccgcgtcaccatcacgtgccaggccgggcagggcatcgggtccagcctcaagtggtaccagcagaagccgggccgggcgccccgcctgctggtgcacggggcctccaacctccaccggggcgtgcccagccgcttctccggcagcgggttccacaccaccttctccctgaccatcagcggcctgcagcgggacgacttcgccacgtacttctgcgccgtcctcgagttcttcgggcccggcaccaaggtggacttcaac

SEQ ID NO: 10456 - RNA, 309 nt, synthetic construct
  misc_feature 1..309: note = derived and/or modified sequence opt1 from anti-HIV-1_LightChain
  source 1..309: mol_type = other RNA
ggcatccagctgacccagagcccctccagcctctccgccagcgtgggggaccgcgtcaccatcacgtgccaggcctcccagggcatcgggagctccctgcagtggtaccagcagaagccgggccgggcgcccaacctgctcgtgcacggggccagcaacctgcaccgcggcgtgccctcccggttcagcggctccgggttccacaccaccttcagcctgaccatctccggcctccagcgcgacgacttcgccacgtacttctgcgccgtcctggagttcttcgggcccggcaccaaggtggagatcaag

SEQ ID NO: 10457 - RNA, 309 nt, synthetic construct
  misc_feature 1..309: note = derived and/or modified sequence opt1 from anti-HIV-1_LightChain
  source 1..309: mol_type = other RNA
ggcgtgcagctgacccagagcccctccagcctctccgccagcgtcggggaccgcgtgtccatcaactgccaggccggccaggggatcggcagctccctgaactggtaccagcagaagcgggggaaggcgccgaagctgctcgtgcacggcgccagcaccctgcagcgcggcgtcccctcccggttcagcgggtccggcttccacacgaccttcaccctgaccatcagctccctccagcccgacgacgtggccacgtacttctgcgaggtgttccagtggttcgggcccggcacccgcgtcgacttcaac

SEQ ID NO: 10458 - RNA, 306 nt, synthetic construct
  misc_feature 1..306: note = derived and/or modified sequence opt1 from anti-HIV-1_LightChain
  source 1..306: mol_type = other RNA
tacatccagctgacccagagcccctccagcctctccgccagcatcggcgaccgcgtgaccatcgcctgccgggcgtcccaggggatcggctacgtccactggtaccagcagaagcgcgggaagccgcccaagctgctgatccacggcgccagcatcctcgagcgcggggtgccctcccggttcagcggctccggcagcgggacgctgttcaacctgaccgtgtccggcctccagcccgaggacttcgccacctacatgtgccaggtcttcgagagcttcgggccgggcaccaaggtgcagatgaag

SEQ ID NO: 10459 - RNA, 309 nt, synthetic construct
  misc_feature 1..309: note = derived and/or modified sequence opt1 from anti-HIV-1_LightChain
  source 1..309: mol_type = other RNA
ggcatccagctgacccagagcccctccagcctctccgccagcctgggggaccgcgtgaccatcacgtgccaggcctcccagggcatcgggagctccctgcagtggtaccagcagaagccgggcaaggcgcccaagctcctggtccacggggccagcaagctgcaccggggcgtgccctcccgcttcagcggctccgggttccacaccaccttcagcctcaccatctccagcctgcagcccgaggacttcgccacgtacctgtgccaggtgctcgagttcttcggcccggggaccaaggtcgacttcaac

SEQ ID NO: 10460 - RNA, 309 nt, synthetic construct
  misc_feature 1..309: note = derived and/or modified sequence opt1 from anti-HIV-1_LightChain
  source 1..309: mol_type = other RNA
ggcatccagctgacccagagcccctccagcctctccgccagcgtgggggacaccgtcacgatcacgtgccaggcctcccagggcatcgggagctccctgcagtggtaccagcagaagcgcggccgggcgccgaagctgctcgtgcacggggccagcaacctgcagggcggcgtgccctcccgcttcagcgggtccggcttccacaccaccttcaccctggccatccgggggctccagcccgacgacttcgccacctacttctgccagagcctggagttcttcggccccgggaccaaggtcgacatgaag

SEQ ID NO: 10461 - RNA, 306 nt, synthetic construct
  misc_feature 1..306: note = derived and/or modified sequence opt1 from anti-HIV-1_LightChain
  source 1..306: mol_type = other RNA
tacatccagctgacccagagcccctccagcctctccgccagcgtgggcgaccgcgtcaccatcacgtgccgggcctcccaggacatcgggtacgtgagctggtacgcgcagaagcgcggccgggccccgaagctgctgatccacggggcctccggcctcgagcgcggggtgcccagccggttctccggcagcggctccgggaccctgttcaccctgaccatcgagagcctccagcccgaggacttcgccacgtacatgtgccaggtcttcgagtccttcggccccgggaccaaggtggagatgaag

SEQ ID NO: 10462 - RNA, 309 nt, synthetic construct
  misc_feature 1..309: note = derived and/or modified sequence opt1 from anti-HIV-1_LightChain
  source 1..309: mol_type = other RNA
ggcatccagctgacccagagcccctccagcctctccgccagcgtgggggaccgcgtctccatcaactgccaggccggccaggggatcggcagctccctgaactggtaccagcagaagccggggcgggcgcccaagctgctcgtgcacggcgccagcaacctgcagcgcggcgtgccctcccggttcagcgggtccggcttccacaccacgttcaccctgaccatcagctccctccagcccgacgacgtcgccacctacttctgcgccgtgttccagtggttcgggccgggcacgcgcgtggacttcaac

SEQ ID NO: 10463 - RNA, 366 nt, synthetic construct
  misc_feature 1..366: note = derived and/or modified sequence opt1 from anti-HIV-1_HeavyChain
  source 1..366: mol_type = other RNA
agccagcagctggtgcagtccggcacccaggtcaagaagcccggggccagcgtgcgcatctcctgccaggccagcggctacaccttcacggactacgtgctccactggtggcggcaggcgccggggcagggcctggagtggatggggtggatcaagcccgtctacggcgcccgcaactacgcccggcgcttccagggccggatcgacttctcccgcgacatctaccgggagatcgcctacatggacctgagcgggctccgctccgacgacaccgccctgtacttctgcgcgcgggacggcagcggggacgacacctcctggcacctggacccctggggccaggggaccctcgtgatcgtgagcgcc

SEQ ID NO: 10464 - RNA, 366 nt, synthetic construct
  misc_feature 1..366: note = derived and/or modified sequence opt1 from anti-HIV-1_HeavyChain
  source 1..366: mol_type = other RNA
agccagcagctggtgcagtccggcacccaggtcaagaagcccggggccagcgtgcgcatctcctgccaggccagcggctacaccttcacggactacctcctgcactggtggcggcaggcgccggggcagcgcctggagtggatgggctggatcaagcccgtgtacggggcccggaactacgcccaccgcttccagggccggatcaacttcgaccgcgacatctaccgggagatcgccttcatggacctctccggcctgcgcagcgacgacaccgccgtctacttctgcgcgcgggacgggggcggggacgaccgcacctggctgctcgacacctggggccaggggacgctggtggtggtctccagc

SEQ ID NO: 10465 - RNA, 366 nt, synthetic construct
  misc_feature 1..366: note = derived and/or modified sequence opt1 from anti-HIV-1_HeavyChain
  source 1..366: mol_type = other RNA
caggtgcacctggagcagcccggcagcgtcgtgcgctggccgggggcctccctgaccctgagctgcaccgcctccggctacatcttcgtgaactaccacatccactggctgcggcaggcgcccgggcagcgcctcgagctgctgggcacgatcaaccccgtcgggggcgccaccagctacgcccagaagttccggggccgcctcgtgctgacccgggacatcgggtccagcaccgtgacgctgctcctgaaccacctccgccgggacgactccgccgtctacttctgcgcccgcgagagcaacgcgtccggccgggggcgcagcatggaccactggggccgggggtcccgcgtgatcgtgagccag

SEQ ID NO: 10466 - RNA, 366 nt, synthetic construct
  misc_feature 1..366: note = derived and/or modified sequence opt1 from anti-HIV-1_HeavyChain
  source 1..366: mol_type = other RNA
caggtgcagctggtccagagcggcgccgaggtgaagaagcccggggcctccgtgcgcgtcagctgccaggcgtccggctacaccttcaccaactacatcctgcactggtggcggcaggccccggggcagggcctggagtggatggggctgatcaagcccgtgtacggcgccgtgaactacgcccgccagttccagggccggatccagctcacgcgcgacatctaccgggagatcgccttcctggacctgagcgggctccgctccgacgacaccgcggtctactactgcgcccgggacgagagcggcgacgacctgaagtggcacctccacccctgggggcagggcacccaggtgatcgtgtccccc

SEQ ID NO: 10467 - RNA, 366 nt, synthetic construct
  misc_feature 1..366: note = derived and/or modified sequence opt1 from anti-HIV-1_HeavyChain
  source 1..366: mol_type = other RNA
caggtgcagctggtccagagcggcgccgaggtgaagaagcccggggcctccgtgcgcatcagctgccaggcgtccggctacaccttcaccgactacgtcctgcactggtggcggcaggccccggggcagggcctggagtggatggggtggatcaagcccgtgtacggcgcccgcaactacgcccggcgcttccagggccggatcaacttcgaccgcgacatctaccgggagatcgcctacatggacctgagcgggctccgctccgacgacacggcgcggtacttctgcgcccgcgacggcagcggggacgacacctcctggcacctccacccctggggccaggggaccctggtgatcgtcagcgcc

SEQ ID NO: 10468 - RNA, 366 nt, synthetic construct
  misc_feature 1..366: note = derived and/or modified sequence opt1 from anti-HIV-1_HeavyChain
  source 1..366: mol_type = other RNA
agccagcagctggtgcagtccggcacccaggtcaagaagcccggggccagcgtgcgcgtgtcctgccaggccagcggctacaccttcacgaactacatcctgcactggtggcggcaggcgccggggcagggcctggagtggatggggctgatcaagcccgtctacggcgccgtgaactacgcccgccagttccagggccggatccagctcacccgcgacatctaccgggagatcgccttcctggacctgtccgggctccgcaccgacgacaccgccgtgtactactgcgcgcgggacgagagcggcgacgacctgaagtggcacctccacccctgggggcagggcacgcaggtcatcgtgtccccc

SEQ ID NO: 10469 - RNA, 366 nt, synthetic construct
  misc_feature 1..366: note = derived and/or modified sequence opt1 from anti-HIV-1_HeavyChain
  source 1..366: mol_type = other RNA
caggtgcacctggagcagagcggctccgtcgtgcgctggcccggggccagcctgaccctgtcctgcaccgccagcggctacatcttcgtgaactaccacatccactggctgcggcaggcgccggggcagcgcctcgagctgatgggcacgatcaaccccgtcgggggcgccacctcctacacccagcggttccgcggccggctggtgctcacccgcgacatcgggagcaacacggtgaccctgctgctcaaccacctccggtccgacgacagcgccgtctacttctgcgcccgcgagtccaacgccagcggccgggggcgctccatggaccactggggccgggggagccacgtgatcgtgtccccc

SEQ ID NO: 10470 - RNA, 366 nt, synthetic construct
  misc_feature 1..366: note = derived and/or modified sequence opt1 from anti-HIV-1_HeavyChain
  source 1..366: mol_type = other RNA
agccagcacctggtgcagtccggcacccaggtcaagaagcccggggccagcgtgcgcgtgtcctgccaggccagcggctacaccttcacgaactacatcctgcactggtggcggcaggcgccggggcagggcctggagtggatggggctgatcaagcccgtctacggcgccgtgaactacgcccgccagttccagggccggatccagctcacccgcgacatctaccgggacatcgccttcctggacctgtccgggctccgcagcgacgacaccgccgtgtactactgcgcgcgggacgagtccggcgacgacctgaagtggcacctccacccctgggggcagggcacccaggtcatcgtgagcccc

SEQ ID NO: 10471 - RNA, 366 nt, synthetic construct
  misc_feature 1..366: note = derived and/or modified sequence opt1 from anti-HIV-1_HeavyChain
  source 1..366: mol_type = other RNA
agccagcagctggtgcagtccggcacccaggtcaagaagcccggggccagcgtgcgcatctcctgccaggccagcggctacaccttcacggactacgtgctgcactggtggcggcaggcgccggggcagggcctggagtggatggggtggatcaagcccgtctacggcgcccgcaactacgcccggcgcttccagggccggatcaacttcgaccgcgacatctaccgggagatcgcctacatggacctgtccgggctccgcagcgacgacaccgcccggtacttctgcgcgcgcgacggctccggggacgacaccagctggcacctccacccctggggccaggggaccctggtgatcgtgtccgcc

SEQ ID NO: 10472 - RNA, 366 nt, synthetic construct
  misc_feature 1..366: note = derived and/or modified sequence opt1 from anti-HIV-1_HeavyChain
  source 1..366: mol_type = other RNA
caggtgcacctggagcagcccggcagcgtcgtgcgctggccgggggcctccctgaccctgagctgcaccgcctccggctacatcttcgtgaactaccacatccactggctgcggcaggcgcccgggcagcgcctcgagctgctgggcacgatcaaccccgtcgggggcgccaccagctacgcccagaagttccggggccgcctcgtgctgacccgggacatcgggtccagcaccgtgacgctgctcctgaaccacctccgccgggacgactccgccgtctacttctgcgcccgcgagagcaacgcgtccggccgggggcgcagcatggaccactggggccgggggaagcccgtgatcgtgtccccg

SEQ ID NO: 10473 - RNA, 321 nt, synthetic construct
  misc_feature 1..321: note = derived and/or modified sequence opt1 from anti-HIV-1_HeavyChain
  source 1..321: mol_type = other RNA
gagatcgtgatgacccagagccccgccatcctgtccgtcagcccgggcgaccgcgccaccttctcctgccgggcgagccagtccgtgaagaacaacctcgcctggtaccagaagcgccccgggcaggcgccccggctgctgatcttcgacgccagctcccgcgccagcggcatccccgcccggttctccgggggcgggagcggcacggagttcaccctcaccgtgaactccatgcagagcgaggacttcgccacctactactgccagcagtacgaggagtggccgcgcacgttcggccaggggaccaaggtcgagatcatg

SEQ ID NO: 10474 - RNA, 321 nt, synthetic construct
  misc_feature 1..321: note = derived and/or modified sequence opt1 from anti-HIV-1_HeavyChain
  source 1..321: mol_type = other RNA
cagatcgtgctgacccagagcccgcccaccctctccctgagccccggcgagcgcgccacgctgtcctgccgggccagccagtccgtcaagaacaacctcgcctggtaccagaagcgccccgggcaggcgccccggctgctgatcttcgacaccagctcccgcgccagcaacatcccggcccggttctccggcgggggcagcgggaccgagttcaccctcacggtgaactccatgcagagcgaggacttcgccacctactactgccagcagtacgaggagtggccccgcaccttcggccagggcaccaaggtggagatcatc

SEQ ID NO: 10475 - RNA, 321 nt, synthetic construct
  misc_feature 1..321: note = derived and/or modified sequence opt1 from anti-HIV-1_HeavyChain
  source 1..321: mol_type = other RNA
gagatcgtgatgacccagagccccgccgtcctgtccgtgagcccgggcgaccgcgccaccctctcctgccgggcgagccagtccgtgaagaacaacctggcctggtaccagaagcgccccgggcaggcgccccggctgctcatcttcgacacgagctcccgcgccagcaacatccccgcccggttctccggcgggggcagcgggaccgagttcaccctgaccgtcaactccatgcagagcgaggacttcgccacgtactactgccagcagtacgaggagtggccgcgcaccttcggccagggcaccaaggtggagatcaac

SEQ ID NO: 10476 - RNA, 321 nt, synthetic construct
  misc_feature 1..321: note = derived and/or modified sequence opt1 from anti-HIV-1_HeavyChain
  source 1..321: mol_type = other RNA
gagatcgtgctgacccagagcccgcccaccctctccgtcagccccggcgaggccgccacgctgtcctgccgcgcgagccagtccgtgaagaacaacctggcctggtaccacctcaaggccgggcaggcgccccggctgctgatcttcgacgccagctcccgcgccggcgacgcccccgcccgggtgagcgggtccggctacgggaccgagttcaccctcaccgtcaacagcgtgcagtccgaggacttcggcgactactactgccagcagtacgaggagtggccgcgcacgttcggccaggggaccaaggtggacctgcgg

SEQ ID NO: 10477 - RNA, 321 nt, synthetic construct
  misc_feature 1..321: note = derived and/or modified sequence opt1 from anti-HIV-1_HeavyChain
  source 1..321: mol_type = other RNA
gagatcgtgatgacccagagcccgcccaccctgtccgtcagccccggcgagacggccaccctctcctgccgcgccagccagaacgtgaagaacaacctggcctggtaccagctgaagcccgggcaggcgccccggctcctgatcttcgacgcctccagccgcgccggcgggatcccggaccggttctccggcagcgggtacggcaccgacttcaccctgacggtgaactccgtccagagcgaggacttcggcgactacttctgccagcagtacgaggagtggccccgcaccttcgggcagggcaccaaggtggacctccgg

SEQ ID NO: 10478 - RNA, 321 nt, synthetic construct
  misc_feature 1..321: note = derived and/or modified sequence opt1 from anti-HIV-1_HeavyChain
  source 1..321: mol_type = other RNA
gagatcgtgatgacccagagccccgccgtcctgtccgtgagcccgggcgaccgcgccaccctctcctgccgggcgagccagtccgtgaagaacaacctggcctggtaccagaagcgccccgggcaggcgccccggctgctcatcttcgacacgagctcccgcgccagcaacatccccgcccggttctccggcgggggcagcgggaccgagttcaccctgaccgtcaactccatgcagagcgaggacttcgccacgtactactgccagcagtacgaggagtggccgcgcaccttcggccagggcaccaaggtggagatcatc

SEQ ID NO: 10479 - RNA, 399 nt, synthetic construct
  misc_feature 1..399: note = derived and/or modified sequence opt1 from anti-HIV-1_HeavyChain
  source 1..399: mol_type = other RNA
gaggtgcacctccaggagagcggccccgggctggtccgcccgctggagaccctgtccctgacctgcacggccagcggcgcctccatccgcgggggcgagtggggcgacaacgactaccactgggggtgggtgcggcacagccccgagaagggcctggagtggatcgggtccatccactggcggggcaccacccactacaacgcgcccttccgcgggcgggccaccctgagcatcgacacgtcccgcaaccagttcttcctccggctgaccagcatgaccgccgacgacaccgccgtgtactactgcgtcaagcacaagtaccacgacatcgtgatggtggtccccatcgccggctggttcgacccgtgggggcagggcctccaggtgacggtgtccgcg

SEQ ID NO: 10480 - RNA, 399 nt, synthetic construct
  misc_feature 1..399: note = derived and/or modified sequence opt1 from anti-HIV-1_HeavyChain
  source 1..399: mol_type = other RNA
gaggtgcacctccaggagagcggccccgggctcgtccgcccgctggagaccctgtccctgacctgcacggccagcggcgcctccatccgcgggggcgagtggggcgacaacgactaccactgggggtgggtgcggcacagccccgagaagggcctggagtggatcgggtccatccactggcggggcaccacccactacaacgcgcccttccgcgggcgggccaccctgagcatcgacacgtcccgcaaccagttcttcctccggctgaccagcatgaccgccgacgacaccgccgtgtactactgcgtcaagcacaagtaccacgacatcgtgatggtggtccccatcgccggctggttcaacccgtgggggcagggcctgcaggcgacggtgccctcc

SEQ ID NO: 10481 - RNA, 399 nt, synthetic construct
  misc_feature 1..399: note = derived and/or modified sequence opt1 from anti-HIV-1_HeavyChain
  source 1..399: mol_type = other RNA
caggtgcagctgaaggagagcggccccgggctcgtcaagccgtccgagaccctgagcctgacctgcacggtgtccggcgggagcatgcgcggcaccgactggggcgagaacgacttccactacgggtggatccggcactccagcgccgagggcctcgagtggatcgggtccatccactggcgcggcaccacccactacaagatgagcttccggtcccgcgccacgatcagcatcgacacctccaacaaccggttcagcctgatgttctccttcgtgaccgcggaggacaccgccgtctactactgcgcccgccacaagtaccacgacatcttccgggtggtgcccgtcgccgggtggttcgacccctggggccaggggctgctcgtgacggtgagctcc

SEQ ID NO: 10482 - RNA, 399 nt, synthetic construct
  misc_feature 1..399: note = derived and/or modified sequence opt1 from anti-HIV-1_HeavyChain
  source 1..399: mol_type = other RNA
gaggtgcacctccaggagagcggccccgggctcgtccgcccgctggagaccctgtccctgacctgcacggccagcggcgcctccatccgcgggggcgagtggggcgacaacgactaccactgggggtgggtgcggcacagccccgagaagggcctggagtggatcgggtccatccactggcggggcaccacccactacaacgcgcccttccgcgggcgggccaccctgagcatcgacacgtccaagaaccagttcagcctccgcctgacctccatgaccgccgacgacaccgccgtgtactactgcgtcaagcacaagtaccacgacatcgtgatggtggtccccttcgccggctggttcgacccgtgggggcagggcctgcgggtgacggtgagcgcg

SEQ ID NO: 10483 - RNA, 399 nt, synthetic construct
  misc_feature 1..399: note = derived and/or modified sequence opt1 from anti-HIV-1_HeavyChain
  source 1..399: mol_type = other RNA
gaggtgcacctccaggagagcggccccgggctcgtccgcccgctggagaccctgtccctgacctgcacggccagcggcgcctccatccgcgggggcgagtggggcgacaacgactaccactgggggtgggtgcggcacagccccgagaagggcctggagtggatcgggtccatccactggcggggcaccacccactacaacgcgcccttccgcgggcgggccaccctgagcatcgacacgtccaagaaccagttcttcctccgcctgaccagcatgaccgccgacgacaccgccgtgtactactgcgtcaagcacaagtaccacgacatctgcatggtggtgcccatcgccggctggttcgacccgtgggggcagggcctgcaggtcacggtgtcccag

SEQ ID NO: 10484 - RNA, 399 nt, synthetic construct
  misc_feature 1..399: note = derived and/or modified sequence opt1 from anti-HIV-1_HeavyChain
  source 1..399: mol_type = other RNA
caggtgcacctccaggagagcggccccgggctggtccgcccgctggagaccctgtccctgacctgcacggccagcggcgcctccatccgcgggggcgagtggggcgacaacgactaccactgggggtgggtgcggcacagccccgagaagggcctggagtggatcgggtccatccactggcggggcaccacccactacaacgcgcccttccgcgggcgggccaccctgagcatcgacacgtcccgcaaccagttcttcctccggctgaccagcatgaccgccgacgacaccgccgtgtactactgcgtcaagcacaagtaccacgacatcgtgatggtggtccccatcgccggctggttcgacccgtgggggcagggcctccaggtgacggtgtccagc

SEQ ID NO: 10485 - RNA, 399 nt, synthetic construct
  misc_feature 1..399: note = derived and/or modified sequence opt1 from anti-HIV-1_HeavyChain
  source 1..399: mol_type = other RNA
caggtgcacctccaggagagcggccccgggctcgtccgcccgctggagaccctgtccctgacctgcacggccagcggcgcctccatccgcgggggcgagtggggcgacaacgactaccactgggggtgggtgcggcacagccccgagaagggcctggagtggatcgggtccatccactggcggggcaccacccactacaacgcgcccttccgcgggcgggccaccctgagcatcgacacgtcccgcaaccagttcttcctccggctgaccagcatgaccgccgacgacaccgccgtgtactactgcgtcaagcacaagtaccacgacatcgtgatggtggtccccatcgccggctggttcgacccgtgggggcagggcctgcgcgtgacggtgtcccag

SEQ ID NO: 10486 - RNA, 399 nt, synthetic construct
  misc_feature 1..399: note = derived and/or modified sequence opt1 from anti-HIV-1_HeavyChain
  source 1..399: mol_type = other RNA
caggtgcacctccaggagagcggccccgggctggtccgcccgctggagaccctgtccctgacctgcacggccagcggcgcctccatccgcgggggcgagtggggcgacaacgactaccactgggggtgggtgcggcacagccccggcaaggggctggagtggatcggctccatccactggcgggggaccacccactacaacgcgcccttccgcggccgggccaccctgagcatcgacacgttccgcaaccagttcttcctccggctgacctccatgaccgccgacgacaccgccgtgtactactgcgtcaagcacaagtaccacgacatcgtgatggtggtccccatcgccgggtggttcgacccgtggggccagggcctccaggtgacggtgagccag

SEQ ID NO: 10487 - RNA, 399 nt, synthetic construct
  misc_feature 1..399: note = derived and/or modified sequence opt1 from anti-HIV-1_HeavyChain
  source 1..399: mol_type = other RNA
gaggtgcacctccaggagagcggccccgggctcgtccgcccgctggagaccctgtccctgacctgcacggccagcggcgcctccatccgcgggggcgagtggggcgacaacgactaccactgggggtgggtgcggcacagccccgagaagggcctggagtggatcgggtccatccactggcggggcaccacccactacaacgcgcccttccgcgggcgggccaccctgagcatcgacacgtcccgcaaccagttcttcctccggctgaccagcatgaccgccgacgacaccgccgtgtactactgcgtcaagcacaagtaccacgacatcgtgatggtggtccccatcgccggctggttcgacccgtgggggcagggcctgcgcggcacggtgtccgcg

SEQ ID NO: 10488 - RNA, 393 nt, synthetic construct
  misc_feature 1..393: note = derived and/or modified sequence opt1 from anti-HIV-1_HeavyChain
  source 1..393: mol_type = other RNA
caggtgcagctggtccagagcggcgccgtgatcaagacccccgggtccagcgtgaagatctcctgccgcgccagcggctacaacttccgggactactccatccactgggtccgcctcatcccggacaaggggttcgagtggatcggctggatcaagcccctgtggggcgcggtgagctacgcccggcagctgcaggggcgcgtgtccatgacccggcagctcagccgcgaccccgacgaccccgactggggcgtcgcctacatggagttctccgggctgacgccggccgacaccgccgagtacttctgcgtgcggcgcggcagctgcgactactgcggggacttcccctggcagtactggggccaggggaccgtggtcgtggtgtccagcgcg

SEQ ID NO: 10489 - RNA, 393 nt, synthetic construct
  misc_feature 1..393: note = derived and/or modified sequence opt1 from anti-HIV-1_HeavyChain
  source 1..393: mol_type = other RNA
caggtgcagctggtccagagcggcgccgtgatcaagacccccgggtccagcgtgaagctctcctgccgcgccagcggctacaacttccgggactactccatccactgggtccgcctgatcccggacaaggggttcgagtggatcggctggatcaagcccctgtggggcgcggtgagctacgcccggcagctccaggggcgcgtgtccatgacccggcagctgagccaggaccccgacgaccccgactggggcgtcgcctacatggagttctccgggctgacgccggccgacaccgccgagtacttctgcgtgcgccggggcagctgcgactactgcggggacttcccctggcagtactggggccaggggaccgtggtcgtggtgtccagcgcg

SEQ ID NO: 10490 - RNA, 303 nt, synthetic construct
  misc_feature 1..303: note = derived and/or modified sequence opt1 from anti-HIV-1_LightChain
  source 1..303: mol_type = other RNA
accgccggcctgacccagagccccgggacgctctccctgagcccgggcgagcgcgccatcctgtcctgccggaccagccagtacgggtccctcgcctggtaccagcagcgccccggccaggcgccccggctggtgatctacgccgggctgacccgcgccaccggcatccccgaccggttcagcggctcccgctggggcgccgagtacaacctcacgatcagcaacctggagtccgaggacttcggggtgtactactgccagcagtacgacttcttcgggcagggcaccaaggtccaggtggac

SEQ ID NO: 10491 - RNA, 378 nt, synthetic construct
  misc_feature 1..378: note = derived and/or modified sequence opt1 from anti-HIV-1_HeavyChain
  source 1..378: mol_type = other RNA
caggtgcagctggtccagagcggctccggggtgaagaagctcggcgccagcgtgcgcgtctcctgctggaccagcgaggacatcttcgagcggaccgagctgatccactgggtgcgccaggcccccgggcagggcctggagtggatcgggtgggtgaaggcggtctccggcgccgtgaactacggcagcctcgacttccggcaccgcgtgtccctgacgcgggaccgcgacctgagcaccgcccacatggacatccgggggctcacccaggacgacaccgccacgtacttctgcgcccgccagaagttcgcgcggggcgaccaggggtggttcttcgacctgtggggccgcgggaccctgatcgtcgtgtccagcgcc

SEQ ID NO: 10492 - RNA, 384 nt, synthetic construct
  misc_feature 1..384: note = derived and/or modified sequence opt1 from anti-HIV-1_HeavyChain
  source 1..384: mol_type = other RNA
caggtgcagctggtccagagcggctccggggtgaagaagctcggcgccagcgtgcgcgtctcctgctggaccagcgaggacatcttcgagcggaccgagctgatccactgggtgcgccaggcccccgggcagggcctggagtggatcgggtgggtgaaggcggtcacgggcaccgtgaacttcggctccctcaacttccggcagcgcgtgagcctgacccgggaccgcgacctgttcaccgcccacatggacatccgggggctcacgcagggcgacaccgccacctacttctgcgcccgccagaagttcgagaagtacaccgggggccaggggtggtacttcgacctgtggggccggggcacgctgatcgtcgtgtccagcgcc

SEQ ID NO: 10493 - RNA, 378 nt, synthetic construct
  misc_feature 1..378: note = derived and/or modified sequence opt1 from anti-HIV-1_HeavyChain
  source 1..378: mol_type = other RNA
caggtgcagctggtccagagcggctccgccatgaagaagcccggggccagcgtgcgcgtgtcctgctggaccagcgaggacatcttcgacaccacggagctcatctactgggtccggcaggcgccgggccaggggctggagtggatcggctgggtgaagatcgtgtccgggaccgtcaacttcgccagcctggacttccgcaaccggatctccctcagccgcgaccgggacctgttcaccgcccacatggacatccgcggcctgacccagggcgacacggccacctacttctgcgcccggcagaagttctacgccgggggccaggggtggtacttcgacctctggggccgcgggaccctgatcgtggtgtccagcgcg

SEQ ID NO: 10494 - RNA, 387 nt, synthetic construct
  misc_feature 1..387: note = derived and/or modified sequence opt1 from anti-HIV-1_HeavyChain
  source 1..387: mol_type = other RNA
caggtgcagctggtccagagcggcgccgaggtgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgagtcccgctacaccggcgggcagggctggtacttcgacctctgggggcggggcacccacatcgtggtcagctccgcg

SEQ ID NO: 10495 - RNA, 387 nt, synthetic construct
  misc_feature 1..387: note = derived and/or modified sequence opt1 from anti-HIV-1_HeavyChain
  source 1..387: mol_type = other RNA
caggtgcagctggtccagagcggctccgccatgaagaagcccggggccagcgtgcgcgtgtcctgctggaccagcgaggacatcttcgagcggaccgagctcatctactgggtccgccaggcgccgggccgggggctggagtggatcggctgggtgaagacggtgtccgggaccgtcaacttcggcagctccgacttccgcaaccggatcagcctgacccgcgaccgggacctctccaccgcccacatggacatccgcggcctgacgcaggacgacaccgccacctacttctgcgcccggcagaagttcgagagcctgtactccgacgaccaggggagctacttcgacctctggggccgcgggaccctgatcatcgtgtccagcgcc

SEQ ID NO: 10496 - RNA, 387 nt, synthetic construct
  misc_feature 1..387: note = derived and/or modified sequence opt1 from anti-HIV-1_HeavyChain
  source 1..387: mol_type = other RNA
caggtgcagctggtccagagcggcctcgaggtgaagaagcccggggcctccgtgcgcgtcagctgctggacctccgaggacatcttcgacaccacggagctgatctactgggtgcggcaggccccgggccaggggctggagtggatcggctgggtgaagatcgtcagcgggaccgtgaacttcgcgtccctcgacttccgcaaccggatcagcctgtcccgcgaccgggacctgagcaccgcccacatggacatccgcggcctcacccaggacgacacggccacctacttctgcgcccggcagaagttcgcctcccgctacagcggcgaccaggggtcctacttcgacctgtggggccgggggaccctgatcatcgtgagctccgcg

SEQ ID NO: 10497 - RNA, 387 nt, synthetic construct
  misc_feature 1..387: note = derived and/or modified sequence opt1 from anti-HIV-1_HeavyChain
  source 1..387: mol_type = other RNA
caggtgcagctggtccagagcgcctccggcgtgcgccggcccggggccagcgtgcgcgtctcctgctggaccagcgaggacatcttcgagcggtccgagctcatctactgggtgcgccaggcgccgggccgggggctggagtggatcggctggatcaagctggtgagcggggccgtcaacttcggctccgtggacttccgcgaccgggtgagcctcacccgcgaccgggacctgttcacggcccacatggacatccgcggcctgacccaggacgacaccgccacctacttctgcgcccggcagaagttcgcgtcccgctacagcggggaccagggctcctacttcgacctctgggggcggggcacgctgatcatcgtcagctccgcc

SEQ ID NO: 10498 - RNA, 375 nt, synthetic construct
  misc_feature 1..375: note = derived and/or modified sequence opt1 from anti-HIV-1_HeavyChain
  source 1..375: mol_type = other RNA
caggtgcagctggtccagagcggctccggggtgaagaagcccggcgccagcgtgcgcgtctcctgctggaccagcgaggggatcttcgagaagtccgagctcatccactgggtgcggcaggccccgggccaggggctggagtggatcggctgggtgaagaccgtcacgggcgcggtgaacttcgggcaccagatcagcgaccgcgtgtccctgacccgggaccgcgacctcttcaccgcccacatggacatccggggcctgacccagggggacacggccacctacttctgcgcccgccagaagttcgagcggggcgggcagggctggatcttcgacctgtggggccgcgggaccctcatcgccgtcagctccgcg

SEQ ID NO: 10499 - RNA, 378 nt, synthetic construct
  misc_feature 1..378: note = derived and/or modified sequence opt1 from anti-HIV-1_HeavyChain
  source 1..378: mol_type = other RNA
caggtgcagctggtccagagcggcgccgaggtgaagaagcccggggcctccgtgcgcgtcagctgctggacctccgaggacatcttcgagaagtccgagctcatccactgggtgcggcaggcgccgggccaggggctggagtggatcggctgggtgaagaccgtcacgggggccgtgaacttcggcagcagcgacttccgccagcgggtgtccctgacccgcgaccgggacctcttcaccgcccacatggacatccgcggcctgacccagggggacacggccacctacttctgcgcccggcagaagttcgagcgcggcgggcagggctggtacttcgacctgtgggggcggggcaccctcatcgtcgtgagctccgcg

SEQ ID NO: 10500 - RNA, 378 nt, synthetic construct
  misc_feature 1..378: note = derived and/or modified sequence opt1 from anti-HIV-1_HeavyChain
  source 1..378: mol_type = other RNA
caggtgcagctggtccagagcggcgccgaggtgaagcgccccggggcctccgtgaaggtcagctgctggacctccgaggacatcttcgagcggaccgagctcatccactgggtgcgccaggcgccgggccaggggctggagtggatcggctgggtgaagacggtcagcggggccgtgaacttcggctcccccaacttccggcaccgcgtgagcctgacccgggaccgcgacctcttcaccgcccacatggacatccggggcctgacccagggggacacggccacctacttctgcgcccgccagaagttcgagcggggcgggcagggctggtacttcgacctgtgggggcgcggcaccctcatcgtcgtgtccagcgcg

SEQ ID NO: 10501 - RNA, 378 nt, synthetic construct
  misc_feature 1..378: note = derived and/or modified sequence opt1 from anti-HIV-1_HeavyChain
  source 1..378: mol_type = other RNA
caggtgcagctggtccagagcggctccggggtgaagaagcccggcgccagcgtgcgcgtctcctgctggaccagcgaggacatcttcgaggggtccgagctcatccactgggtgcggcaggccccgggccaggggctggagtggatcggctgggtgaagaccgtcacgggcgcggtgaacttcgggagcgcctacttccgccaccgggtgtccctgacccgcgaccgggacctcttcaccgcccacatggacatccgcggcctgacccagggggacacggccacctacttctgcgcccggcagaagttcatgagcggcgggcagggctggtacttcgacctgtggggccgcgggaccgtcatcgtggtgtccagcgcg

SEQ ID NO: 10502 - RNA, 387 nt, synthetic construct
  misc_feature 1..387: note = derived and/or modified sequence opt1 from anti-HIV-1_HeavyChain
  source 1..387: mol_type = other RNA
caggtgcagctggtccccagcggctccggggtgaagaagccgggcgccagcgtgcgcgtctcctgctggaccagcgaggacatcttcgagcggaccgagctcatccactgggtgcgccaggcccccgggcagggcctggagtggatcgggtgggtgaagacggtcaccggcgcggtgaacttcggctccctggacttccggcaccgcatcagcctcacccgggaccgcgacctgttcaccgcccacatggacatccgggggctgacgcagggcgacaccgccacctacttctgcgcccgccagaagttcgagtcccggtacaccgggggccaggggtggtacttcgacctctggggccgcggcacgcacatcgtggtcagctccgcc

SEQ ID NO: 10503 - RNA, 378 nt, synthetic construct
  misc_feature 1..378: note = derived and/or modified sequence opt1 from anti-HIV-1_HeavyChain
  source 1..378: mol_type = other RNA
caggtgcagctggtccagagcggctccggggtgaagaaggtgggcgccagcgtccgcgtgtcctgctggaccagcgaggacatcttcgagcggaccgagctcatccactgggtgcgccaggcccccgggcagggcctggagtggatcgggtgggtcaaggcggtgtccggcgccgtgaactacggcagcctggacttccggcaccgcgtctccctcacgcgggaccgcgacctgttcaccgcccacatggacatccgggggctgacccaggacgacaccgccatctacttctgcgcccgccagaagttctacgcgggcgggcagggctggtacttcgacctctgggggcggggcacgctgatcgtggtgagctccgcc

SEQ ID NO: 10504 - RNA, 387 nt, synthetic construct
  misc_feature 1..387: note = derived and/or modified sequence opt1 from anti-HIV-1_HeavyChain
  source 1..387: mol_type = other RNA
caggtgcagctggtccagagcggcgccgaggtgaagaagcccgggtccagcgtgcgcgtctcctgctggaccagcgaggacatcttcgagcggaccgagctcatccactgggtgcgccaggccccgggccaggggctggagtggatcggctgggtgaagacggtcaccggggcggtgaacttcggctcccccaacttccggcaccgcgtgagcctgacccgggaccgcgacctcttcaccgcccacatggacatccggggcctgacgcagggggacaccgccacctacttctgcgcccgccagaagttcgagtcccggtacagcggcgaccaggggtcctacttcgacctgtggggccgcgggaccctcatcatcgtcagctccgcc

SEQ ID NO: 10505 - RNA, 375 nt, synthetic construct
  misc_feature 1..375: note = derived and/or modified sequence opt1 from anti-HIV-1_HeavyChain
  source 1..375: mol_type = other RNA
caggtgcagctggtccagagcggcgccgaggtgaagaagcccggggcctccgtgaaggtcagctgcaaggcgtccggctacaccttcaccagctactacatgcactgggtgcgccaggccccggggcagggcctcgagtggatcgggtgggtgaagcccgtcacgggcgccgtgaacttcggctcccccaacttccggcaccgcgtgagcctgacccgggaccgcgacctgttcaccgcccacatggacatccgggggctcacccagggcgacacggccacctacttctgcgcgcgccagaagtactacgccgggggccaggggtggtacttcgacctgtggggccggggcaccctgatcgtcgtgtccagcgcc

SEQ ID NO: 10506 - RNA, 375 nt, synthetic construct
  misc_feature 1..375: note = derived and/or modified sequence opt1 from anti-HIV-1_HeavyChain
  source 1..375: mol_type = other RNA
caggtgcagctggtccagagcggcgccgaggtgaagaagcccggggcctccgtgcaggtcagctgcaaggcgtccggctacccgttcaccaagtactacatgcactgggtgcgccaggcccccgggcagggcctcgagtggatcgggtgggtgaaggccgtcagcggcgccgtgaactacggctccctggacttccggcaccgcgtgagcctgacccgggaccgcgacctctccacggcccacatggacatccgggggctgacccaggacgacaccgcgacctacttctgcgcccgccagaagttcgcccggggcgaccaggggtggttcttcgacctgtggggccgcgggacgctcatcgtcgtgagctccgcc

SEQ ID NO: 10507 - RNA, 375 nt, synthetic construct
  misc_feature 1..375: note = derived and/or modified sequence opt1 from anti-HIV-1_HeavyChain
  source 1..375: mol_type = other RNA
caggtgcagctggtccagagcggcgccgaggtgaagaagcccggggcctccgtgaaggtcagctgcaaggcgtccggctacaccttcaccgggtactacatgcactgggtgcgccaggccccgggccaggggctcgagtggatcggctgggtgaagacggtcagcggcgccgtgaacttcgggtccctgaacttccggcaccgcgtgagcctgacccgggaccgcgacctcttcaccgcccacatggacatccggggcctgacccagggggacacggccacctacttctgcgcgcgccagaagttcgcccggggcgaccaggggtggttcttcgacctgtggggccgcggcaccctcatcgtcgtgtccagcgcc

SEQ ID NO: 10508 - RNA, 402 nt, synthetic construct
  misc_feature 1..402: note = derived and/or modified sequence opt1 from anti-HIV-1_HeavyChain
  source 1..402: mol_type = other RNA
caggtgcagctggtccagagcggctccggggtgaagaagcccggcgccagcgtgcgggtctcctgccgggccagcgaggacctcttcggggacgagatcatctacgacgacgaggtgatccactggctgcgccaggtgccgggccagcggcccgagtggatggggtggatccgccccaagaccggcgcgcggaaccaggcccgccagttccagccccggatctccctgacccgcgaccgggccctcagcacggcctacctggacctgaactccctcaccagcgccgactccggcacctacttctgcgcgcgccagaccttcaagccggacttctacttcgccgaccaggggtggagcttcaacctgtggggccgcggggcccacttcatcgtctccagcgcc

SEQ ID NO: 10509 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgggggcgtgaagaagcccggggcctccgccagcttctcctgccgcaccagcgaggacccgttcgacaacgagttcttcgactccgagttcatgcactgggtgcggctcacccccggccagcgccccgagtggatggggtggatgaacccccggagcggcggcgtcaactacgcggggcagttccgcccgcggatgtccatgtggcgcgaccgggagctgagcacggcctacatggagctgcgcgacctcaccttcgccgacaccggcctgtacttctgcgcccggcgcaaggaggacgactacgactggtactacgacctgtgggggcggggcgcccacatcatcgtgtccgcggcc

SEQ ID NO: 10510 - RNA, 384 nt, synthetic construct
  misc_feature 1..384: note = derived and/or modified sequence opt1 from anti-HIV-1_HeavyChain
  source 1..384: mol_type = other RNA
caggtgcagctggtccaggccggcgggggcgtgaagaagcccggggccagcgtgaccctctcctgcaagaccgcggacgaggacgtcttcgacgccgcctacatgcactgggtgcgccaggccccgggccagacgttcgagtggctggggtggatgaagcccgtgaccggcgccgtcaactacgcgcggaagttccagggccgcgtgagcttctaccggacccgcgagctggggatcgcctacatggacctccggaacctgcgcttcgacgacaccgccgtgtacttctgcgcccggaagacggcgggcgacgtctccggggacaagcgcggcttcttcttcgacctgtgggggcggggcagccgcgtgatcgtgtccagcgcc

SEQ ID NO: 10511 - RNA, 384 nt, synthetic construct
  misc_feature 1..384: note = derived and/or modified sequence opt1 from anti-HIV-1_HeavyChain
  source 1..384: mol_type = other RNA
caggtgcagctggtccagagcggcgccgaggtgaagaagcccggggcctccgtgaccctcagctgcaagaccgcggacgaggacgtcttcgacgccgcctacatgcactgggtgcgccaggccccgggccagacgttcgagtggctggggtggatgaagcccgtgaccggcgccgtctcctacgcgcggaagttccaggggcgcgtgagcttctacatgacccgggagctgggcatggcctacatggacctccgcaacctgcggttcgacgacaccgccgtgtacttctgcgcccgcaagacggcgggcgacgtctccggggacaaccggggctacttcttcgacctgtgggggcgcggcagccgggtgatcgtgtccagcgcc

SEQ ID NO: 10512 - RNA, 384 nt, synthetic construct
  misc_feature 1..384: note = derived and/or modified sequence opt1 from anti-HIV-1_HeavyChain
  source 1..384: mol_type = other RNA
caggtgcagctggtccagagcgaggccgaggtgaagaagcccggcgcctccatgaccgtgagctgcgagaccgcggacgaggacatcttcgacgccgcctacatgcactgggtccgccaggccccggggcagacgttcgagtggctcggctggatgaagcccgtgaccggggccgtgaactacgcgcggaagttccagggccgcatctccttctaccggacccgcgagctggccatcgcctacatggacctgcgggacctccgcttcgacgacaccgccgtctacttctgcgcgcggaagacggccggggacgtgagcggcgacaaccgcggctacttcttcgacctgtgggggcggggctcccgcgtgatcgtcagctccgcc

SEQ ID NO: 10513 - RNA, 420 nt, synthetic construct
  misc_feature 1..420: note = derived and/or modified sequence opt1 from anti-HIV-1_HeavyChain
  source 1..420: mol_type = other RNA
cagagccacctggagcagtccggcagcgccatgaagaagcccggggcctccgtgcgcgtcagctgctggacctccgaggacatcttcgacaccacggagctcctgtgggtgcggcaggcgccgggccaggggctggagtggatcggctgggtgaagatcgtcagcgggaccgtgaacttcgcctccctcgacttccgcaaccggatcagcctgtcccgcgaccgggacctgagcaccgcccacatggacatccgcggcctcacccaggacgacacggccacctactactgcgcccggcagaagttcgcgtcccgctacagcggcgaccaggggtcctacttcgacctgtggggccgggggaccctgatcatcgtgagctccgccagcaccaagggcccctccgtcttcccccacgacctc

SEQ ID NO: 10514 - RNA, 417 nt, synthetic construct
  misc_feature 1..417: note = derived and/or modified sequence opt1 from anti-HIV-1_HeavyChain
  source 1..417: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgcccggccgggggctggagtggatcggctgggtgaagacggtcagcgggaccgtgaacttcggctccagcgacttccgcaaccggatctccctgacccgcgaccgggacctcttcaccgcccacatggacatccgcggcctgacgcagggggacaccgccacctacttctgcgcccggcagaagttcgagcgcggcgggcagggctggtacttcgacctgtgggggcggggcaccctcatcgtggtcagctccgccagcacgaacggccccatcgggctgccgccccgctccgcg

SEQ ID NO: 10515 - RNA, 423 nt, synthetic construct
  misc_feature 1..423: note = derived and/or modified sequence opt1 from anti-HIV-1_HeavyChain
  source 1..423: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagtccctgtacagcgacgaccaggggtcctacttcgacctctggggccgcgggaccctgatcatcgtgagctccgcgagcaccaagggcccctccagctcccccacgatctgc

SEQ ID NO: 10516 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgagcgcgggggccaggggtggtacttcgacctgtggggccggggcaccctcatcgtggtgagctccgcgagcaccaaggggccctccgtcttcccccacgacctgcgg

SEQ ID NO: 10517 - RNA, 411 nt, synthetic construct
  misc_feature 1..411: note = derived and/or modified sequence opt1 from anti-HIV-1_HeavyChain
  source 1..411: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgagcgcgggggccaggggtggtacttcgacctgtggggccggggcaccctcatcgtggtgagctccagcctgcaccaggggccctccggcctgccccacgac

SEQ ID NO: 10518 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgtccagcgcgtccaccaaggggcccagcgtcttcccccacgacctgcgg

SEQ ID NO: 10519 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctactactgcgcccgccagaagttcgagagcctgtactccgacgaccaggggagctacttcgacctctggggccgggggaccctgatcatcgtgtccagcgcgtccaccaagggccccagcgtgttcccccacgacctgcgc

SEQ ID NO: 10520 - RNA, 384 nt, synthetic construct
  misc_feature 1..384: note = derived and/or modified sequence opt1 from anti-HIV-1_HeavyChain
  source 1..384: mol_type = other RNA
caggtgcacctggagcagagcggctccggggtcaagaagcccggcgccagcgtgcgcgtgtcctgctggaccagcgaggacatcttcgagaagtccgagctcatccactgggtccggcaggccccggggcagggcctggagtggatcgggtgggtgaagaccgtgacgggcgcggtcaacttcggcagctccgacttccgccagcgggtgagcctgacccgcgaccgggacctcttcaccgcccacatggacatccgcgggctgacccagggcgacacggccacctacttctgcgcccggcagaagttcgagtcccgctacaccgggggccaggggtggtacttcgacctgtggggccggggcacccacatcgtggtcagctcc

SEQ ID NO: 10521 - RNA, 423 nt, synthetic construct
  misc_feature 1..423: note = derived and/or modified sequence opt1 from anti-HIV-1_HeavyChain
  source 1..423: mol_type = other RNA
caggtgtacatggagcaggccggcgccggggtcaagaagcccggcgcgagcgtgaccctgtcctgcaagaccgccgacgaggacgtgttcgacgccgcctacatgcactgggtccgccaggccccggggcagacgttcgagtggctcggctggatgaagcccgtgaccggggcggtgaactacgcccggaagttccagggccgcgtcagcttctaccggacccgcgagctgggcatcgcctacatggacctgcggaacctccgcttcgacgacaccgccgtgtacttctgcgcgcggaagacggccggggacgtgtccggcgacaagcgcgggttcttcttcgacctgtggggccgggggagccgcgtcatcgtgtccagcgcctccaccaagggccccagcgtgttcccccacgacctgcgg

SEQ ID NO: 10522 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcaccagcgtccgcgtgtcctgctggaccagcgaggacatcttcgagcggacggagctcatccactgggtgcgccaggccccggggcagggcctggagtggatcgggtgggtcaagaccgtgaccggcgcggtgaacttcggctcccccaacttccggcaccgcgtcagcctgacccgggaccgcgacctcttcacggcccacatggacatccgggggctgacccagggcgacaccgccacctacttctgcgcccgccagaagttcgcccgcggggaccagggctggttcttcgacctgtgggggcggggcacgctcatcgtggtgtccagcgcgtccaccaagggccccagcgtcttccccaccatctgc

SEQ ID NO: 10523 - RNA, 411 nt, synthetic construct
  misc_feature 1..411: note = derived and/or modified sequence opt1 from anti-HIV-1_HeavyChain
  source 1..411: mol_type = other RNA
caggtgcagctggtccagagcggcgccgaggtgaagaagcccggggcctccgtgaaggtcagctgcaaggcgtccggctacaccttcaccagctactacatgcactgggtgcgccaggccccggggcagggcctcgagtggatcgggtgggtgaagcccgtcacgggcgccgtgaacttcggctcccccaacttccggcaccgcgtgagcctgacccgggaccgcgacctgttcaccgcccacatggacatccgggggctcacccagggcgacacggccacctacttctgcgcgcgccagaagtactacgccgggggccaggggtggtacttcgacctgtggggccggggcaccctgatcgtcgtgtccagcgcctccaccaaggggcccgtggtcttcccgacgatctgc

SEQ ID NO: 10524 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaagttccagggccgcgtcagcttctaccggacccgcgagctggggatcgcctacatggacctgcggaacctccgcttcgacgacaccgccgtgtacttctgcgcccggaagacggcgggcgacgtgtccggggacaagcgcggcttcttcttcgacctgtgggggcggggcagccgcgtcatcgtgtccagc

SEQ ID NO: 10525 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtggatcaagacggtcaccggcgccgtgaacttcggctccctggacttccggcaccgcatcagcctcacccgggaccgcgacctgttcaccgcccacatggacatccgggggctgacgcagggcgacaccgccacctacttctgcgcccgccagaagttcgagtcccggtacaccgggggccaggggtggtacttcgacctctggggccgcggcacgcacatcgtggtcagctcc

SEQ ID NO: 10526 - RNA, 420 nt, synthetic construct
  misc_feature 1..420: note = derived and/or modified sequence opt1 from anti-HIV-1_HeavyChain
  source 1..420: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgagcgcgggggccaggggtggtacttcgacctgtggggccgggggaccctcatcgtggtctccagcgcctccacggagggccccagccgctccttcccccagatcctgcgg

SEQ ID NO: 10527 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatctgcgtgtccagcgcgagcccccgggcccaccgctccagcccccggtccgcc

SEQ ID NO: 10528 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccgcggcgacacggccacctactactgcgcccggcagaagttcgagagccgctacaccgggggccaggggtggtacttcgacctctggggccggggcacccacatcgtcgtgtccagc

SEQ ID NO: 10529 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcatcgtctccagc

SEQ ID NO: 10530 - RNA, 423 nt, synthetic construct
  misc_feature 1..423: note = derived and/or modified sequence opt1 from anti-HIV-1_HeavyChain
  source 1..423: mol_type = other RNA
cagagccacctggagcagtccggcagcgccatgaagaagcccggggcctccgtgcgcgtcagctgctggacctccgaggacatcttcgacaccacgagcatcttcatcggctgcgaccggccgctcgacaaggactggtccgggctgggcgggagcaagctgtccctcgcgcccagcatcttcgcctccctggacttccgcaaccggatcagcctgtcccgcgaccgggacctcagcaccgcctacatggacatccgcggcctgacccaggacgacaccgccacgtacttctgcgcccggcagaagttcgcgtcccgctacagcggcgaccaggggtcctacttcgacctgtggggccgggggaccctcatcgtggtgagctccgccagcaccaagggccccagcgtcttcccccacgacctg

SEQ ID NO: 10531 - RNA, 399 nt, synthetic construct
  misc_feature 1..399: note = derived and/or modified sequence opt1 from anti-HIV-1_HeavyChain
  source 1..399: mol_type = other RNA
cgcgagtacctggagcagagcggcgggggcgtgaagaagctcggggcctccgtccgggtgagctgccgcgcctccgaggacctgttcggcgacgaggtgatctacgacgacgagctgatccactggctccggcaggtccccgggcagcgcccggagtggatgggctggatccggcccaagaccggcgcgcgcaaccaggcccggcagttccagccccgcatcaacctgagccgggaccgcgccctgaacaccgcctacctcgacctgtccagcctgacgtccgccgacagcgcgacctacttctgcgcccggcagaccttcaagcccgacttctacttcgccgaccaggggtggtccttcaacctctggggccgcggggcccgggtgatcgtgagctcc

SEQ ID NO: 10532 - RNA, 384 nt, synthetic construct
  misc_feature 1..384: note = derived and/or modified sequence opt1 from anti-HIV-1_HeavyChain
  source 1..384: mol_type = other RNA
caggtgcacctggtccagagcggcgccgaggtgaagaagcccgggtccagcgtgcgcgtctcctgctggaccagcgaggacatcttcgagcggaccgagctcatccactgggtgcgccaggccccgggccaggggctggagtggatcggctgggtgaagacggtcaccggggcggtgaacttcggctcccccaacttccggcaccgcgtgagcctgacccgggaccgcgacctcttcaccgcccacatggacatccggggcctgacgcagggggacaccgccacctacttctgcgcccgccagaagttcgagtcccggtacagcggcgaccaggggtcctacttcgacctgtggggccgcgggaccctcatcatcgtcagctcc

SEQ ID NO: 10533 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgcggtgagctccgccagcaccaaggggccctccgtgttccccaccatctgc

SEQ ID NO: 10534 - RNA, 441 nt, synthetic construct
  misc_feature 1..441: note = derived and/or modified sequence opt1 from anti-HIV-1_HeavyChain
  source 1..441: mol_type = other RNA
cgcgagttcctggagcagagcggcgggggcgtgaagaagctcggggcctccctgcgggtcagctgccgcgcctccgaggacctgttcggcgacgagttcatctacgacgacgaggtgatccactggctccgccaggtgcccgggcagcggccggagtggatgggctggatccggcccaagaccggcgcgcgcaaccaggccacccagttccagccccggatcagcctgacgcgcgaccgggccctgtccaccgcctacctcgacctgaacagcctgacctccgccgacagcgggacctacttctgcgcgcgccagacgttcaagcccgacttctacttcgccgaccagggctggtccttcaacctctgggggcggggcgcccacttcatcgtcagctccgccagcaccaaggggccgtccgtgttcccccacgacagcgcg

SEQ ID NO: 10535 - RNA, 399 nt, synthetic construct
  misc_feature 1..399: note = derived and/or modified sequence opt1 from anti-HIV-1_HeavyChain
  source 1..399: mol_type = other RNA
cgcgagtacctggagcagagcggcgggggcgtgaagaagctcggggcctccctgcgggtcagctgccgcgcctccgaggacctgttcggcgacgagatcatctacgacgacgaggtgatccactggctccgccaggtgcccgggcagcggccggagtggatgggctggatccggcccaagaccggcgcgcgcaaccaggcccggcagttccagccccgcatcagcctgacccgggaccgcgccctgtccacggcctacctcgacctgaacagcctgacctccgccgacagcgggacctacttctgcgcgcggcagaccttcaagcccgacttctacttcgccgaccagggctggtccttcaacctctgggggcgcggcgcccacttcatcgtcagctcc

SEQ ID NO: 10536 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtcgtgtccagc

SEQ ID NO: 10537 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgagctacgcgcggaagttccagggccgcgtctccttctacatgacccgggagctggggatggcctacatggacctgcgcaacctccggttcgacgacaccgccgtgtacttctgcgcccgcaagacggcgggcgacgtgagcggggacaaccggggctacttcttcgacctgtgggggcgcggctcccgggtcatcgtgagctcc

SEQ ID NO: 10538 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggcaccggggtgaagaagcccggcgcctccgtccgcgtgagctgctggacctccgaggacatcttcgagaagtccgagctcatccactgggtgcggcaggcgccggggcagggcctggagtggatcgggtgggtcaagatcgtgagcggcgccgtgaacttcggcagccccaacttccgccagcgggtctccctgacgcgcgaccgggacctcttcaccgcccagatggacatccgcgggctgacccagggcgacaccgccacgtacttctgcgcccggcagaagttcgagcgcgggggccaggggtggatcttcgacctgtggggccggggcaccctcatcgcggtgagctccgccagcaccaaggggccctccgtgttcccccacgacctg

SEQ ID NO: 10539 - RNA, 399 nt, synthetic construct
  misc_feature 1..399: note = derived and/or modified sequence opt1 from anti-HIV-1_HeavyChain
  source 1..399: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgcccggggcgaccaggggtggttcttcgacctgtggggccgcgggaccctgatcgtggtgtccagcgcctccaccaagggcccgagcggc

SEQ ID NO: 10540 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccacgaccgggacctcttcaccgcccacatggacatccgcgggctgacgcagggcgacaccgccacctacttctgcgcccggcagaagttctacgccgggggccaggggtggtacttcgacctgtggggccgcggcaccctcatctgcgtgtccagcgcgtccacgaaggggcccagcggcctgcccccgcggtcc

SEQ ID NO: 10541 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgagtccctgtacagcgacgaccagggctcctacttcgacctgtgggggcggggcaccctcatcatcgtgagctccgccagcaccaaggggccgtccgtgttcccccacgacctgcgc

SEQ ID NO: 10542 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctactactgcgcccgccagaagttcgagcgcgggggccaggggtggtacttcgacctgtggggccggggcaccctcatcgtggtgagctccgcgagcaccaaggggccctccgtcttccccacgatctac

SEQ ID NO: 10543 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctactactgcgcccgccagaagttcgagagccggtacaccgggggccaggggtggtacttcgacctctggggccgcggcacccacatcgtcgtgtccagc

SEQ ID NO: 10544 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgaggggtccgagctcatccactgggtgcggcaggcgccgggccaggggctggagtggatcggctgggtcaagaccgtgacgggcgccgtgaacttcgggagcgcctacttccgccaccgggtctccctgacccgcgaccgggacctcttcaccgcccacatggacatccgcggcctgacccagggggacacggccacctactactgcgcgcggcagaagttctacaagggcgggcagggctggtacttcgacctgtggggccgcgggaccctcatcgtggtgagctccgccagcaccaagggcccctccgtcttccccacgatctgc

SEQ ID NO: 10545 - RNA, 399 nt, synthetic construct
  misc_feature 1..399: note = derived and/or modified sequence opt1 from anti-HIV-1_HeavyChain
  source 1..399: mol_type = other RNA
cgcgagtacctggagcagagcggcgggggcgtgaagaagcccggggcctccgtccgggtgagctgccgcgcctccgaggacctcttcggcgacgagatcatctacgacgacgaggtgatccactggctgcggcaggtcccggggcagcgccccgagtggatgggctggatccggcccaagaacggcgggcgcaaccaggcgcggcagttccagccccgcatcagcctgacccgggaccgcgccctcaacaccgcctacctggacctgaactccctcacgagcgccgactccggcacctacttctgcgcccggcagaccttcaagccggacttctacttcgcggaccaggggtggagcttcaacctgtggggccgcggggcccgggtgatcgtgtccagc

SEQ ID NO: 10546 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgcccggggcgaccaggggtggttcttcgacctgtggggccgcgggaccctgatcgtggtgtccagc

SEQ ID NO: 10547 - RNA, 420 nt, synthetic construct
  misc_feature 1..420: note = derived and/or modified sequence opt1 from anti-HIV-1_HeavyChain
  source 1..420: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgagctacgcgcggaagttccagggccgcgtctccttctacatgacccgggagctggggatggcctacatggacctgcgcaacctccggttcgacgacaccgccgtgtacttctgcgcccgcaagacggcgggcgacgtgagcggggacaaccggggctacttcttcgacctgtgggggcgcggctcccgggtcatcgtgagctccgccagcaccaagggcccctccgtgttccccaccatctgc

SEQ ID NO: 10548 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgaggggtccgagctcatccactgggtgcggcaggcgccgggccaggggctggagtggatcggctgggtcaagaccgtgacgggcgccgtgaacttcgggagcgcctacttccgccaccgggtctccctgacccgcgaccgggacctcttcaccgcccacatggacatccgcggcctgacccagagcgacacggccacctacttctgcgcgcggcagaagttctacgccgggggccaggggtggtacttcgacctgtggggccgcggcaccctcatcgtggtgtccagcgcctccaccaaggggcccagcgtcttcccccacgacctgcgg

SEQ ID NO: 10549 - RNA, 426 nt, synthetic construct
  misc_feature 1..426: note = derived and/or modified sequence opt1 from anti-HIV-1_HeavyChain
  source 1..426: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgagtccctgtacagcgacgaccaggggtcctacttcgacctctggggccgcgggaccctgatcatcgtgagctccgccagccccaagggcccctccgggctgcccccgcggagcgcg

SEQ ID NO: 10550 - RNA, 411 nt, synthetic construct
  misc_feature 1..411: note = derived and/or modified sequence opt1 from anti-HIV-1_HeavyChain
  source 1..411: mol_type = other RNA
caggtgcagctggtccagagcggcgccgaggtgaagaagcccggggcctccgtgaaggtcagctgcaaggcgtccggctacaccttcaccacgtacgggatcagctgggtgcgccaggccccgggccaggggctcgagtggatcggctgggtgaagaccgtcaccggcgccgtgaacttcgggcaccagatctccgaccgggtgagcctgacccgcgaccgggacctgttcacggcccacatggacatccgcggcctcacccagggggacaccgccacctacttctgcgcgcggcagaagttctacgccggcgggcagggctggtacttcgacctgtggggccgcgggacgctgatcgtcgtgtccagcgcctccaccaagggccccagcgtgttcccccacgacctccgg

SEQ ID NO: 10551 - RNA, 417 nt, synthetic construct
  misc_feature 1..417: note = derived and/or modified sequence opt1 from anti-HIV-1_HeavyChain
  source 1..417: mol_type = other RNA
caggcccagctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccagcgacttccggcagcgcgtctccctgacccgggaccgcgacctcttcaccgcccacatggacatccgggggctgacgcagggcgacaccgccacctacttctgcgcccgccagaagttctacgccgggggccaggggtggtacttcgacctgtggggccggggcaccctcatcgtggtgagctccgcgagcacgaaggggccctccgtcttcccccacgacctgcgc

SEQ ID NO: 10552 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctactactgcgcccgccagaagttcgagcgcgggggccaggggtggtacttcgacctgtggggccggggcaccctcatcgtggtgtccagc

SEQ ID NO: 10553 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctactactgcgcccggcagaagttcgagtcccgctacaccgggggccaggggtggtacttcgacctgtggggccggggcacccacatcgtggtgagctcc

SEQ ID NO: 10554 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtggtgtccagcgcgtccacgaaggggcccagcgtcttccccaccatctgc

SEQ ID NO: 10555 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgcagaagcccggggcctccgtgaccgtcagctgcaaggcgtccggctacaccctcatcagctacgggatctcctgggtgcgccaggccccgggccaggggcccgagtggatgggctggatccggcccaagacgggcgcccgcaaccaggcccggcagttccagccccgcatcagcctgacccgggaccgcgccctgtccaccgcgtacctcgacctgaacagcctgacctccgccgacagcgggacgtacttctgcgcccggcagaccttcaagccggacttctacttcgccgaccagggctggtccttcaacctctgggggcgcggcgcgcacttcatcgtgagctcc

SEQ ID NO: 10556 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcctccggaagaaggagctgatccactgggtgcgccaggcgccggggcagggcctggagtggatcgggtgggtcaagaccgtgacgggcaccgtgaacttcggctccagcgacttccggcagcgcgtctccctcacccgggaccgcgacctgttcaccgcccacatggacatccgggggctgacgcagggcgacaccgccacctacctctgcgcccgccagaagttcgagcgcgggggccaggggtggatcttcgacctgtggggccggggcaccctgatcgccgtgagctccgcgagcacgaaggggccctccgtgttcccccacgacctc

SEQ ID NO: 10557 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtcgtgtccagcgcgtccacgaacgggcccatcggcctgccccaccggagcgcc

SEQ ID NO: 10558 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgggaagtccgagctcatccactgggtgcggcaggcgccgggccaggggctggagtggatcggctgggtcaagaccgtgacgggcgccgtgaacttcgggagctccgacttccgccagcgggtcagcctgacccgcgaccgggacctcttcaccgcccacatggacatccgcggcctgacccagggggacacggccacctacttctgcgcccggcagaagttcgagtccctgtacagcgacgaccagggctcctacttcgacctctgggggcgcggcaccctgatcatcgtgagctcc

SEQ ID NO: 10559 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttcgagcgcgggggccaggggtggtacttcgacctgtggggccggggcaccctcatcgtggtgagctccgcgagcaccaaggggccctccggcctgccccacgggagcgcc

SEQ ID NO: 10560 - RNA, 423 nt, synthetic construct
  misc_feature 1..423: note = derived and/or modified sequence opt1 from anti-HIV-1_HeavyChain
  source 1..423: mol_type = other RNA
caggtgcagtacggccgcgaggccggggccggcatgaagaagcccggggcgagcatgaccgtctcctgcaagaccgccgacgaggacatcttcgacgccgcctacatgcaccgggtgcgccaggccccgggccagacgttcgagtggctggggtggatgaagcccgtgaccggcgcggtcaactacgcccggcagttccagggccgcgtgagcttctaccggacccgcgagctcgggatcgcctacatggacctgcgggacctgaagttcgacgacaccgccgtgtacttctgcgcgcgcaagacgaagggcgacgtctccggggacgaccggggcttcttcttcgacctctgggggcgcggcacccgggtgatcgtgagctccgccagcaccaagggcccctccgtcttccccaccatctac

SEQ ID NO: 10561 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccctggacttccggcaccgcatcagcctcacccgggaccgcgacctgttcaccgcccacatggacatccgggggctgacgcagggcgacaccgccacctacttctgcgcccgccagaagttcgagtcccggtacaccgggggccaggggtggtacttcgacctctggggccgcggcacgcacatcgtcgtgagctccgcgagcaccaaggggccctccgtgttcccccacgacctgcgg

SEQ ID NO: 10562 - RNA, 423 nt, synthetic construct
  misc_feature 1..423: note = derived and/or modified sequence opt1 from anti-HIV-1_HeavyChain
  source 1..423: mol_type = other RNA
caggtgcagctggtccagagcgaggccgagctcaagaagcccggcgcctccgtgagcgtgtcctgcaaggcgagcgggtactccttcaccagctacggcatctcctgggtccgccaggtgccggggcagggcctggagtggatcgcctggatccggcccaagaccggggcccgcaaccaggcccggcagttccagccccgcatcagcctgacgcgggaccgcgccctctccaccgcgtacctggacctgaacagcctcacctccgccgacagcggcacctacttctgcgcccggcagacgttcaagcccgacttctacttcgccgaccagggctggtccttcaacctgtgggggcgcggcgcgcacttcatcgtgagctccgccagcaccaaggggccgtccgtcttcccccacgacctgcgg

SEQ ID NO: 10563 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctactactgcgcccgccagaagttcgagcgcgggggccaggggtggtacttcgacctgtggggccggggcaccctcatcgtggtgtccagcgcgtccacgaaggggcccagcgtcttcccccacgacctg

SEQ ID NO: 10564 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgcagaagcccggggcctccgtgaccgtcagctgcaaggcgtccggctacaccctcatcagctacgggatctcctgggtgcgccaggccccgggccaggggcccgagtggatgggctggatccggcccaagacgggcgcccgcaaccaggcccggcagttccagccccgcatcagcctgacccgggaccgcgccctgtccaccgcgtacctcgacctgaacagcctgacctccgccgacagcgggacgtactactgcgcccggcagaccttcaagccggacttctacttcgccgaccagggctggtccttcaacctctgggggcgcggcgcgcacttcatcgtgagctcc

SEQ ID NO: 10565 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtacttctgcgcgcgccagaagttcgcccggggcgaccaggggtggttcttcgacctgtggggccgcgggaccctgatcgtggtgagctccgccagcaccaagggcccgtccgtcttcccccagatctgc

SEQ ID NO: 10566 - RNA, 378 nt, synthetic construct
  misc_feature 1..378: note = derived and/or modified sequence opt1 from anti-HIV-1_HeavyChain
  source 1..378: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatctgcgtgtccagcgcg

SEQ ID NO: 10567 - RNA, 438 nt, synthetic construct
  misc_feature 1..438: note = derived and/or modified sequence opt1 from anti-HIV-1_HeavyChain
  source 1..438: mol_type = other RNA
cagggctacctggcccagagcgggggcggggtgaagaagcccggcacctccgccagcttctcctgccgcaccagcgacgacatctacgacaacgagttcttcgactccgcgttcatgcactgggtccggctcatcccggggcagcgccccgagtggatgggctggatgaacccccggagcggcgccgtgaactacgcccgccagctgcagccccgggtgtccatgtaccgcgaccgggacctgagcacggcctacctcgacctgaactccctgaccagcgccgactccgggacctacttctgcgcgcgccagaccttcaagccggacttctacttcgccgaccagggctggagcttcaacctctgggggcggggcgcccacttcatcgtctccagcgcctccacgaaggggcccagcgtgctgccccacgacctgcgc

SEQ ID NO: 10568 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagcggaccgagctcacgcactgggtgcgccaggcgccggggcagggcctggagtggatcgggtgggtcaagatcgtgtccggcgccgtgaacttcggcagccccaacttccggcagcgcgtctccctgacccgggaccgcgacctcttcaccgcccacatggacatccgggggctgacccagggcgacacggccacctacttctgcgcccgccagaagttcgagcgcgggggccaggggtggatcttcgacctgtggggccggggcaccctcatcgcggtgagctccgccagcaccaaggggccctccgtgttcccccggagcgcc

SEQ ID NO: 10569 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagaagaaggagctcatccactgggtgcggcaggcgccggggcagggcctggagtggatcgggtgggtcaagaccgtgacgggcgccgtgaacttcggctccagcgacttccgccagcgggtctccctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgagctccgcgagcaccaaggggccctccgtcttcccccacgacctg

SEQ ID NO: 10570 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagcctggacttccgccaccggatctccctcacccgcgaccgggacctgttcaccgcccacatggacatccgcgggctgacccagggcgacacggccacctactactgcgcccggcagaagttcgagagccgctacaccgggggccaggggtggtacttcgacctctggggccggggcacccacatcgtcgtgtccagc

SEQ ID NO: 10571 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctactactgcgcccggcagaagttctacgccgggggccaggggtggtacttcgacctgtggggccgcggcaccctcatcgtggtgtccagcgcgtccaccaaggggcccagcgtcttccccacgatctgc

SEQ ID NO: 10572 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgagtccctgtacagcgacgaccagggctcctacttcgacctgtgggggcggggcaccctcatcatcgtgagctcc

SEQ ID NO: 10573 - RNA, 426 nt, synthetic construct
  misc_feature 1..426: note = derived and/or modified sequence opt1 from anti-HIV-1_HeavyChain
  source 1..426: mol_type = other RNA
caggcccacctggagcagagcggctccggggtgaagaagcccggcgccagcgtccgcgtgtcctgctggaccagcgaggacatcttcgaggggtccgagctcatccactgggtgcggcaggcgccgggccaggggctggagtggatcggctgggtcaagaccgtgacgggcgccgtgaacttcgggagcgcctacttccgccaccgggtctccctgacccgcgaccgggacctcttcaccgcccacatggacatccgcggcctgacccagggggacacggccacctacttctgcgcgcggcagaagttcgagagccgctacaccggcgggcagggctggtacttcgacctgtggggccgggggacccacatcgtggtgtccagcgcctccacgaagggccccagcgtcttcccccacgacctccgc

SEQ ID NO: 10574 - RNA, 408 nt, synthetic construct
  misc_feature 1..408: note = derived and/or modified sequence opt1 from anti-HIV-1_HeavyChain
  source 1..408: mol_type = other RNA
caggtgcagctggtccacagcggcgccgaggtgaagaagcccggggcctccatgaaggtgagctgcaagacctccggctacagcttcaccgggtactacatgcactgggtccgccaggcgccgggccaggggctcgagtggatgggctggatcaacccctccagcaacgacacgaactacgcccagaagttccagggccgggtgaccatgacccgcgacacctccatcaacacggcctacatggagctgagccggctgcgctccggggacaccgccatctacttctgcgcccggcagaagttctacgcgggcgggcagggctggtacttcgacctctgggggcgcggcaccctgatcgtggtcagctccgccagcaccaagggcccctccgtgttccccacgatctgc

SEQ ID NO: 10575 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgagctacgcgcggcgcttccagggccgggtctccttctacatgacccgcgagctggggatggcctacatggacctgcggaacctccgcttcgacgacaccgccgtgtacttctgcgcccggaagacggcgggcgacgtgagcggggacaaccgcggctacttcttcgacctgtgggggcggggctcccgcgtcatcgtgagctcc

SEQ ID NO: 10576 - RNA, 414 nt, synthetic construct
  misc_feature 1..414: note = derived and/or modified sequence opt1 from anti-HIV-1_HeavyChain
  source 1..414: mol_type = other RNA
cagggcaccctggagcagagctggtccgaggtgaagaagctcggggccagcgtccgcgtgtcctgctggaccagcgaggacatcttcaagacggagctgatccactgggtgcggcaggcccccggccaggggctggagtggatcggcgggatgaaggcggtctccggcgccgtgaactacggcagcctcgacttccgccaccgggtgtccctgaccccggaccgcgacctgagcaccgcccacatggacatccgggggctcacccaggacgacacggccacctacttctgcgcccgccagaagttcgcgcggggcgaccaggggtggttcttcgacctgtggggccgcgggaccctgatcgtcgtgtccagcgcctccaccaagggccccagcgtgttcccccacgacctccgg

SEQ ID NO: 10577 - RNA, 423 nt, synthetic construct
  misc_feature 1..423: note = derived and/or modified sequence opt1 from anti-HIV-1_HeavyChain
  source 1..423: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgcccgggcagggcctggagtggatcgggtgggtcaagaccgtgacgggcgccgtgaacttcgccagcctggacttccgcaaccggatctccctcagccgcgaccgggacctgtccaccgcctacatggacatccgcggcctgacccaggacgacaccgccacgtacttctgcgcgcggcagaagttcgccagccgctactccggggaccagggcagctacttcgacctctgggggcggggcaccctgatctgcgtctccagcgcctccacccgcgcccaccggctgccgccccgcagcgcg

SEQ ID NO: 10578 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgcgcgcggggaccagggctggttcttcgacctgtgggggcggggcaccctcatcgtggtgtccagcgccagcccccgggcccaccgctccagcccccggtccgcc

SEQ ID NO: 10579 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgtccagcgcgtccaccaaggggcccagcgtcttcccccacgactccgcc

SEQ ID NO: 10580 - RNA, 414 nt, synthetic construct
  misc_feature 1..414: note = derived and/or modified sequence opt1 from anti-HIV-1_HeavyChain
  source 1..414: mol_type = other RNA
caggcccacctggtgcagagcggctccggggtcaagaagcccggcgccagcgtgcgcgtgtcctgctggaccagcgaggacatcttcaagtccgagctcatccactgggtccggcaggcgccggggcagggcctggagtggatcgggtgggtgaagaccgtgacgggcgccgtcaacttcggcagctccgacttccgccagcgggtgagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtctccagcgcgtccaccaaggggcccagcgtgttcccccacgacctgcgg

SEQ ID NO: 10581 - RNA, 414 nt, synthetic construct
  misc_feature 1..414: note = derived and/or modified sequence opt1 from anti-HIV-1_HeavyChain
  source 1..414: mol_type = other RNA
caggcccagctggagcagagcggctccggggtgaagaagcccggcgccagcgtccgcgtgtcctgctggaccagcgaggacatcttcaagaccgagctcatccactgggtgcggcaggcgccggggcagggcctggagtggatcgggtgggtcaagacggtgaccggcgccgtgaacttcggctcccccaacttccgccaccgggtcagcctgacccgcgaccgggacctcttcaccgcccacatggacatccgcgggctgacgcagggcgacaccgccacctacttctgcgcccggcagaagttcgagcgcgggggccaggggtggtacttcgacctgtggggccggggcaccctcatcgtggtgtccagcgcgtccacgaaggggcccagcgtcttcccccacgacctgcgc

SEQ ID NO: 10582 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggccgcgaggtgaagaagcccggggcctccgtccgggtgagctgctggacctccgaggacatcttcgagaagtccgagctcatccactgggtgcgccaggcgccgggccaggggctggagtggatcggctgggtcaagaccgtgacgggggccgtgaacttcggcagcagcgacttccggcagcgcgtctccctgacccgggaccgcgacctcttcaccgcccacatggacatccggggcctgacccagggggacacggccacctacttctgcgcccgccagaagttctacgcgggcgggcagggctggtacttcgacctgtgggggcggggcaccctcatcgtggtgagctccgccagcaccaagggcccctccgtcttcccccacgacctgcgc

SEQ ID NO: 10583 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcatctccctgacccgggaccgcgacctcttcaccgcccacatggacatccgggggctgacccagggcgacacggccacctactactgcgcccgccagaagttcgagagccggtacaccgggggccaggggtggtacttcgacctgtggggccgcggcacccacatcgtcgtgtccagc

SEQ ID NO: 10584 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgaggggtccgagctcatccactgggtgcggcaggcgccgggccaggggctggagtggatcggctgggtcaagaccgtgacgggcgccgtgaacttcgggagcgcctacttccgccaccgggtctccctgacccgcgaccgggacctcttcaccgcccacatggacatccgcggcctgacccagggggacacggccacctactactgcgcgcggcagaagttctacaagggcgggcagggctggtacttcgacctgtggggccgcgggaccctcatcgtggtgagctcc

SEQ ID NO: 10585 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgaagaagcccggggcctccgtgaaggtcagctgcaaggcgtccggctacaccttcaccgactactacctccactgggtgcgccaggccccggggcagggcctggactgggtggggtggatcaaccccaacagcggcggcacgaactacgcccagaagttccaggggcgggtcgccatgacccgcgacacctccctgagctccgtgtacctcgacctgaacagcctgacctccgccgacagcggcacgtacttctgcgcgcggcagaccttcaagcccgacttctacttcgccgaccaggggtggtccttcaacctctggggccgcggggcccacttcatcgtgagctcc

SEQ ID NO: 10586 - RNA, 414 nt, synthetic construct
  misc_feature 1..414: note = derived and/or modified sequence opt1 from anti-HIV-1_HeavyChain
  source 1..414: mol_type = other RNA
caggccgacctggagcagagcggctccggggtgaagaagcccggcgccagcgtccgcgtgtcctgctggaccagcgaggacatcttcgagcggaccaactacgtgcactgggtccgccaggcgccggggcggggcctcgagtggatcgggtggtccaagacggtgaccggcgccgtgaacttcggcagccccaacttccgccaccgggtctccctgacccgcgaccgggacctgttcaccgcccacatggacatccgcgggctcacgcagggcgacaccgccacctacttctgcgcccggcagaagttcgagcgcgggggccaggggtggtacttcgacctgtggggccggggcaccctgatcgtggtgagctccgcgagcacgaaggggccctccgtcttcccccacgacctc

SEQ ID NO: 10587 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcatgaagaagcccggggccagcatgaccgtctcctgcaagaccgcggacgaggacatcttcgacgccgcctacatgcactgggtgcgccaggccccgggccagacgttcgagtggctggggtggatgaagcccgtgaccggcgccgtcaactacgcgcggcagttccagggccgcgtgagcttctaccggacccgcgagctcgggatcgcctacatggacctgcgggacctgaagttcgacgacaccgccgtgtacttctgcgcccgcaagacgaagggcgacgtctccggggacgaccggggcttcttcttcgacctctgggggcgcggcacccgggtgatcgtgagctcc

SEQ ID NO: 10588 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgagtccctgtacagcgacgaccaggggtcctacttcgacctctggggccgcgggaccctgatcatcgtgagctcc

SEQ ID NO: 10589 - RNA, 414 nt, synthetic construct
  misc_feature 1..414: note = derived and/or modified sequence opt1 from anti-HIV-1_HeavyChain
  source 1..414: mol_type = other RNA
caggcccacctggagcagagcggctccggggtgaagaagctcggcgccagcgtccgcgtgtcctgctggaccagcgaggacatcttcgagcggaccaacctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgcccggggcgaccaggggtggttcttcgacctgtggggccgcgggaccctgatcgtggtgtccagcgcctccaccaagggcccgagcgtcttcccccacgacctc

SEQ ID NO: 10590 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcgggcgaggacgtgttcgacgccgcctacatgcactgggtccgccaggccccggggcagacgttcgagtggctcggctggatgaagcccgtgaccggcgccgtgaactacgcgcggaagttccaggggcgcgtcagcttctaccggacccgcgagctgggcatcgcctacatggacctgcggaacctccgcttcgacgacaccgccgtgtacttctgcgcccggaagacggcgggggacgtgtccggcgacaagcgcgggttcttcttcgacctgtggggccggggcagccgcgtcatcgtgtccagc

SEQ ID NO: 10591 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgagtccctgtacagcgacgaccaggggtcctacttcgacctctggggccgcgggaccctgatcacggtgagctcc

SEQ ID NO: 10592 - RNA, 429 nt, synthetic construct
  misc_feature 1..429: note = derived and/or modified sequence opt1 from anti-HIV-1_HeavyChain
  source 1..429: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgcccgggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagagccggtacaccgggggccaggggtggtacttcgacctctggggccgcggcacccacatcgtcgtgtccagcgcgtccacgaaggggcccagcggcctgccgcccaccatctgccgg

SEQ ID NO: 10593 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgcgcgcggggaccagggctggttcttcgacctgtgggggcggggcaccctcatcgtggtgtccagcgcctccaccaagggccccagcgtcttcccccacgacctgcgc

SEQ ID NO: 10594 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcaccagcgtccgcgtgtcctgctggaccagcgaggacatcttcgagcggacggagctcatccactgggtgcgccaggccccggggcagggcctggagtggatcgggtgggtcaagaccgtgaccggcgcggtgaacttcggctcccccaacttccggcaccgcgtcagcctgacccgggaccgcgacctcttcacggcccacatggacatccgggggctgacccagggcgacaccgccacctacttctgcgcccgccagaagttcgagcgcgggggccaggggtggtacttcgacctgtggggccggggcacgctcatcgtggtgtccagcgcctccaccaaggggcccagcgtcttcccccacgacctgcgg

SEQ ID NO: 10595 - RNA, 417 nt, synthetic construct
  misc_feature 1..417: note = derived and/or modified sequence opt1 from anti-HIV-1_HeavyChain
  source 1..417: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggggcgcgacctcttcaccgcccacatggacatccggggcctgacgcagggggacaccgccacctactactgcgcccgccagaagttcgagcggggcgggcagggctggtacttcgacctgtggggccgcgggaccctcatcgtggtgtccagcgcgtccacgaagggccccagcgtcttcccccacgacctgcgg

SEQ ID NO: 10596 - RNA, 411 nt, synthetic construct
  misc_feature 1..411: note = derived and/or modified sequence opt1 from anti-HIV-1_HeavyChain
  source 1..411: mol_type = other RNA
caggcccacctgggcgccaactggagcggggtgaagaagctcggcgcgtccgtccgcgtgagctgctggacctccgaggacatcttcgagcggaccgagctgatccactgggtgcgccaggcccccgggcagggcctggagtggatcgggtgggtcaaggccgtgagcggcgccgtgaactacggctccctcgacttccggcaccgcgtcagcctgacgcgggaccgcgacctgtccaccgcccacatggacatccgggggctcacccaggacgacaccgcgacgtacttctgcgcccgccagaagttcgcccggggcgaccaggggtggttcttcgacctgtggggccgcgggaccctgatcgtggtgagctccgccagcaccaagggcccgtccgtcttcccccagatc

SEQ ID NO: 10597 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgtccagc

SEQ ID NO: 10598 - RNA, 423 nt, synthetic construct
  misc_feature 1..423: note = derived and/or modified sequence opt1 from anti-HIV-1_HeavyChain
  source 1..423: mol_type = other RNA
caggcccagctggagcagagcggcgtgggggtcaagaagcccggcgcctccgtgcgcgtgagctgcctcgcgtccgaggacatcttcaagaccgagctgatccactgggtccggcaggccccggggcagggcctggagtggatcgggtgggtgaagaccgtgacgggcgccgtcaacttcggcagccagatcttccgccaccggatctccctcacccgcgaccgggacctgttcaccgcccacatggacatccgcgggctgacccagggcgacacggccacctacttctgcgcgcggcagaagttcgagagccgctacaccgggggccaggggtggtacttcgacctctggggccggggcacccacatcgtggtgtccagcgcctccacgaaggggcccagcgtcttcccccacgacctgcgc

SEQ ID NO: 10599 - RNA, 411 nt, synthetic construct
  misc_feature 1..411: note = derived and/or modified sequence opt1 from anti-HIV-1_HeavyChain
  source 1..411: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcgcccaccagatcagcgaccgcgtctccctgacccgggaccgcgacctcttcaccgcccacatggacatccggggcctgacccagggggacacggccacctacttctgcgcgcgccagaagttctacgccggcgggcagggctggtacttcgacctgtgggggcggggcaccctcatcgtggtgagctccgccagcaccaagggcccctccgtcttccccacgatctgc

SEQ ID NO: 10600 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggtccgagctcatccactgggtgcgccaggcgccggggcagggcctggagtggatcgggtgggtcaagaccgtgacgggcgccgtgaacttcggcagccccaacttccggcaccgcgtctccctgacccgggaccgcgacctcttcaccgcccacatggacatccgggggctgacccagggcgacacggccacctacttctgcgcccgccagaagtactacgccgggggccaggggtggtacttcgacctgtggggccggggcaccctcatctgcgtgagctcc

SEQ ID NO: 10601 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgagcgcgggggccaggggtggtacttcgacctgtggggccggggcaccctcatcgtggtgagctcc

SEQ ID NO: 10602 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcggggcctggagtggatcgggtgggtcaaggccgtgtccggcgccgtgaactacggcagcctcgacttccgccaccgggtctccctgacgcgcgaccgggacctgttcaccgcccacatggacatccgcgggctcacccaggacgacaccgccacgtacttctgcgcgcggcagaagttcgcccgcggcgaccaggggtggttcttcgacctgtggggccgggggaccctgatcgtggtgagctcc

SEQ ID NO: 10603 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgagggcgtgttcgacgccgcctacatgcactgggtccgccaggccccggggcagacgttcgagtggctcggctggatgaagcccgtgaccggcgccgtgaactacgcgcggaagttccaggggcgcgtcagcttctaccggacccgcgagctgggcatcgcctacatggacctgcggaacctccgcttcgacgacaccgccgtgtacttctgcgcccggaagacggcgggggacgtgtccggcgacaagcgcgggttcttcttcgacctgtggggccggggcagccgcgtcatcgtgtccagc

SEQ ID NO: 10604 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgaggggtccgagctcatccactgggtgcggcaggcgccgggccaggggctggagtggatcggctgggtcaagaccgtgacgggcgccgtgaacttcgggagcgcctacttccgccaccgggtctccctgacccgcgaccgggacctcttcaccgcccacatggacatccgcggcctgacccagggggacacggccacctacttctgcgcgcggcagaagtactacgccggcgggcagggctggtacttcgacctgtggggccgcgggaccctcatcgtggtgagctcc

SEQ ID NO: 10605 - RNA, 378 nt, synthetic construct
  misc_feature 1..378: note = derived and/or modified sequence opt1 from anti-HIV-1_HeavyChain
  source 1..378: mol_type = other RNA
caggtgtacatggagcagcccggcgtcgaggtgaccaagccgggggccagcgtgaccctgtcctgcaagacggccgaggacgtcttcgacgcggcctacatgcactgggtgcgccaggcccccggccagaccttcgagtggctcgggtggatcaagcccgtgaccggcgccgtcaactacgcccggaagttccaggggcgcgtgagcttctaccggacccgcgagctgggcatcgcgtacatggacctgcggaacctccgcttcgacgacacggccgtgtacttctgcgcccggaagaccgccggcgacgtctccggggacaagcgcggcttcttcttcgacctgtgggggcggggcagccgcgtgatcgtgtccagc

SEQ ID NO: 10606 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagcgcgggggccaggggtggatcttcgacctgtggggccggggcaccctcatcatcgtgtccagc

SEQ ID NO: 10607 - RNA, 384 nt, synthetic construct
  misc_feature 1..384: note = derived and/or modified sequence opt1 from anti-HIV-1_HeavyChain
  source 1..384: mol_type = other RNA
caggcccacctggtgcagagcggctccgaggtcaagaagcccggggccttcgtgcgcgtgagctgctggacctccgaggacatcttcgaggagaccgagctcatccactgggtccggcaggcgccgggccaggggctggagtggatcggctgggtgaagacggtgaccggggccgtcaacttcggcagcctggacttccgccaccggatctccctcacccgcgaccgggacctgttcaccgcccacatggacatccgcggcctgacgcagggggacaccgccacctacttctgcgcccggcagaagttcgagagccgctacaccggcgggcagggctggtacttcgacctctgggggcggggcacgcacatcgtggtgtccagc

SEQ ID NO: 10608 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgcaaggcgagcgaggacatcttcgagcggaccgagctcatccactgggtgcgccaggccccggggcagggcctggagtggatcgggtgggtcaagaccgtgacgggcgccgtgaacttcggctcccccaacttccggcaccgcgtcagcctgacccgggaccgcgacctcttcaccgcccacatggacatccgggggctgacccagggcgacacggccacctacttctgcgcgcgccagaagttcgagcgcgggggccaggggtggtacttcgacctgtggggccggggcaccctcatcgtggtgtccagc

SEQ ID NO: 10609 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccgaggtgaagaagcccggggccagcgtccgcgtgtcctgctggaccagcgaggacatcttcgagcggaccgagctcatccactgggtgcgccaggcgccgggccaggggctggagtggatcggctgggtcaagacggtgtccggggccgtgaacttcggcagccccaacttccggcaccgcgtctccctgacccgggaccgcgacctcttcaccgcccacatggacatccggggcctgacccagggggacacggccacctacttctgcgcccgccagaagttcgagcggggcgggcagggctggtacttcgacctgtgggggcgcggcaccctcatcgtggtgagctcc

SEQ ID NO: 10610 - RNA, 375 nt, synthetic construct
  misc_feature 1..375: note = derived and/or modified sequence opt1 from anti-HIV-1_HeavyChain
  source 1..375: mol_type = other RNA
caggcgcacctggtgcagagcggctccggggtcaagaagcccggcgccagcgtgcgcgtgtcctgctggaccagcgaggacatcttcgagaagtccgagctcatccactgggtccggcaggcgccggggcagggcctggagtggatcgggtgggtgaagaccgtgacgggcgccgtcaacttcggcagctccgacttccgccagcgggtgagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtctccagc

SEQ ID NO: 10611 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgagcggggcgggcagggctggtacttcgacctgtgggggcgcggcaccctgatctgcgtgtccagc

SEQ ID NO: 10612 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagccccgcgccagcgtccgggtgtcctgctggaccagcgaggacatcttcgagaagtccgagctcatccactgggtgcgccaggcgccgggccaggggctggagtggatcggctgggtcaagaccgtgacgggggccgtgaacttcggcagctccgacttccggcagcgcgtcagcctgacccgggaccgcgacctcttcaccgcccacatggacatccggggcctgacccagggggacacggccacctacttctgcgcccgccagaagttctacgcgggcgggcagggctggtacttcgacctgtgggggcggggcaccctcatcgtggtgtccagc

SEQ ID NO: 10613 - RNA, 381 nt, synthetic construct
  misc_feature 1..381: note = derived and/or modified sequence opt1 from anti-HIV-1_HeavyChain
  source 1..381: mol_type = other RNA
caggtgcagctggagcaggccggcgccggggtcaagaagcccggcccgagcgtgaccctctcctgcaagaccgcggacgaggacgtgttcgacgccgcctacatgcactgggtccgccaggcccccgggcagacgttcgagtggctgggctggatgaagcccgtgaccggggccgtgagctacgcgcggaagttccagggccgcgtctccttctacatgacccgggagctgggcatggcctacatggacctccgcaacctgcggttcgacgacaccgccgtgtacttctgcgcccgcaagacggcgggggacgtgagcggcgacaaccgggggtacttcttcgacctgtggggccgcgggtcccgggtcatcgtgagctcc

SEQ ID NO: 10614 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcagcgcgtctccctgacccgggaccgcgacctcttcaccgcccacatggacatccgggggctgacccagggcgacacggccacctacttctgcgcccgccagaagttctacgccgggggccaggggtggtacttcgacctgtggggccggggcaccctcatcgtggtgagctcc

SEQ ID NO: 10615 - RNA, 381 nt, synthetic construct
  misc_feature 1..381: note = derived and/or modified sequence opt1 from anti-HIV-1_HeavyChain
  source 1..381: mol_type = other RNA
caggtgttcatggagcaggccggcgccgggatgaagaagcccggcgcgagcatgaccgtctcctgcaagaccgccgacgaggacgtgttcgacgccgcctacatgcactgggtgcgccaggccccggggcagacgttcgagtggctgggctggatgaagcccgtcaccggggcggtgaactacgcccggaagttccagggccgcgtgagcttctaccggacccgcgagctcggcatcgcctacatggacctgcggaacctgcgcttcgacgacaccgccgtctacttctgcgcgcggaagacggccggggacgtgtccggcgacaagcgcgggttcttcttcgacctctggggccgggggagccgcgtgatcgtctccagc

SEQ ID NO: 10616 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgcgtcctgctggaccagcgaggacatcttcgagcggaccgagctcatccactgggtgcgccaggccccggggcagggcctggagtggatcgggtgggtgaagatcgtctccggcgccgtgaacttcggcagccccaacttccggcagcgcgtgtccctgacgcgggaccgcgacctcttcaccgcccacatggacatccgggggctgacccagggcgacaccgccacgtacttctgcgcgcgccagaagttcgagcgcgggggccaggggtggatcttcgacctgtggggccggggcaccctcatcgccgtcagctcc

SEQ ID NO: 10617 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcatgaagaagcccggggccagcatgaccgtctcctgcaagaccgcggacgaggacatcttcgacgccgcctacatgcactgggtgcgccaggcccggggccagacgttcgagtggctggggtggatgaagccggtgaccggcgccgtcaactacgcgcgccagttccagggccgggtgagcttctaccgcacccgggagctcgggatcgcctacatggacctgcgcgacctgaagttcgacgacaccgccgtgtacttctgcgcccggaagacgaagggcgacgtctccggggacgaccgcggcttcttcttcgacctctgggggcggggcacccgcgtgatcgtgagctcc

SEQ ID NO: 10618 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggcgccggggtgaaggagcccggcgcgtccgtccgcgtgagctgctggtccagcgaggacatcttcgagcggaccgagctcatccactgggtgcgccaggccccggggcagggcctggagtggatcgggtgggtcaagaccgtgacgggcgccgtgaacttcggctccctggacttccggcaccgcatcagcctcacccgggaccgcgacctgctgaccgcccacatggacatccgggggctcacccagggcgacacggccacctacttctgcgcgcgccagaagttcgagtcccggtacaccgggggccaggggtggtacttcgacctgtggggccgcggcacccacatcgtcgtgagctcc

SEQ ID NO: 10619 - RNA, 384 nt, synthetic construct
  misc_feature 1..384: note = derived and/or modified sequence opt1 from anti-HIV-1_HeavyChain
  source 1..384: mol_type = other RNA
caggtgcagctggtccagagcggctccgccatgaagaagcccggggccagcgtgcgcgtgtcctgctggaccagcgaggacatcttcgagcggaccgagctcatctactgggtccgccaggcgccgggccgggggctggagtggatcggctgggtgaagacggtgtccgggaccgtcaacttcggcagctccgacttccgcaaccggatcagcctgacccgcgaccgggacctctccaccgcccacatggacatccgcggcctgacgcaggacgacaccgccacctacttctgcgcccggcagaagttcgagagcctgtactccgacgaccaggggagctacttcgacctctggggccgcgggaccctgatcatcgtgtccagc

SEQ ID NO: 10620 - RNA, 384 nt, synthetic construct
  misc_feature 1..384: note = derived and/or modified sequence opt1 from anti-HIV-1_HeavyChain
  source 1..384: mol_type = other RNA
caggcccacctggtgcagagcgcctccggcgtcaagcgccccggggcgagcgtgcgggtgtcctgctggaccagcgaggacatcttcgagcgcaccgagctcatctactgggtccggcaggccccgggccaggggctggagtggatcggctgggtgaagacggtgtccggggccgtcaacttcggcagccaggacttccgccaccggatctccctgacccgcgaccgggacctcttcaccgcccacatggacatccgcggcctgacccagggggacacggccacctacttctgcgcgcggcagaagttcgagagccgctacaccggcgggcagggctggtacttcgacctgtgggggcggggcacccacatcgtggtgtccagc

SEQ ID NO: 10621 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgagctacgcgcggaagttccagggccgcgtctccttctacatgacccgggagctggggatggcctacatggacctgcgcaacctccggttcgacgacaccgccgtgtacttctgcgcccgcaagacggcgggcgacgtgagcggggacaagcggggcttcttcttcgacctgtgggggcgcggctcccgggtcatcgtgagctcc

SEQ ID NO: 10622 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagcccggcgccagcgtccgcgtgtcctgctggaccagcgaggacatcttcgaggggtacatgatccactgggtgcggcaggcgccgggccaggggctcgagtggatcggctgggtcaagaccgtgacgggcgccgtgaacttcgggtccgcctacttccgccaccgggtcagcctgacccgcgaccgggacctgttcaccgcccacatggacatccgcggcctcacccagggggacacggccacctacttctgcgcgcggcagaagttctacaagggcgggcagggctggtacttcgacctgtggggccgcgggaccctgatcgtggtgtccagc

SEQ ID NO: 10623 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcggggcctggagtggatcgggtgggtcaaggccgtgtccggcgccgtgaactacggcagcctcgacttccgccaccgggtctccctgacgcgcgaccgggacctgttcaccgcccacatggacatccgcgggctcacccaggacgacaccgccacgtacttctgcgcgcggcagaagttcgcccgcggcgaccaggggtggttcttcgacctgtggggccgggggaccctgatctgcgtgagctcc

SEQ ID NO: 10624 - RNA, 375 nt, synthetic construct
  misc_feature 1..375: note = derived and/or modified sequence opt1 from anti-HIV-1_HeavyChain
  source 1..375: mol_type = other RNA
caggcgcacctggtgcagagcggctccggggtcaagaagtccggcgccagcgtgcgcgtgagctgctggacctccgaggacatcttcgagaagtccgagctcatccactgggtccggcaggcgcccgggcagggcctggagtggatcgggtgggtgaagaccgtgacgggcgccgtcaacttcggcagcagcgacttccgccagcgggtgtccctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtcagctcc

SEQ ID NO: 10625 - RNA, 378 nt, synthetic construct
  misc_feature 1..378: note = derived and/or modified sequence opt1 from anti-HIV-1_HeavyChain
  source 1..378: mol_type = other RNA
caggtgtacatggagcgcgccggcgccggggtcaagaagcccggcgcgagcgtgaccctgtcctgcaagaccgccgacgaggacgtgttcggggcctacatgcactgggtccggcaggccccgggccagacgttcgagtggctcgggtggatgaagcccgtgaccggcgccgtgagctacgcgcgcaagttccagggccgggtctccttctacatgacccgcgagctggggatggcctacatggacctgcggaacctccgcttcgacgacaccgccgtgtacttctgcgcccggaagacggcgggcgacgtgagcggggacaaccgcggctacttcttcgacctgtgggggcggggctcccgcgtcatcgtgagctcc

SEQ ID NO: 10626 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgaggggtccgagctcatccactgggtgcggcaggcgccgggccaggggctggagtggatcggctgggtcaagaccgtgacgggcgccgtgaacttcgggagcgcctacttccgccaccgggtctccctgacccgcgaccgggacctcttcaccgcccacatggacatccgcggcctgacccagggggacacggccacctacttctgcgcgcggcagaagttctacaagggcgggcagggctggtacttcgacctgtggggccgcgggaccctcatcgtggtgagctcc

SEQ ID NO: 10627 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccgggtgtccctgacccgcgaccgggacctcttcaccgcccacatggacatccgcggcctgacgcaggacgacaccgccacctacttctgcgcccggcagaagttcgcccgcggggaccagggctggttcttcgacctgtgggggcggggcaccctcatcgtcgtgagctcc

SEQ ID NO: 10628 - RNA, 384 nt, synthetic construct
  misc_feature 1..384: note = derived and/or modified sequence opt1 from anti-HIV-1_HeavyChain
  source 1..384: mol_type = other RNA
caggcccacctggtgcagagcggctccggggtcaagaagcccggcgccagcgtgcgcgtgtcctgctggaccagcgaggacatcttcgagcggaccgagctcatccactgggtccgccaggcgccggggcagggcctggagtggatcgggtgggtgaagacggtggccggcgccgtcaacttctccagcctggacttccggcaccgcatctccctcacccgggaccgcgacctgttcaccgcccacatggacatccggggcctgacccagggggacacggccacctacttctgcgcgcgccagaagttcgagagccggtacaccggcgggcagggctggtacttcgacctctgggggcgcggcacccacatcgtggtgtccagc

SEQ ID NO: 10629 - RNA, 384 nt, synthetic construct
  misc_feature 1..384: note = derived and/or modified sequence opt1 from anti-HIV-1_HeavyChain
  source 1..384: mol_type = other RNA
caggcccacctggagcagagcggctccggggtgaagaagtccggcgccagcgcgcgcgtcagctgctggtccagcgaggacatcttcgagcggaccgagctcatccactgggtgcgccaggcccccgggcagggcctggagtggatcgggtgggtgaagaccgtcacgggcgccgtgaacttcggctccctggacttccggcaccgcatcagcctcacccgggaccgcgacctgttcaccgcccacatggacatccgggggctgacccagggcgacacggccacctacttctgcgcgcgccagaagttcgagtcccggtacaccgggggccaggggtggtacttcgacctctggggccgcggcacccacatcgtggtcagctcc

SEQ ID NO: 10630 - RNA, 369 nt, synthetic construct
  misc_feature 1..369: note = derived and/or modified sequence opt1 from anti-HIV-1_HeavyChain
  source 1..369: mol_type = other RNA
ctgctccagctggtgcagagcggcgccgaggtcaagaagcccggggcctccgtgaaggtgacctgcaaggcgagcggctacaccttcacggggtacatccactgggtccgccaggccccgggccaggggctggagtggatcggctgggtgaaggccgtgtccggcgccgtcaactacgggagcctcgacttccggcaccgcgtgtccctgacccacgaccgggacctgagcaccgcccacatggacatccgcggcctcacccaggacgacacggcgacctacttctgcgcccggcagaagttcgcccgcggggaccagggctggttcttcgacctgtgggggcggggcaccctgatcgtggtctccagc

SEQ ID NO: 10631 - RNA, 369 nt, synthetic construct
  misc_feature 1..369: note = derived and/or modified sequence opt1 from anti-HIV-1_HeavyChain
  source 1..369: mol_type = other RNA
caggtgcagctggtccagagcggcgccgaggtgaagaagcccggggcctccgtgaaggtcagctgcaaggcgtccggctgcaccttcaccgggtactacatgcactgggtgcgccaggccccgggccaggggctcgagtggatgggctggatcaaccccaacagcggcgggacgaactacgcccagaagttccagggccgggtgaccatgacccgcgacacctccatcagcacggcctacatggagctgtcccggctgcgcagcgacgacaccgccgtctactactgcgcgcggcagaagttcgcccgcggggaccagggctggttcttcgacctctgggggcggggcaccctgatcgtggtgtccagc

SEQ ID NO: 10632 - RNA, 369 nt, synthetic construct
  misc_feature 1..369: note = derived and/or modified sequence opt1 from anti-HIV-1_HeavyChain
  source 1..369: mol_type = other RNA
caggtgcagctggtccagagcggcaccgagctccgcaagcccggggcctccgtgaaggtgagctgcaaggcctccggctacaccttcagcgggtcctacatccactgggtccggcaggcgccgggccaggggctggagtgggtgggctggatcaaccccagctccggcgccacgcagtgcgccaagaagttccaggacaaggtgaccatgacccgcgacaccacgaacaacaccgtctacatggaggtgaaccggctgatcagcgacgacaccgccacctacttctgcgcccgccagaagttcgcgcgcggggaccagggctggttcttcgacctctgggggcggggcacgctgatcgtggtctccagc

SEQ ID NO: 10633 - RNA, 372 nt, synthetic construct
  misc_feature 1..372: note = derived and/or modified sequence opt1 from anti-HIV-1_HeavyChain
  source 1..372: mol_type = other RNA
caggtgctgctcgtccagagcggcgccgaggtgaagaagcccgggtccagcgtgaaggtctcctgcaagaccagcggcgactccctgaccaagtacgccctgcactgggcgcgccaggccccggggcagggcctcgagtggatcgggtgggtgaagacggtgaccggcgccgtcaacttcggcagctccgacttccggcagcgcgtgagcctgacccgggaccgcgacctgttcaccgcccacatggacatccgggggctcacgcagggcgacaccgccacctacttctgcgcgcgccagaagttctacgccgggggccaggggtggtacttcgacctgtggggccggggcaccctgatcgtggtctccagc

SEQ ID NO: 10634 - RNA, 372 nt, synthetic construct
  misc_feature 1..372: note = derived and/or modified sequence opt1 from anti-HIV-1_HeavyChain
  source 1..372: mol_type = other RNA
caggtgcagctggtccagagcggcaccgaggtgaagacccccggggcgtccgtgaaggtcagctgcaaggcctccggctacacgttcaccaactacgacatcaactgggtgcgccaggcgccggggcagggcctcgagtggatcgggtgggtgaagaccgtcaccggcgccgtgaacttcggcagctccgacttccggcagcgcgtgagcctgacgcgggaccgcgacctgttcaccgcccacatggacatccgggggctcacccagggcgacaccgccacgtacttctgcgcccgccagaagttctacgccgggggccaggggtggtacttcgacctgtggggccggggcaccctgatcgtcgtgtccagc

SEQ ID NO: 10635 - RNA, 372 nt, synthetic construct
  misc_feature 1..372: note = derived and/or modified sequence opt1 from anti-HIV-1_HeavyChain
  source 1..372: mol_type = other RNA
caggtgcagctggtccagagcggcgacgaggtgaagaagcccggggcctccgtgaaggtcagctgcaaggcctccggcaaggggttcccgaccagcctcgtgacctgggtgcgccaggcgcccggccaggggctggagtggatcggctgggtcaaggccgtgtccggcgccgtgaactacgggagcctggacttccggcaccgcgtctccctcacgcgggaccgcgacctgttcaccgcccacatggacatccggggcctgacccaggacgacaccgccacgtacttctgcgcgcgccagaagttcgcccgcggggaccagggctggttcttcgacctctgggggcggggcaccctgatcgtggtgagctcc

SEQ ID NO: 10636 - RNA, 372 nt, synthetic construct
  misc_feature 1..372: note = derived and/or modified sequence opt1 from anti-HIV-1_HeavyChain
  source 1..372: mol_type = other RNA
caggtgcagctggtccagagcggcgccgaggtgaagaagcccgggtccagcgtgaaggtctcctgcaagaccagcggcgacatcctcaccaactacgggctgaactgggtgcgccaggccccgggccaggggctggagtggatcggctgggtgaaggcggtctccggcgccgtgaactacgggagcctcgacttccggcaccgcgtgtccctgacgcgggaccgcgacctgagcaccgcccacatggacatccggggcctcacccaggacgacaccgccacgtacttctgcgcccgccagaagttcgcgcgcggggaccagggctggttcttcgacctgtgggggcggggcaccctgatcgtcgtgtccagc

SEQ ID NO: 10637 - RNA, 372 nt, synthetic construct
  misc_feature 1..372: note = derived and/or modified sequence opt1 from anti-HIV-1_HeavyChain
  source 1..372: mol_type = other RNA
caggtgcagctggtccagagcggcgccgaggtgaagaagcccggggcctccgtgcgcgtcagctgcaagacctccggctacccgttcagccggtacgggatctcctgggtgcgccaggcgcccggccaggggctcgtgtggatggcctgggtcaaggccgtgagcggcgccgtgaactacggctccctggacttccggcaccgcgtcagcctgacccgggaccgcgacctctccacggcccacatggacatccgggggctgacccaggacgacaccgcgacctacttctgcgcccgccagaagttcgcccggggcgaccaggggtggttcttcgacctgtggggccgcgggacgctcatcgtggtgagctcc

SEQ ID NO: 10638 - RNA, 372 nt, synthetic construct
  misc_feature 1..372: note = derived and/or modified sequence opt1 from anti-HIV-1_HeavyChain
  source 1..372: mol_type = other RNA
cgcgagcagctggtgcagagcggcgccgaggtcaagaagcccggggcctccgtgaaggtgagctgcaagacctccggcaacaccttcgggagctacgacttcaactgggtccggcaggcgccgggccaggggctcgagtggatcggctgggtgaagatcgtgtccggcgccgtcaacttcgggagccccaacttccgccagcgggtgtccctgacgcgcgaccgggacctgttcaccgcccacatggacatccgcggcctcacccagggggacaccgccacgtacttctgcgcccggcagaagttcgagcgcggcgggcagggctggatcttcgacctgtggggccgggggaccctgatcgcggtgagctcc

SEQ ID NO: 10639 - RNA, 372 nt, synthetic construct
  misc_feature 1..372: note = derived and/or modified sequence opt1 from anti-HIV-1_HeavyChain
  source 1..372: mol_type = other RNA
caggtgcagctggtccagagcggcgccgaggtgaagaagcccggggcctccgtgaaggtcagctgcaaggcgtccggctacaccttcaccagctactacatgcactgggtgcgccaggccccggggcagggcctcgagtggatcgggtgggtgaagacggtcaccggcgccgtgaacttcggctcccccaacttccggcaccgcgtgagcctgacccgggaccgcgacctgttcaccgcccacatggacatccgggggctcacgcagggcgacaccgccacctacttctgcgcgcgccagaagtactacgccgggggccaggggtggtacttcgacctgtggggccggggcaccctgatcgtcgtgtccagc

SEQ ID NO: 10640 - RNA, 372 nt, synthetic construct
  misc_feature 1..372: note = derived and/or modified sequence opt1 from anti-HIV-1_HeavyChain
  source 1..372: mol_type = other RNA
caggtgcagctggtccagagcggcgccgaggtgaagaagcccggggcctccgtgaaggtcagctgcaaggcgtccggctacaccttcaccagctactacatgcactgggtgcgccaggccccggggcagggcctcgagtggatcgggtgggtgaagacggtcaccggcaccgtgaacttcggctccctgaacttccggcagcgcgtgagcctgacccgggaccgcgacctcttcacggcccacatggacatccgggggctgacccagggcgacaccgccacctacttctgcgcccgccagaagttcgagcgcgggggccaggggtggtacttcgacctgtggggccggggcacgctcatcgtcgtgtccagc

SEQ ID NO: 10641 - RNA, 372 nt, synthetic construct
  misc_feature 1..372: note = derived and/or modified sequence opt1 from anti-HIV-1_HeavyChain
  source 1..372: mol_type = other RNA
caggtgcagctgggccagagcggggccgagatgaagaagcccggctccagcgtcaaggtgtcctgcaaggccagcgggggcaccttccgccactccccgatcagctgggtgcggcaggcgcccgggcagggcctcgagtggatcggctgggtcaaggccgtgtccggggccgtgaactacggcagcctggacttccgccaccgggtctccctgacccgcgaccgggacctcagcacggcccacatggacatccgcgggctgacccaggacgacaccgccacctacttctgcgcgcggcagaagttcgcccgcggcgaccaggggtggttcttcgacctgtggggccggggcacgctcatcgtggtgtccagc

SEQ ID NO: 10642 - RNA, 369 nt, synthetic construct
  misc_feature 1..369: note = derived and/or modified sequence opt1 from anti-HIV-1_HeavyChain
  source 1..369: mol_type = other RNA
caggtgcagctggtccagagcggcgccgaggtgcgcacccccggggcctccgtgaaggtcagctgcaaggcgtccggctacaacttcatcgcctaccacgtgcactgggtgcggcaggccccggggcagggcctcacctggatggggtggatcaaccccgacagcggcgacacggtctacgcccagaacttcgtggaccgcgtgatgatgacccggaacacctccatccagaccgtctacctggagctgaacgtgctcacgctggaggacaccgccacctacttctgcgcgcgccagaagttcgcccggggcgaccaggggtggttcttcgacctgtggggccgcgggaccctcatcgtggtcagctcc

SEQ ID NO: 10643 - RNA, 372 nt, synthetic construct
  misc_feature 1..372: note = derived and/or modified sequence opt1 from anti-HIV-1_HeavyChain
  source 1..372: mol_type = other RNA
caggtgcagctggtccagagcggcgccgaggtgaagaagcccggggcctccgtgaaggtcagctgcaaggcgtccggctacaccttcaccgtgtactacatgcactgggtgcgccaggccccggggcggggcctcgagtggatcgggtgggtcaaggccgtgagcggcgccgtgaactacggctccctggacttccgccaccgggtcagcctgacgcgcgaccgggacctcttcaccgcccacatggacatccgcgggctgacccaggacgacaccgcgacgtacttctgcgcccggcagaagttcgcccgcggcgaccaggggtggttcttcgacctgtggggccgggggaccctcatcgtggtgtccagc

SEQ ID NO: 10644 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccagggcgacaccgccacgtacttctgcgcgcgccagaagttcgagcgcgggggccaggggtggtacttcgacctgtggggccggggcaccctgatcgtggtgagctcc

SEQ ID NO: 10645 - RNA, 372 nt, synthetic construct
  misc_feature 1..372: note = derived and/or modified sequence opt1 from anti-HIV-1_HeavyChain
  source 1..372: mol_type = other RNA
caggtgcagctggtccagagcggcgccgaggtgaagaagcccggggcctccgtgaaggtcagctgcaaggcgtccggctacaccttcatcgggtactacatgcactgggtgcgccaggccccgggccaggggctcgagtggatgggctgggtgaagaccgtcacgggcgccgtgaacttcgggagccccaacttccggcaccgcgtgtccctgacccgggaccgcgacctgttcaccgcccacatggacatccggggcctcacccagggggacacggccacctacttctgcgcgcgccagaagttcgagcggggcgggcagggctggtacttcgacctgtggggccgcgggaccctgatcgtcgtgagctcc

SEQ ID NO: 10646 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagcctgaacttccggcaccgcgtctccctcacccgggaccgcgacctgttcaccgcccacatggacatccgggggctgacccagggcgacacggccacctacttctgcgcccgccagaagttcgcgcgcggggaccagggctggttcttcgacctctgggggcggggcaccctgatcgtggtgagctcc

SEQ ID NO: 10647 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagctcggcgccagcgtccgcgtgtcctgctggaccagcgaggacatcttcaaggaccggatcgaccactgggtgcgccaggcgcccgggcagggcctggagtggatcgggtgggtcaaggccgtgtccggcgccgtgaactacggcagcctggacttccggcaccgcgtctccctcacccgggaccgcgacctgttcacggcccacatggacatccgggggctgacccaggacgacaccgccacctacttctgcgcgcgccagaagttcgcccggggcgaccaggggtggttcttcgacctctggggccgcgggacgctgatcgtggtgagctcc

SEQ ID NO: 10648 - RNA, 375 nt, synthetic construct
  misc_feature 1..375: note = derived and/or modified sequence opt1 from anti-HIV-1_HeavyChain
  source 1..375: mol_type = other RNA
caggtgcagctggcccagagcggcgccgaggtcaagaagctcggggcgtccgtgcgcgtgagctgctggacctccgaggacatcttcgagcggaccgagctgatccactgggtccgccaggcccccggccaggggctggagtggatcggctgggtgaaggccgtgagcggggccgtcaactacggctccctcgacttccggcaccgcgtgagcctgacgcgggaccgcgacctgttcaccgcccacatggacatccggggcctcacccaggacgacaccgcgatctacttctgcgcccgccagaagttcgcccgcggggaccagggctggttcttcgacctgtgggggcggggcacgctgatcgtggtctccagc

SEQ ID NO: 10649 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagcccggcgccagcgtccgcgtgtcctgctggaccagcgaggacatctccaaggcggagctcatccactgggtgcggcaggccccggggcagggcctggagtggatcgggtgggtcaagaccgtgagcggcgccgtgaacttcggctcccccaacttccgccaccgggtcagcctgacgcgcgaccgggacctcttcaccgcccacatggacatccgcgggctgacccagggcgacaccgccacgtacttctgcgcgcggcagaagttcgagcgcgggggccaggggtggtacttcgacctgtggggccggggcaccctcatcgtggtgtccagc

SEQ ID NO: 10650 - RNA, 372 nt, synthetic construct
  misc_feature 1..372: note = derived and/or modified sequence opt1 from anti-HIV-1_HeavyChain
  source 1..372: mol_type = other RNA
accgcccacctggagcagagcggctccggggtgcgccggcccggcgccagcgtccgcgtgtcctgctggaccagcggggacatcttcaagtccgagctcatccactgggtgcggcaggcgccgggccaggggctggagtggatcggctgggtcaagacggtgaccggcgccgtgaacttcgggagctccgacttccgccagcgggtcagcctgacccgcgaccgggacctcttcaccgcccacatggacatccgcggcctgacgcagggggacaccgccacctacttctgcgcccggcagaagttctacgcgggcgggcagggctggtacttcgacctgtggggccgcgggaccctcatcgtggtgtccagc

SEQ ID NO: 10651 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagcgccccggcgccagcgtccgggtgtcctgctggaccagcgaggacatcttcaacaccgagctcatccactgggtgcgccaggcgccggggcagggcctggagtggatcgggtgggtcaagacggtgtccggcgccgtgaacttcggcagcctgaacttccggcaccgcgtctccctcacccgggaccgcgacctgttcaccgcccacatggacatccgggggctgacccagggcgacacggccacctacttctgcgcccgccagaagttcgcgcgcggggaccagggctggttcttcgacctctgggggcggggcaccctgatcgtggtgagctcc

SEQ ID NO: 10652 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagcccggcgccagcgtccgcgtgtcctgctggaccagcgaggacatcttcaagaccgagctcatccactgggtgcggcaggcgccggggcagggcctggagtggatcgggtgggtcaaggccgtgtccggcgccgtgaactacggcagcctggacttccgccaccgggtctccctcacgcgcgaccgggacctgagcaccgcccacatggacatccgcgggctgacccaggacgacaccgccacgtacttctgcgcgcggcagaagttcgcccgcggcgaccaggggtggttcttcgacctctggggccgggggaccctgatcgtggtgtccagc

SEQ ID NO: 10653 - RNA, 372 nt, synthetic construct
  misc_feature 1..372: note = derived and/or modified sequence opt1 from anti-HIV-1_HeavyChain
  source 1..372: mol_type = other RNA
caggtgcagctggtccagagcggcgccgaggtgaagaagcccggggcctccgtgcgcgtcagctgcaaggcgtccggctacaccttcaccgcctactacatccactgggtgcggcaggccccggggcagggcctcgagtggatcgggtgggtgaagacggtcagcggcgccgtgaacttcggctcccccaacttccgccaccgggtgagcctgacccgcgaccgggacctgttcaccgcccacatggacatccgcgggctcacccagggcgacacggcgacctacttctgcgcccggcagaagttcgagcgcgggggccaggggtggtacttcgacctgtggggccggggcaccctgatcgtcgtgtccagc

SEQ ID NO: 10654 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccgagagcaagaagcccggggcctccgtgcgcgtcagctgctggtccagcgaggacatcttcaagaccgagctcatccactgggtgcggcaggcgccgggccaggggctggagtggatcggctgggtgaagatcgtctccggggccgtgaacttcggcagccccaacttccgccagcgggtgtccctgacccgcgaccgggacctcttcacggcccacatggacatccgcggcctgacccagggggacaccgccacctacttctgcgcccggcagaagttcgagcgcggcgggcagggctggatcttcgacctgtgggggcggggcacgctcatcgcggtcagctcc

SEQ ID NO: 10655 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccgaggtgaagaagcccggggccagcgtccgcgtgtcctgctggaccagcgaggacatcttcgagaagtccgagctcatccactgggtgcggcaggcgccgggccaggggctggagtggatcggctgggtcaagaccgtgacgggggccgtgaacttcggcagctccgacttccgccagcgggtcagcctgacccgcgaccgggacctcttcaccgcccacatggacatccgcggcctgacccagggggacacggccacctacttctgcgcccggcagaagttctacgcgggcgggcagggctggtacttcgacctgtgggggcgcggcaccctcatcgtggtgtccagc

SEQ ID NO: 10656 - RNA, 372 nt, synthetic construct
  misc_feature 1..372: note = derived and/or modified sequence opt1 from anti-HIV-1_HeavyChain
  source 1..372: mol_type = other RNA
caggcccacctggagcaggtctgggccggcgtgaagaagctcggggcgagcgtgcgcgtgtcctgctggaccagcgaggacatcttcaagaccgagctgatccactgggtccggcaggcccccggccaggggctggagtggatcggctgggtgaaggccgtgtccggggccgtcaactacggcagcctcgacttccgccaccgggtgtccctgacgcgcgaccgggacctgagcaccgcccacatggacatccgcggcctcacccaggacgacaccgcgacgtacttctgcgcccggcagaagttcgcccgcggggaccagggctggttcttcgacctgtgggggcggggcaccctgatcgtggtctccagc

SEQ ID NO: 10657 - RNA, 372 nt, synthetic construct
  misc_feature 1..372: note = derived and/or modified sequence opt1 from anti-HIV-1_HeavyChain
  source 1..372: mol_type = other RNA
caggcgcacctggagcagagcggctccggggtgaagaagcccggcgccagcgtccgcgtgtcctgctggaccagcgaggacatcttcgagcggtccgagctcatccactgggtgcgccaggcgccggggcagggcctggagtggatcgggtgggtcaagaccgtgacgggcgccgtgaacttcggcagcaacttccggcagcgcgtctccctgacccgggaccgcgacctcttcaccgcccacatggacatccgggggctgacccagggcgacacggccacctacttctgcgcccgccagaagttctacgccgggggccaggggtggtacttcgacctgtggggccggggcaccctcatcgtggtgagctcc

SEQ ID NO: 10658 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgccaccgggtgagcctcacccgcgaccgggacctgtccaccgcccacatggacatccgcggcctgacgcaggacgacaccgccacctacttctgcgcccggcagaagttcgcgcgcggcgaccaggggtggttcttcgacctctggggccgggggaccctgatcgtcgtgagctcc

SEQ ID NO: 10659 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcaccagcgtccgcgtgtcctgctggaccagcgaggacatcttcgagcggacggagctcatccactgggtgcgccaggccccggggcagggcctggagtggatcgggtgggtcaagaccgtgaccggcgcggtgaacttcggctcccccaacttccggcaccgcgtcagcctgacccgggaccgcgacctcttcacggcccacatggacatccgggggctgacccagggcgacaccgccacctacttctgcgcccgccagaagttcgcccgcggggaccagggctggttcttcgacctgtgggggcggggcacgctcatcgtggtgtccagc

SEQ ID NO: 10660 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgggggcatcttcgagcggaccgagctcatccactgggtgcgccaggcgccggggcagggcctggagtggatcggctgggtcaagacggtgaccggggccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgagcgcgggggccagggctggtacttcgacctgtgggggcggggcaccctcatcgtggtgtccagc

SEQ ID NO: 10661 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccaggacgacacggccacctacttctgcgcccgccagaagttcgcgcggggcgaccaggggtggttcttcgacctctggggccgcgggaccctgatcgtcgtgagctcc

SEQ ID NO: 10662 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagcccggcgccagcgtccgcgtgtcctgctggaccagcgaggacatcttcaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagcgcgggggccaggggtggatcttcgacctgtggggccggggcaccctcatcgcggtgtccagc

SEQ ID NO: 10663 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagcgccccggcgccagcgtccgggtgtcctgctggaccagcgaggacatcttcgagaccacggagctcatccactgggtgcgccaggcgccggggcagggcctggagtggatcgggtgggtcaagaccgtgtccggcgccgtgaacttcggcagcctgaacttccggcaccgcgtctccctcacccgggaccgcgacctgttcaccgcccacatggacatccgggggctgacgcagggcgacaccgccacctacttctgcgcccgccagaagttcgcgcgcggggaccagggctggttcttcgacctctgggggcggggcaccctgatcgtggtgagctcc

SEQ ID NO: 10664 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcagcgcgtctccctgacgcgggaccgcgacctgttcaccgcccacatggacatccgggggctcacccagggcgacaccgccacgtacttctgcgcgcgccagaagttctacgccgggggccaggggtggtacttcgacctgtggggccggggcaccctgatcgtggtgagctcc

SEQ ID NO: 10665 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacctggtccaccagatcagcgaccgcgtgtccctcacccgggaccgcgacctgttcaccgcccacatggacatccggggcctgacccagggggacacggccacctacttctgcgcccgccagaagttctacgcgggcgggcagggctggtacttcgacctctgggggcggggcaccctgatcgtggtcagctcc

SEQ ID NO: 10666 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgggcgggacctcttcaccgcccacatggacatccgcggcctgacccagggggacacggccacctacttctgcgcccggcagaagttctacgcgggcgggcagggctggtacttcgacctgtggggccgcgggaccctcatcgtggtgtccagc

SEQ ID NO: 10667 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggcgccggggtgaagaagcccggcgcgtccgtccgcgtgagctgctggacctccgaggacatcttcgagcggaccgagctcatccactgggtgcgccaggccccggggcagggcctggagtggatcgggtgggtcaagacggtgaccggcgccgtgaacttcggcagccccaacttccggcaccgcgtctccctgacccgggaccgcgacctcttcaccgcccacatggacatccgggggctgacgcagggcgacaccgccacctacttctgcgcgcgccagaagttcgagcgcgggggccaggggtggtacttcgacctgtggggccggggcaccctcatcgtggtgagctcc

SEQ ID NO: 10668 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacaccacggagctcatccactgggtgcggcaggcgccgggccaggggctggagtggatcggctgggtgaaggccgtcagcggggccgtgaactacggctccctggacttccgccaccgggtgagcctcacccgcgaccgggacctgtccaccgcccacatggacatccgcggcctgacccaggacgacacggccacctacttctgcgcgcggcagaagttcgcccgcggggaccagggctggttcttcgacctctgggggcggggcaccctgatcgtcgtgagctcc

SEQ ID NO: 10669 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagcccggcgccagcgtccgcgtgtcctgctggaccagcgaggacatcttcaagaccgagctcatccactgggtgcggcaggcgccggggcagggcctggagtggatcgggtgggtcaagacggtgtccggcgccgtgaacttcggcagccccaacttccgccaccgggtctccctgacccgcgaccgggacctcttcaccgcccacatggacatccgcgggctgacccagggcgacacggccacctacttctgcgcccggcagaagttcgagcgcgggggccaggggtggtacttcgacctgtggggccggggcaccctcatcgtggtgagctcc

SEQ ID NO: 10670 - RNA, 375 nt, synthetic construct
  misc_feature 1..375: note = derived and/or modified sequence opt1 from anti-HIV-1_HeavyChain
  source 1..375: mol_type = other RNA
caggtgcacctggagcagagcggctccggggtcaagaagctcggcgccagcgtgcgcgtgtcctgctggaccagcgaggacatcttcgagcggaccgagctgatccactgggtccgccaggcccccgggcagggcctggagtggatcgggtgggtgaaggcggtgtccggcgccgtcaactacggcagcctcgacttccggcaccgcgtgtccctgacgcgggaccgcgacctgttcaccgcccacatggacatccgggggctcacccaggacgacaccgccacgtacttctgcgcccgccagaagttcgcgcggggcgaccaggggtggttcttcgacctgtggggccgcgggaccctgatcgtggtcagctcc

SEQ ID NO: 10671 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcgcctccggcgtgaagcgccccggggcgagcgtccgggtgtcctgctggaccagcgaggacatcttcgagcgctccgagctcatctactgggtgcggcaggccccgggccaggggctggagtggatcggctgggtcaagaccgtgagcggggccgtgaacctggcccccaacttccgccagcgggtctccctcacgcgcgaccgggacctgttcaccgcccacatggacatccgcggcctgacccagggcgacaccgcgacgtacttctgcgcccggcagaagttcgagcgcgggggccaggggtggatcttcgacctctggggccgggggaccctgatcgccgtgagctcc

SEQ ID NO: 10672 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagcccggcgccagcgtccgcgtgtcctgctggaccagcgaggacatcttcaagtccgagctcatccactgggtgcggcaggcgccggggcagggcctggagtggatcgggtgggtcaagaccgtgacgggcgccgtgaacttcggcagctccgacttccgccagcgggtcagcctgacccgcgacggggacctcttcaccgcccacatggacatccggggcctgacccagggggacacggccacctacttctgcgcccgccagaagttctacgcgggcgggcagggctggtacttcgacctgtggggccgggggaccctcatcatcgtgtccagc

SEQ ID NO: 10673 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgagcgaccgggacctgtccaccgcccacatggacatccgcgggctcacccaggacgacaccgccacgtacttctgcgcgcggcagaagttcgcccgcggcgaccaggggtggttcttcgacctgtggggccgggggaccctgatcgtggtgagctcc

SEQ ID NO: 10674 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctctccaccgcccacatggacatccgcgggctgacccaggacgacacggccacctacttctgcgcccggcagaagttcgcgcgcggcgaccaggggtggttcttcgacctgtggggccgggggaccctcatcgtggtgagctcc

SEQ ID NO: 10675 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagcccggcgccagcgtccgcgtgtcctgctggaccagcgaggacatcttcaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagcgcgggggccaggggtggtacttcgacctgtggggccggggcaccctcatcgtggtgtccagc

SEQ ID NO: 10676 - RNA, 372 nt, synthetic construct
  misc_feature 1..372: note = derived and/or modified sequence opt1 from anti-HIV-1_HeavyChain
  source 1..372: mol_type = other RNA
caggcgcacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggccaccagatcagcgaccgcgtctccctgacccgggaccgcgacctcttcaccgcccacatggacatccgggggctgacccagggcgacacggccacctacttctgcgcccgccagaagttctacgccgggggccaggggtggtacttcgacctgtggggccggggcaccctcatcgtggtgagctcc

SEQ ID NO: 10677 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccaggacgacacggccacctacttctgcgcccggcagaagttcgcgcgcggcgaccaggggtggttcttcgacctgtggggccgggggaccctcatcgtggtgtccagc

SEQ ID NO: 10678 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagctcggcgccagcgtccgcgtgtcctgctggaccagcgaggacatcctgaagaccgagctgatccactgggtgcggcaggcgcccgggcagggcctcgagtggatcgggtgggtcaaggccgtgtccggcgccgtgaactacggcagcctggacttccgccaccgggtctccctgacgcgcgaccgggacctcttcaccgcccacatggacatccgcgggctgacccaggacgacaccgccacgtacttctgcgcgcggcagaagttcgcccgcggcgaccaggggtggttcttcgacctgtggggccgggggaccctcatcgtggtgagctcc

SEQ ID NO: 10679 - RNA, 372 nt, synthetic construct
  misc_feature 1..372: note = derived and/or modified sequence opt1 from anti-HIV-1_HeavyChain
  source 1..372: mol_type = other RNA
gtgcgcagcgtcgtgcagtgcgaggccggcgtgaagaagcccggggcctccgtcaagatcagctgcgcgacctccggctacgccttcaccctgtactacctccactgggtgcggcaggccccggggcagggcctggagtggatcgggtgggtgaagacggtcaccggcgccgtgaacttcggcagcgcctacttccgccaccgggtgtccctgacccccgaccgcgacctcttcaccgcgcacatggacatccgggggctgacgcagggcgacaccgccacctacttctgcgcccgccagaagttctacaagggcgggcaggggtggtacttcgacctgtggggccggggcaccctcatcgtcgtgagctcc

SEQ ID NO: 10680 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgcctggacagcgaggacatcttcgagcggaccgagctgatccactgggtgcgccaggcgcccgggcagggcctcgagtggatcgggtgggtcaaggccgtgtccggcgccgtgaactacggcagcctggacttccggcaccgcgtctccctgacccgggaccgcgacctcttcacggcccacatggacatccgggggctgacccaggacgacaccgccacctacttctgcgcgcgccagaagttcgcccggggcgaccaggggtggttcttcgacctgtggggccgcgggacgctcatcgtggtgagctcc

SEQ ID NO: 10681 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgcgcgcggcgaccaggggtggttcttcgacctctggggccgggggaccctgatcgtggtctccagc

SEQ ID NO: 10682 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtcaagtccagctgctggacctccgaggacatcttcgagcgcaccgagctgatccactgggtgcggcaggcgcccgggcagggcctggagtggatcgggtgggtgaaggccgtcagcggcgccgtgaactacggctccctcgacttccgccaccgggtgagcctgacgcgcgaccgggacctgtccaccgcccacatggacatccgcgggctcacccaggacgacaccgccacgtacttctgcgcgcggcagaagttcgcccgcggcgaccaggggtggttcttcgacctgtggggccgggggaccctgatcgtcgtgagctcc

SEQ ID NO: 10683 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggcgccggggtgaagaagcccggcgcgtccgtccgcgtgagctgctggacctccgaggacatcttcgagcggaccgagctcatccactgggtgcgccaggccccggggcagggcctggagtggatcgggtgggtcaagatcgtgagcggcgccgtgaacttcggctcccccaacttccggcagcgcgtcagcctgacgcgggaccgcgacctcttcaccgcccacatggacatccgggggctgacccagggcgacaccgccacgtacttctgcgcgcgccagaagttcgagcgcgggggccaggggtggatcttcgacctgtggggccggggcaccctcatcgccgtgtccagc

SEQ ID NO: 10684 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtggatgaagacggtcaccggcgccgtgaacttcggctcccccaacttccggcaccgcgtgagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtcgtgtccagc

SEQ ID NO: 10685 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccgaggtgaagaagcccggggccagcgtccgcgtgtcctgctggaccagcgaggacatcttcgagcggaccgagctcatccactgggtgcgccaggcgccgggccaggggctggagtggatcggctgggtcaagacggtgaccggggccgtgaacttcggctcccccaacttccggcaccgcgtcagcctgacccgggaccgcgacctcttcaccgcccacatggacatccggggcctgacgcagggggacaccgccacctacttctgcgcccgccagaagttcgagcggggcgggcagggctggtacttcgacctgtgggggcgcggcaccctcatcgtggtgtccagc

SEQ ID NO: 10686 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggcgccggggtgaagaagctcggcgcgtccgtccgcgtgagctgctggacctccggggacatcttcgagcggaccgagctgatccactgggtgcgccaggcccccggccaggggctggagtggatcggctgggtcaaggccgtgagcggcgccgtgaactacgggtccctcgacttccggcagcgcgtcagcctgacgcgggaccgcgacctgttcaccgcccacatcgacatccggggcctcacccagggggacaccgcgacgtacttctgcgcccgccagaagttcgagcggggcgggcagggctggatcttcgacctgtggggccgcgggaccctgatcgccgtgtccagc

SEQ ID NO: 10687 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctgggcgagcgaggacatcttcgagcggaccgagctgatccactgggtgcgccaggcccccgggcagggcctggagtggatcgggtgggtcaaggccgtgtccggcgccgtgaactacggcagcctcgacttccggcaccgcgtctccctgacccgggaccgcgacctgagcacggcccacatggacatccgggggctcacccaggacgacaccgcgacctacttctgcgcccgccagaagttcgcccggggcgaccaggggtggttcttcgacctgtggggccgcgggacgctgatcgtggtgtccagc

SEQ ID NO: 10688 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcaccgtgaacttcggctcccagaacttccggcagcgcgtcagcctgacccgggaccgcgacctcttcacggcccacatggacatccgggggctgacccagggcgacaccgccacctacttctgcgcccgccagaagttcgagcgcgggggccaggggtggatcttcgacctgtggggccggggcacgctcatcgccgtgtccagc

SEQ ID NO: 10689 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagcgccccggcgccagcgtccgggtgtcctgctggaccagcgaggacatcttcgagaccacggagctcatccactgggtgcgccaggcgccggggcagggcctggagtggatcgggtgggtcaagaccgtgaccggcgccgtgaacttcggctcccccaacttccggcaccgcgtcagcctgacccgggaccgcgacctcttcacggcccacatggacatccgggggctgacccagggcgacaccgccacctacttctgcgcccgccagaagttcgagcgcgggggccaggggtggtacttcgacctgtggggccggggcacgctcatcgtggtgtccagc

SEQ ID NO: 10690 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcctccggaagtccgagctgatccactgggtgcgccaggcgccggggcagggcctggagtggatcgggtgggtcaagaccgtgacgggcgccgtgaacttcggcagctccgacttccggcagcgcgtcagcctcacccgggaccgcgacctgttcaccgcccacatggacatccgggggctgacccagggcgacacggccacctacttctgcgcccgccagaagttctacgccgggggccaggggtggtacttcgacctctggggccggggcaccctgatcgtggtgtccagc

SEQ ID NO: 10691 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagcccggcgccagcgtccgcgtgtcctgctggaccagcgaggacatcttcaagaccgagctcatccactgggtgcggcaggcgccggggcagggcctggagtggatcgggtgggtcaagacggtgaccggcaccgtgaacttcggctccctgaacttccgccagcgggtcagcctcacccgcgaccgggacctgttcacggcccacatggacatccgcgggctgacccagggcgacaccgccacctacttctgcgcccggcagaagttctacgccgggggccaggggtggtacttcgacctctggggccgcggcacgctgatcgtggtgtccagc

SEQ ID NO: 10692 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtacttctgcgcgcgccagaagttcgcccggggcgaccaggggtggttcttcgacctgtggggccgcgggaccctgatcgtggtgagctcc

SEQ ID NO: 10693 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccagcgacttccggcagcgcgtctccctgacccgggaccgcgacctcttcaccgcccacatggacatccgggggctgacgcagggcgacaccgccacctacttctgcgcccgccagaagttctacgccgggggccaggggtggtacttcgacctgtggggccggggcaccctcatcgtggtgagctcc

SEQ ID NO: 10694 - RNA, 375 nt, synthetic construct
  misc_feature 1..375: note = derived and/or modified sequence opt1 from anti-HIV-1_HeavyChain
  source 1..375: mol_type = other RNA
caggtgcagctggtccagagcggcgccgaggtgaagaagcccggggcctccgtgcgcgtcagctgctggacctccgaggacatcttcgagcggagcgagctcatctactgggtgcgccaggcgccgggccgggggctggagtggatcggctggatcaagctggtgtccggggccgtcaacttcggcagcgtggacttccgcgaccgggtgtccctcacccgcgaccgggacctgttcacggcccacatggacatccgcggcctgacccaggacgacaccgccacctacttctgcgcccggcagaagttcgcgcgcggggaccagggctggttcttcgacctctgggggcggggcacgctgatcgtcgtgagctcc

SEQ ID NO: 10695 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagccgctccggcgtgaagaagcccggggccagcgtccgggtgtcctgctggaccagcgaggacatcttcgagcgcaccgagctcatccactgggtgcggcaggcgccgggccaggggctggagtggatcggctgggtcaaggccgtgtccggggccgtgaacttcggcagccccaacttccgccaccgggtctccctgacgcgcgaccgggacctcagcaccgcccacatggacatccgcggcctgacccaggacgacaccgccacgtacttctgcgcgcggcagaagttcgcccgcggggaccagggctggttcttcgacctgtgggggcggggcaccctcatcgtggtgtccagc

SEQ ID NO: 10696 - RNA, 375 nt, synthetic construct
  misc_feature 1..375: note = derived and/or modified sequence opt1 from anti-HIV-1_HeavyChain
  source 1..375: mol_type = other RNA
cagagctacctggagcagtccggcagcgcgatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgttcaccgcccacatggacatccgcggcctgacccagggcgacacggccacctacttctgcgcccggcagaagttctacgccgggggccaggggtggtacttcgacctctggggccgcgggaccctgatcgtggtcagctcc

SEQ ID NO: 10697 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagaccgagctcatccactgggtgcggcaggcgccggggcagggcctggagtggatcgggtgggtcaaggccgtgtccggcgccgtgaactacggcagcctggacttccgccaccgggtctccctcacgcgcgaccgggacctgttcaccgcccacatggacatccgcgggctgacccaggacgacaccgccacgtacttctgcgcgcggcagaagttcgcccgcggcgaccaggggtggttcttcgacctctggggccgggggaccctgatcgtggtgagctcc

SEQ ID NO: 10698 - RNA, 372 nt, synthetic construct
  misc_feature 1..372: note = derived and/or modified sequence opt1 from anti-HIV-1_HeavyChain
  source 1..372: mol_type = other RNA
caggcgcacctggagcagagcggctccggggtgaagaagcccggcgccagcgtccgcgtgtcctgctggaccagcgaggacatcttcaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgtccagc

SEQ ID NO: 10699 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccaggacgacacggccacctacttctgcgcccgccagaagttcgcgcggggcgaccaggggtggttcttcgacctgtggggccgcgggaccctcatcgtggtgagctcc

SEQ ID NO: 10700 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttcgcgcgcggggaccagggctggttcttcgacctgtgggggcggggcaccctcatcgtggtgagctcc

SEQ ID NO: 10701 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccagggcgacaccgccacgtacttctgcgcgcgccagaagttctacgccgggggccaggggtggtacttcgacctgtggggccggggcaccctgatcgtggtgagctcc

SEQ ID NO: 10702 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccagggcgacacggccacctacttctgcgcccggcagaagttcgagcgcgggggccaggggtggtacttcgacctctggggccgggggaccctgatcgtggtctccagc

SEQ ID NO: 10703 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgccagcgggtgagcctcacccgcgaccgggacctgttcaccgcccacatggacatccgcggcctgacgcagggcgacaccgccacctacttctgcgcccggcagaagttcgagcgcgggggccaggggtggatcttcgacctctggggccgggggaccctgatcgcggtctccagc

SEQ ID NO: 10704 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcaccgtgaacttcggctccctgaacttccggcagcgcgtcagcctcacccgggaccgcgacctgttcacggcccacatggacatccgggggctgacccagggcgacaccgccacctacttctgcgcccgccagaagttcgagcgcgggggccaggggtggatcttcgacctctggggccggggcacgctgatcgccgtgtccagc

SEQ ID NO: 10705 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtggtgtccagc

SEQ ID NO: 10706 - RNA, 375 nt, synthetic construct
  misc_feature 1..375: note = derived and/or modified sequence opt1 from anti-HIV-1_HeavyChain
  source 1..375: mol_type = other RNA
cgccacaccgtggagcagagcggctccggggtcaagaagcccggcgccagcgtgcgggtgtcctgctggaccagcgaggacatcttcgagcgcacggagctgatccactgggtccggcaggccccggggcagggcctcgagtggatcgggtgggtgaagaccgtgtccggcgcggtcaacttcggcagccccaacttccgccaccgggtgtccctgacccgcgaccgggacctgttcaccgcccacatggacatccgcgggctcacgcagggcgacaccgccacctacttctgcgcccggcagaagttcgagcgcgggggccaggggtggtacttcgacctgtggggccggggcaccctgatcgtggtcagctcc

SEQ ID NO: 10707 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgagcgcgggggccaggggtggtacttcgacctgtggggccggggcaccctcatcgtggtgtccagc

SEQ ID NO: 10708 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcagagcggctccggggtgaagaagctgggcgccagcgtccgggtgtcctgctggaccagcgaggacatcttcgagcgcacggagctcatccactgggtgcggcaggcccccgggcagggcctggagtggatcgggtggatgaaggcggtctccggcgccgtgaactacggcagcctggacttccgccaccgggtgtccctcacccgcgaccgggacctgagcaccgcccacatcgacatccgcgggctgacccaggacgacacggccacctacttctgcgcccggcagaagttcgcgcgcggcgaccaggggtggttcttcgacctctggggccgggggaccctgatcgtcgtgtccagc

SEQ ID NO: 10709 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaagacggtgaccggcgccgtgaacttcggctccccgaacttccggcaccgcgtcagcctcacccgggaccgcgacctgttcaccgcccacatggacatccgggggctgacgcagggcgacaccgccacctacttctgcgcccgccagaagttcgagcgcgggggccaggggtggtacttcgacctctggggccggggcaccctgatcgtggtgtccagc

SEQ ID NO: 10710 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgagcgcgggggccaggggtggatcttcgacctgtggggccggggcaccctcatcgcggtgtccagc

SEQ ID NO: 10711 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccaccgggtcagcctgacccgcgaccgggacctcttcaccgcccacatggacatccgcgggctgacccagggcgacacggccacctacttctgcgcccggcagaagtactacgccgggggccaggggtggtacttcgacctgtggggccgcggcaccctcatcgtggtgtccagc

SEQ ID NO: 10712 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggggatccgcggcctgacccagggggacacggccacctacttctgcgcccggcagaagttctacgcgggcgggcagggctggtacttcgacctgtggggccgcgggaccctcatcgtggtgtccagc

SEQ ID NO: 10713 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcttcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgagctcc

SEQ ID NO: 10714 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaaggccgtgtccggcgccgtgaactacggcagcctggacttccggcaccgcgtctccctcacgcgggaccgcgacctgagcaccgcccacatggacatccgggggctgacccaggacgacaccgccacgtacttctgcgcgcgccagaagttcgcccggggcgaccaggggtggttcttcgacctctggggccgcgggaccctgatcgtggtgtccagc

SEQ ID NO: 10715 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagccaggacttccgcgaccggttctccctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtcgtgagctcc

SEQ ID NO: 10716 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacgcgaccggcctcatctactgggtgcggcaggccccggggcagggcctggagtggatcgggtgggtgaagatcgtcagcggcacggtgaacttcgcctccctggacttccgccagcgggtgagcctcacccgcgaccgggacctgttcaccgcccacatggacatccgcggcctgacccagggggacacggccacctacttctgcgcgcggcagaagttctacgccggcgggcagggctggtacttcgacctctgggggcgcggcaccctgatcgtcgtgtccagc

SEQ ID NO: 10717 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcctacatggacatccgggggctcacccaggacgacaccgccacgtacttctgcgcgcgccagaagttcgcccggggcgaccaggggtggttcttcgacctgtggggccgcgggaccctgatcgtggtgtccagc

SEQ ID NO: 10718 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccatctacctgtgcgcgcgccagaagttcgcccggggcgaccaggggtggttcttcgacctgtggggccgcgggacgctcatcgtggtgagctcc

SEQ ID NO: 10719 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccagggcgacacggccacctacttctgcgcccggcagaagttcgagcgcgggggccaggggtggatcttcgacctctggggccgggggaccctgatcgcggtgtccagc

SEQ ID NO: 10720 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagccccaacttccgccaccgggtctccctgacccgcgaccgggacctcttcaccgcccacatggacatccgcgggctgacccagggcgacacggccacctacttctgcgcccggcagaagttcgagcgcgggggccaggggtggtacttcgacctgtggggccggggcaccctcatcgtggtgagctcc

SEQ ID NO: 10721 - RNA, 375 nt, synthetic construct
  misc_feature 1..375: note = derived and/or modified sequence opt1 from anti-HIV-1_HeavyChain
  source 1..375: mol_type = other RNA
caggcgcaccccgagcagagcggctccggggtgaagaagccgggcgccagcgtccgcgtgtcctgctggaccagcgaggacatcttcgagaagtccgagctgatccactgggtgcggcaggcgcccgggcagggcctcgagtggatcgggtgggtcaagaccgtgacgggcgccgtgaacttcggcagctccgacttccgccagcgggtcagcctgacccgcgaccgggacctgttcaccgcccacatggacatccgcgggctcacccagggcgacacggccacctacttctgcgcccggcagaagttctacgccgggggccaggggtggtacttcgacctgtggggccgcggcaccctgatcgtggtgtccagc

SEQ ID NO: 10722 - RNA, 375 nt, synthetic construct
  misc_feature 1..375: note = derived and/or modified sequence opt1 from anti-HIV-1_HeavyChain
  source 1..375: mol_type = other RNA
cgcgcgcacctggagcagagcggctccggggtgcggaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtgtccagc

SEQ ID NO: 10723 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgagcgcgggggccaggggtggatcttcgacctgtggggccggggcaccctcatcgcggtgagctcc

SEQ ID NO: 10724 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgagaagtccgagctcatccactgggtgcggcaggcgccgggccaggggctggagtggatcggctgggtgaagaccgtcacgggggccgtgaacttcggcagcagcgacttccgccagcgggtgtccctgacccgcgaccgggacctcttcaccgcccacatggacatccgcggcctgacccagggggacacggccacctacttctgcgcccggcagaagttctacgcgggcgggcagggctggtacttcgacctgtgggggcgcggcaccctcatcgtcgtgagctcc

SEQ ID NO: 10725 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcacccacatcgtggtgtccagc

SEQ ID NO: 10726 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgcggtgagctcc

SEQ ID NO: 10727 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccagcgacttccgccaccgggtgtccctgacccgcgaccgggacctcagcaccgcccacatggacatccgcggcctgacgcaggacgacaccgccacctacttctgcgcccggcagaagttcgcgcgcggcgaccaggggtggttcttcgacctgtggggccgggggaccctcatcgtcgtgtccagc

SEQ ID NO: 10728 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacttctgcgcccgccagaagttctacgccgggggccaggggtggtacttcgacctgtggggccggggcaccctcatcgtggtgagctcc

SEQ ID NO: 10729 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggtccgagctcatccactgggtgcgccaggcgccggggcagggcctggagtggatcgggtgggtcaagaccgtgacgggcgccgtgaacttcggcagccccaacttccggcagcgcgtctccctgacccgggaccgcgacctcttcaccgcccacatggacatccgggggctgaccgagggcgacacggccacctacttctgcgcccgccagaagttctacgccgggggccaggggtggtacttcgacctgtggggccggggcaccctcatcgtggtgagctcc

SEQ ID NO: 10730 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgccaactacggcagcctcgacttccggcaccgcgtgtccctgacgcgggaccgcgacctgttcaccgcccacatggacatccgggggctcacccaggacgacaccgcgacgtacttctgcgcccgccagaagttcgcccggggcgaccaggggtggttcttcgacctgtggggccgcgggaccctgatcgtcgtgagctcc

SEQ ID NO: 10731 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgagcggcgccgtgaacttcggctcccccaacttccgccaccgggtcagcctgacgcgcgaccgggacctcttcaccgcccacatggacatccgcgggctgacccagggcgacaccgccacgtacttctgcgcccggcagaagttcgagcgcgggggccaggggtggtacttcgacctgtggggccggggcaccctcatcgtggtgtccagc

SEQ ID NO: 10732 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaacttcggcagcccgaacttccggcaccgcgtctccctcacgcgggaccgcgacctgttcaccgcccacatggacatccgggggctgacccagggcgacaccgccacgtacttctgcgcgcgccagaagttcgagcgcgggggccaggggtggtacttcgacctctggggccggggcaccctgatcgtggtgagctcc

SEQ ID NO: 10733 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcaccgcccacatggacatccgggggctgacccagggcgacaccgccacgtacctgtgcgcccgccagaagttcgagcgcgggggccaggggtggatcttcgacctctggggccggggcaccctgatcgcggtgagctcc

SEQ ID NO: 10734 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgagcggcgccgtgaacttcggctcccccaacttccggcaccgcgtcagcctgacgcgggaccgcgacctcttcaccgcccacatggacatccgggggctgacccagggcgacaccgccacgtacttctgcgcccgccagaagttcgagcgcgggggccaggggtggtacttcgacctgtggggccggggcaccctcatcgtggtgtccagc

SEQ ID NO: 10735 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcaccgtgaacttcggctccctgaacttccggcagcgcgtcagcctcacccgggaccgcgacctgttcacggcccacatggacatccgggggctgacccagggcgacaccgccacctacttctgcgcccgccagaagttctacgccgggggccaggggtggtacttcgacctctggggccggggcacgctgatcgtggtgtccagc

SEQ ID NO: 10736 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcgcctccggcgtgaagcgccccggggcgagcgtccgggtgtcctgctggaccagcgaggacatcttcgagcgctccgagctcatctactgggtgcggcaggccccgggccaggggctggagtggatcggctgggtcaagaccgtgagcggggccgtgaacttcggctccacggacttccgcgagcgggtcagcctgacccgcgaccgggacctcttcaccgcccacatggacatccgcggcctgacccagggggacacggccacctacttctgcgcgcggcagaagttcgcccgcggcgaccaggggtggttcttcgacctgtggggccgggggaccctcatcgtggtgtccagc

SEQ ID NO: 10737 - RNA, 375 nt, synthetic construct
  misc_feature 1..375: note = derived and/or modified sequence opt1 from anti-HIV-1_HeavyChain
  source 1..375: mol_type = other RNA
caggtgcacctggagcagagcggctccggggtcaagaagcccggcgccagcgtgcgcgtgtcctgctggaccagcgaggacatcttcgagcggtccgagctcatccactgggtccgccaggccccggggcagggcctggagtggatcgggtgggtgaagaccgtgacgggcgcggtcaacttcggcagccccaacttccggcaccgcgtgtccctgacccgggaccgcgacctcttcaccgcccacatggacatccgggggctgacccagggcgacacggccacctacttctgcgcccgccagaagtactacgccgggggccaggggtggtacttcgacctgtggggccggggcaccctcatcgtggtcagctcc

SEQ ID NO: 10738 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatctgcgggctgacccagggcgacacggccacctacttctgcgcccgccagaagttctacgccgggggccaggggtggtacttcgacctgtggggccggggcaccctcatcgtggtgtccagc

SEQ ID NO: 10739 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccgaggccagcgtccgcgtgtcctgctggaccagcgaggacatcttcgagaagtccgagctcatccactgggtgcggcaggcgccgggccaggggctggagtggatcggctgggtcaagaccgtgacgggggccgtgaacttcggcagctccgacttccgccagcgggtcagcctgacccgcgaccgggacctcttcaccgcccacatggacatccgcggcctgacccagggggacacggccacctacttctgcgcccggcagaagttctacgcgggcgggcagggctggtacttcgacctgtgggggcgcggcaccctcatcgtggtgtccagc

SEQ ID NO: 10740 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcagcgcgtcagcctgacccgggaccgcgacctcttcaccgcccacatggacatccgggggctgacgcagggcgacaccgccacctacttctgcgcccgccagaagttcgagcgcgggggccaggggtggatcttcgacctgtggggccggggcaccctcatcgcggtgtccagc

SEQ ID NO: 10741 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcgcctccggcgtgaagcgccccggggcgagcgtccgggtgtcctgctggaccagcgaggacatcttcgagcgcaccgagctcatctactgggtgcggcaggccccgggccaggggctggagtggatcggctgggtcaagacggtgtccggggccgtgaacttcggcagccaggacttccgcgaccggttctccctgacccgcgaccgggacctcttcaccgcccacatggacatccgcggcctgacccagggggacacggccacctacttctgcgcgcggcagaagttcgagcgcggcgggcagggctggtacttcgacctgtgggggcggggcaccctcatcgtcgtgagctcc

SEQ ID NO: 10742 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagatcgtgagcggcgccgtgaacttcggctcccccaacttccgccagcgggtcagcctgacccgcgaccgggacctcttcacggcccacatggacatccgcgggctgacccagggcgacaccgccacctacttctgcgcccggcagaagttcgagcgcgggggccaggggtggatcttcgacctgtggggccggggcacgctcatcgcggtgtccagc

SEQ ID NO: 10743 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgaccccttcaccgcccacatggacatccgggggctcacgcagggcgacaccgccacctacttctgcgcccgccagaagttcgagcgcgggggccaggggtggtacttcgacctgtggggccggggcaccctgatcgtggtgtccagc

SEQ ID NO: 10744 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgggctcatccactgggtgcggcaggcgccgggccaggggctggagtggatcggctgggtcaagaccgtgacgggcgccgtgaacttcgggagctccgacttccgccagcgggtcagcctgacccgcgaccgggacctcttcaccgcccacatggacatccgcggcctgacccagggggacacggccacctacttctgcgcccggcagaagttctacgcgggcgggcagggctggtacttcgacctgtggggccgcgggaccctcatcgtggtgtccagc

SEQ ID NO: 10745 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaaggccgtgagcggcaccgtgaactacggctccctggacttccgccaccgggtcagcctcacgcgcgaccgggacctgttcaccgcccacatggacatccgcgggctgacccaggacgacaccgccacgtacttctgcgcccggcagaagttcgcgcgcggcgaccaggggtggttcttcgacctctggggccgggggaccctgatcgtggtgtccagc

SEQ ID NO: 10746 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgaggggtccgagctcatccactgggtgcggcaggcgccgggccaggggctggagtggatcggctgggtcaagaccgtgacgggcgccgtgaacttcgggagcgcctacttccgccaccgggtctccctgacccgcgaccgggacctcttcaccgcccacatggacatccgcggcctgacccagggggacacggccacctacttctgcgcgcggcagaagttctacgccggcgggcagggctggtacttcgacctgtggggccgcgggaccctcatcgtggtgagctcc

SEQ ID NO: 10747 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttctacgccgggggccaggggtggtacttcgacctctggggccggggcaccctgatcgtcgtgagctcc

SEQ ID NO: 10748 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaaggccgtgagcggcgccgtgaactacggctccctggacttccggcaccgcgtcagcctcacccgggaccgcgacctgtccacggcccacatggacatccgggggctgacccaggacgacaccgccacccacttctgcgcgcgccagaagttcgcccggggcgaccaggggtggttcttcgacctctggggccgcgggacgctgatcgtggtgagctcc

SEQ ID NO: 10749 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgaggggaccgagctcatccactgggtgcggcaggcgccgggccaggggctggagtggatcggctgggtcaagatcgtgtccggcgccgtgaacttcgggagccccaacttccgccagcgggtctccctgacgcgcgaccgggacctcttcaccgcccacatggacatccgcggcctgacccagggggacaccgccacgtacttctgcgcccggcagaagttcgagcgcggcgggcagggctggatcttcgacctgtggggccgggggaccctcatcgcggtgagctcc

SEQ ID NO: 10750 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcagcgcgtcagcctgacccgggaccgcgacctcttcaccgcccacatggacatccgggggctgacgcagggcgacaccgccacctacttctgcgcccgccagaagttctacgccgggggccaggggtggtacttcgacctgtggggccggggcaccctcatcgtggtgtccagc

SEQ ID NO: 10751 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgaggggtccgagctcatccactgggtgcggcaggcgccgggccaggggctggagtggatcggctgggtcaagaccgtgacgggcgccgtgaacttcgggagccccaacttccgccaccgggtctccctgacccgcgaccgggacctcttcaccgcccacatggacatccgcggcctgacccagggggacacggccacctacttctgcgcccggcagaagttcgagcgcggcgggcagggctggtacttcgacctgtggggccgggggaccctcatcgtggtgagctcc

SEQ ID NO: 10752 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgcgcgcggggaccagggctggttcttcgacctgtgggggcggggcaccctcatcgtggtgagctcc

SEQ ID NO: 10753 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggggatcttcgagcggaccgagctcatccactgggtgcgccaggcgccgggccaggggctggagtggatcggctgggtcaagatcgtgtccggcgccgtgaacttcgggagccccaacttccggcagcgcgtctccctgacgcgggaccgcgacctcttcgccgcccacatggacatccggggcctgacccagggggacaccgccacctacttctgcgcgcgccagaagttcgagcggggcgggcagggctggatcttcgacctgtggggccgcgggacgctcatcgccgtgagctcc

SEQ ID NO: 10754 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcgggcggagctgatccactgggtgcgccaggcccccgggcagggcctggagtggatcgggtgggtcaaggccgtgtccggcgccgtgaactacggcagcctcgacttccggcaccgcgtctccctgacccgggaccgcgacctgttcacggcccacatggacatccgggggctcacccaggacgacaccgcgatctacttctgcgcccgccagaagttctacgccggcgggcagggctggtacttcgacctgtgggggcggggcaccctgatcgtggtgagctcc

SEQ ID NO: 10755 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcccgaacttccggcagcgcgtctccctcacgcgggaccgcgacctgttcaccgcccacatggacatccgggggctgacccagggcgacaccgccacgtacttctgcgcgcgccagaagttcgagcgcgggggccaggggtggatcttcgacctctggggccggggcaccctgatcgccgtgagctcc

SEQ ID NO: 10756 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaactacggctccctgaacttccggagccgcatctccctcacccgggaccgcgacctgttcaccgcccacatggacatccgggggctgacggagggcgacaccgccacctacttctgcgcccgccagaagttctacgccgggggccaggggtggtacttcgacctctggggccggggcaccctgatcgtcgtgagctcc

SEQ ID NO: 10757 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgagcggcgccgtgaacttcggctcccccaacttccgccagcgggtcagcctgacgcgcgaccgggacctcttcaccgcccacatggacatccgcgggctgacccagggcgacaccgccacgtacttctgcgcccggcagaagttcgagcgcgggggccaggggtggatcttcgacctgtggggccggggcaccctcatcgcggtgtccagc

SEQ ID NO: 10758 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatccggtgggtcaaggccgtgtccggggccgtgaactacggcagcctcgacttccgccaccgggtctccctgacgcgcgaccgggacctgagcaccgcccacatggacatccgcggcctcacccaggacgacaccgccacgtacttctgcgcgcggcagaagttcgcccgcggggaccagggctggttcttcgacctgtgggggcggggcaccctgatcgtggtgtccagc

SEQ ID NO: 10759 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaagacggtgaccggcgccgtgaacttcggctccagcgacttccggcagcgcgtctccctcacccgggaccgcgacctgttcaccgcccagatggacatccgggggctgacgcagggcgacaccgccacctacttctgcgcccgccagaagttctacgccgggggccaggggtggtacttcgacctctggggccggggcaccctgatcgtggtgagctcc

SEQ ID NO: 10760 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcgcccaccagatcagcgaccgcgtctccctgacccgggaccgcgacctcttcaccgcccacatggacatccggggcctgacccagggggacacggccacctacttctgcgcgcgccagaagttctacgccggcgggcagggctggtacttcgacctgtgggggcggggcaccctcatcgtggtgagctcc

SEQ ID NO: 10761 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaaggtggtgtccggcgccgtcaacttcggcagccccaacttccggcagcgcgtgtccctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgcggtgagctcc

SEQ ID NO: 10762 - RNA, 375 nt, synthetic construct
  misc_feature 1..375: note = derived and/or modified sequence opt1 from anti-HIV-1_HeavyChain
  source 1..375: mol_type = other RNA
caggtgcacctggagcagagcggctccggggtcaagaagcccggcgccagcgtgcgcgtgtcctgctggaccagcgaggacatcttcgagaagtccgagctcatccactgggtccggcaggccccggggcagggcctggagtggatcgggtgggtgaagaccgtgacgggcgcggtcaacttcggcagctccgacttccgccagcgggtgagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtctccagc

SEQ ID NO: 10763 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttcgagcgcgggggccaggggtggatcttcgacctctggggccggggcaccctgatcgcggtcagctcc

SEQ ID NO: 10764 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcctacatggacatccgcggcctgacccaggacgacacggccacctacttctgcgcccggcagaagttcgcgcgcggcgaccaggggtggttcttcgacctctggggccgggggaccctgatcgtggtctccagc

SEQ ID NO: 10765 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacctgtgcgcccgccagaagttcgagcgcgggggccaggggtggtacttcgacctctggggccggggcaccctgatcgtggtgtccagc

SEQ ID NO: 10766 - RNA, 372 nt, synthetic construct
  misc_feature 1..372: note = derived and/or modified sequence opt1 from anti-HIV-1_HeavyChain
  source 1..372: mol_type = other RNA
cgccacacctgggagcagagcggctccggggtgaagaagcccggcgccagcgtccgggtgtcctgctggaccagcgaggacatcttcaagtccgagctgatccactgggtgcgccaggccccggggcagggcctcgagtggatcgggtgggtcaagacggtgaccggcgcggtgaacttcggcagctccgacttccggcagcgcgtcagcctgacccgggaccgcgacctgttcaccgcccacatggacatccgggggctcacgcagggcgacaccgccacctacttctgcgcccgccagaagttctacgccgggggccaggggtggtacttcgacctgtggggccggggcaccctgatcgtggtgtccagc

SEQ ID NO: 10767 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacggagggcgacaccgccacctacttctgcgcccgccagaagttctacgccgggggccaggggtggtacttcgacctgtggggccggggcaccctcatcgtggtgtccagc

SEQ ID NO: 10768 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccgcctacttccggcaccgcgtcagcctgacccgggaccgcgacctcttcaccgcccacatggacatccgggggctgacgcagggcgacaccgccacctacttctgcgcgcgccagaagttctacaagggcgggcaggggtggtacttcgacctgtggggccggggcaccctcatcgtggtgtccagc

SEQ ID NO: 10769 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggccccggggtgaagaagctcggcgcctccgtccgcgtgagctgctggacctccgaggacatcttcgagcggaccgagctgatccactgggtgcgccaggcgccggggcagggcctggagtggatcgggtgggtcaaggccgtgagcggcgccgtgaactacggctccctcgacttccggcaccgcgtcagcctgacgcgggaccgcgacctgttcaccgcccacatggacatccgggggctcacccaggacgacaccgccacgtacttctgcgcgcgccagaagttcgcccggggcgaccaggggtggttcttcgacctgtggggccgcgggaccctgatcgtggtgtccagc

SEQ ID NO: 10770 - RNA, 375 nt, synthetic construct
  misc_feature 1..375: note = derived and/or modified sequence opt1 from anti-HIV-1_HeavyChain
  source 1..375: mol_type = other RNA
cgcgcccacctggagcagagcggctccggggtgaagaagcccggcgccagcgtccgggtgtcctgctggaccagcgaggacatcttcgagcgcaccgagctcatccactgggtgcggcaggcgccggggcagggcctggagtggatcgggtgggtcaagatcgtgtccggcgccgtgaacttcggcagccccaacttccgccagcgggtctccctgacgcgcgaccgggacctcttcaccgcccacatggacatccgcgggctgacccagggcgacaccgccacgtacttctgcgcccggcagaagttcgagcgcgggggccaggggtggatcttcgacctgtggggccggggcaccctcatcgcggtgagctcc

SEQ ID NO: 10771 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaagacggtgaccggcgccgtgaacttcggctccagcgacttccggcagcgcgtctccctcacccgggaccgcgacctgttcaccgcccacatggacatccgggggctgacgcagggcgacaccgccacctacttctgcgcccgccagaagttctacgccgggggccaggggtggtacttcgacctctggggccggggcaccctgatcgtggtgagctcc

SEQ ID NO: 10772 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaaggccgtgagcggcgccgtgaactacggctccctggacttccggcaccgcgtcagcctcacccgggaccgcgacctgttcacggcccacatggacatccgggggctgacccaggacgacaccgccatctacttctgcgcgcgccagaagttcgcccggggcgaccaggggtggttcttcgacctctggggccgcgggaccctgatcgtggtgtccagc

SEQ ID NO: 10773 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaaggtcggcgccagcgtgcgcgtgtcctgctggaccagcgaggacatcttcgagcggaccgagctcatccactgggtccgccaggcgcccgggcagggcctggagtggatcgggtgggtgaaggccgtgtccggcgccgtcaactacggcagcctggacttccggcaccgcgtgtccctcacgcgggaccgcgacctgttcaccgcccacatggacatccgggggctgacccaggacgacaccgccatctacttctgcgcgcgccagaagttcgcccggggcgaccaggggtggttcttcgacctctggggccgcgggacgctgatcgtggtcagctcc

SEQ ID NO: 10774 - RNA, 375 nt, synthetic construct
  misc_feature 1..375: note = derived and/or modified sequence opt1 from anti-HIV-1_HeavyChain
  source 1..375: mol_type = other RNA
caggtgcagctggtccagagcggcgccgagctcaagaagcccgggtccagcgtgcgcgtgtcctgctggaccagcgaggacatcttcgagggctccgagctgatccactgggtccggcaggccccggggcagggcctggagtggatcgggtgggtgaagaccgtgacgggcgcggtcaacttcggcagcgcctacttccgccaccgggtgtccctcacccgcgaccgggacctgttcaccgcccacatggacatccgcgggctgacccagggcgacacggccacctacttctgcgcccggcagaagttctacaagggcgggcaggggtggtacttcgacctctggggccgcggcaccctgatcgtggtcagctcc

SEQ ID NO: 10775 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgtcagcgtgcgcgtgtcctgctggaccagcgaggacatcttcgagcggaccgagctcatccactgggtccgccaggccccggggcagggcctggagtggatcgggtgggtgaagatcgtgtccggcgcggtcaacttcggcagccccaacttccggcagcgcgtgtccctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgccgtgagctcc

SEQ ID NO: 10776 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggtggtgtccggcgccgtcaactacggcagcctcgacttccggcaccgcgtgtccctgacgcgggaccgcgacctgttcaccgcccacatggacatccgggggctcacccaggacgacaccgccacgtacttctgcgcccgccagaagttcgcgcggggcgaccaggggtggttcttcgacctgtggggccgcgggaccctgatcgtggtcagctcc

SEQ ID NO: 10777 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccgcgtacttctgcgcccgccagaagttcgcccggggcgaccaggggtggttcttcgacctgtggggccgcgggacgctgatcgtggtgagctcc

SEQ ID NO: 10778 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgcgcaagcccggcgccagcgtccgggtgtcctgctggaccagcgaggacatcttcgagaagtccgagctcatccactgggtgcgccaggcgccggggcagggcctggagtggatcgggtgggtcaagaccgtgacgggcgccgtgaacttcggcagctccgacttccggcagcgcgtcagcctgacccgggaccgcgacctcttcaccgcccacatggacatccgggggctgacccagggcgacacggccacctacttctgcgcccgccagaagttctacgccgggggccaggggtggtacttcgacctgtggggccggggcaccctcatcgtggtgtccagc

SEQ ID NO: 10779 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcaccgtgaacttcggctccctgaacttccggcagcgcgtcagcctcacccgggaccgcgacctgttcacggcccacatggacatccgggggctgacccagggcgacaccgccacctacttctgcgcccgccagaagttctacaagggcgggcaggggtggtacttcgacctctggggccggggcacgctgatcgtggtgtccagc

SEQ ID NO: 10780 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgagcggaccgagctcatccactgggtgcgccaggcgccgggccaggggctggagtggatcggctgggtgaaggccgtcagcggggccgtgaactacggctccctggacttccggcaccgcgtgagcctcacgcgggaccgcgacctgttcaccgcccacatggacatccggggcctgacccaggacgacaccgccacgtacttctgcgcgcgccagaagttcgcccgcggggaccagggctggttcttcgacctctgggggcggggcaccctgatcgtcgtgtccagc

SEQ ID NO: 10781 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcgtctccctcacccgggaccgcgacctgttcaccgcccacatggacatccgggggctgacccagggcgacacggccacctacttctgcgcccgccagaagttcgcgcgcggggaccagggctggttcttcgacctctgggggcggggcaccctgatcgtggtgagctcc

SEQ ID NO: 10782 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagcgccccggcgccagcgtccgggtgtcctgctggaccagcgaggacatcttcgagaccacggagctcatccactgggtgcgccaggcgccggggcagggcctggagtggatcgggtgggtcaagaccgtgtccggcgccgtgaacttcggcagcctgaacttccggcaccgcgtctccctcacccgggaccgcgacctgttcaccgcccacatggacatccgggggctgacgcagggcgacaccgccacctacttctgcgcccgccagaagttctacaagggcgggcaggggtggtacttcgacctctggggccggggcaccctgatcgtggtgagctcc

SEQ ID NO: 10783 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcgcctccggcgtgcgccggcccggggcgagcgtccgcgtgtcctgctggaccagcgaggacatcttcgagcggtccgagctcatctactgggtgcgccaggccccgggccgggggctggagtggatcggctggatcaagctggtcagcggggccgtgaacttcggctccgtggacttccgcgaccgggtcagcctcacccgcgaccgggacctgttcacggcccacatggacatccgcggcctgacccagggggacaccgccacctacttctgcgcgcggcagaagttctacgccggcgggcagggctggtacttcgacctctgggggcgcggcacgctgatcgtggtgtccagc

SEQ ID NO: 10784 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagatcgtgagcggcgccgtgaacttcggctcccccaacttccggcagcgcgtcagcctgacccgggaccgcgacctcttcacggcccacatggacatccgggggctgacccagggcgacaccgccacctacttctgcgcccgccagaagttcgagcgcgggggccaggggtggatcttcgacctgtggggccggggcacgctcatcgcggtgtccagc

SEQ ID NO: 10785 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaagacggtgtccggcgccgtgaacttcggcagcccgaacttccggcaccgcgtctccctcacccgggaccgcgacctgttcaccgcccacatggacatccgggggctgacccagggcgacacggccacctacttctgcgcccgccagaagttcgagcgcgggggccaggggtggtacttcgacctctggggccggggcaccctgatcgtggtgagctcc

SEQ ID NO: 10786 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagcgccccggcgccagcgtccgggtgtcctgctggaccagcgaggacatcttcgagaagtccgagctcatccactgggtgcgccaggcgccggggcagggcctggagtggatcgggtgggtcaagaccgtgacgggcgccgtgaacttcggcagctccgacttccggcagcgcgtcagcctgacccgggaccgcgacctcttcaccgcccacatggggatccggggcctgacccagggggacacggccacctacttctgcgcccgccagaagttctacgcgggcgggcagggctggtacttcgacctgtggggccgggggaccctcatcgtggtgtccagc

SEQ ID NO: 10787 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaaggccgtgtccggcgccgtgaactacggcagcctggacttccggcaccgcgtctccctcacgcgggaccgcgacctgttcaccgcccacatggacatccgggggctgacccaggacgacaccgccatctacttctgcgcgcgccagaagttcgcccggggcgaccaggggtggttcttcgacctctggggccgcgggacgctgatcgtggtgagctcc

SEQ ID NO: 10788 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagctcggggcctccgtgcgcgtcccctgctggaccagcgaggacatcttcgagcggaccgagctgatccactgggtgcgccaggcgccgggccaggggctggagtggatcggctgggtgaaggccgtctccggggccgtgaactacggcagcctcgacttccggcaccgcgtgtccctgacgcgggaccgcgacctgttcaccgcccacatggacatccggggcctcacccaggacgacaccgccacgtacttctgcgcgcgccagaagttcgcccgcggggaccagggctggttcttcgacctgtgggggcggggcaccctgatcgtcgtgagctcc

SEQ ID NO: 10789 - RNA, 375 nt, synthetic construct
  misc_feature 1..375: note = derived and/or modified sequence opt1 from anti-HIV-1_HeavyChain
  source 1..375: mol_type = other RNA
caggtgcacctggagcagagcggctccggggtcaagaagcccggcgccagcgtgcgcgtgtcctgctggaccagcgaggacatcttcgagcggaccgagctcatccactgggtccgccaggccccggggcagggcctggagtggatcgggtgggtgaagatcgtgtccggcgcggtcaacttcggcagccccaacttccggcagcgcgtgtccctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgccgtgagctcc

SEQ ID NO: 10790 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaaggccgtgtccggcgccgtgaactacggcagcctggacttccggcaccgcgtctccctcacgcgggaccgcgacctgttcaccgcccacatggacatccgggggctgacccaggacgacaccgccacgtacttctgcgcgcgccagaagttcgcccggggcgaccaggggtggttcttcgacctctggggccgcgggaccctgatcgtggtgagctcc

SEQ ID NO: 10791 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcgcctccggcgtgcgccggcccggggcgagcgtccgcgtgtcctgctggaccagcgaggacatcttcgagcggtccgagctcatctactgggtgcgccaggccccgggccgggggctggagtggatcggctgggtcaagaccgtgagcggggccgtgaacttcggctcccccaacttccgccaccgggtcagcctgacgcgcgaccgggacctcttcaccgcccacatggacatccgcggcctgacccagggggacaccgccacgtacttctgcgcgcggcagaagttcgagcgcggcgggcagggctggtacttcgacctgtgggggcggggcaccctcatcgtggtgtccagc

SEQ ID NO: 10792 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcagcgcgtcagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtggtgtccagc

SEQ ID NO: 10793 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttctacgccgggggccaggggtggtacttcgacctgtggggccgcgggaccctcatcgtggtctccagc

SEQ ID NO: 10794 - RNA, 375 nt, synthetic construct
  misc_feature 1..375: note = derived and/or modified sequence opt1 from anti-HIV-1_HeavyChain
  source 1..375: mol_type = other RNA
caggtgcagctggagcagagcggctccggggtcaagaagcccggcgccagcgtgcgcgtgtcctgctggaccagcgaggacatcttcgagaagtccgagctcatccactgggtccggcaggccccggggcagggcctggagtggatcgggtgggtgaagaccgtgacgggcgcggtcaacttcggcagctccgacttccgccagcgggtgagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtctccagc

SEQ ID NO: 10795 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcggggcctggagtggatcgggtgggtcaaggccgtgtccggcgccgtgaactacggcagcctggacttccgccaccgggtctccctcacgcgcgaccgggacctgttcaccgcccacatggacatccgcgggctgacccaggacgacaccgccacgtacttctgcgcgcggcagaagttcgcccgcggcgaccaggggtggttcttcgacctctggggccgggggaccctgatcgtggtgagctcc

SEQ ID NO: 10796 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgagcggaccgagctcatccactgggtgcgccaggcgccgggccaggggctggagtggatcggctgggtgaagacggtcaccggggccgtgaacttcggcagccccaacttccggcaccgcgtgtccctgacccgggaccgcgacctcttcaccgcccacatggacatccggggcctgacgcagggggacaccgccacctacttctgcgcccgccagaagttcgagcggggcgggcagggctggtacttcgacctgtgggggcgcggcaccctcatcgtcgtgagctcc

SEQ ID NO: 10797 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcgcctccggcgtgaagcgccccggggcgagcgtccgggtgtcctgctggaccagcgaggacatcttcgagcgctccgagctcatctactgggtgcggcaggccccgggccaggggctggagtggaccggctgggtcaagacggtgagcggggccgtgaacttcggctccaccgacttccgcgagcgggtcagcctgacccgcgaccgggacctcttcaccgcccacatggacatccgcggcctgacgcagggggacaccgccacctacttctgcgcgcggcagaagttcgcccgcggcgaccaggggtggttcttcgacctgtggggccgggggaccctcatcgtggtgtccagc

SEQ ID NO: 10798 - RNA, 375 nt, synthetic construct
  misc_feature 1..375: note = derived and/or modified sequence opt1 from anti-HIV-1_HeavyChain
  source 1..375: mol_type = other RNA
caggtgcacctggagcagagcggctccggggtcaagaagctcggcgccagcgtgcgcgtgtcctgctggaccagcgaggacatcttcgagcggaccgagctgatccactgggtccgccaggcccccgggcggggcctggagtggatcgggtgggtgaaggcggtgtccggcgccgtcaactacggcagcctcgacttccgccaccgggtgtccctgacgcgcgaccgggacctgttcaccgcccacatggacatccgcgggctcacccaggacgacaccgccacgtacttctgcgcccggcagaagttcgcgcgcggcgaccaggggtggttcttcgacctgtggggccgggggaccctgatcgtggtcagctcc

SEQ ID NO: 10799 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggtccgagctcatccactgggtgcgccaggcgccggggcagggcctggagtggatcgggtgggtcaagaccgtgacgggcgccgtgaacttcggcagccccaacttccggcaccgcgtctccctgacccgggaccgcgacctcttcaccgcccacatggacatccgggggctgacccagggcgacacggccacctacttctgcgcccgccagaagtactacgccgggggccaggggtggtacttcgacctgtggggccggggcaccctcatcgtggtgagctcc

SEQ ID NO: 10800 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttctacgccgggggccaggggtggtacttcgacctgtggggccggggcaccctcatcgtggtgtccagc

SEQ ID NO: 10801 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgggacggccacctacttctgcgcccggcagaagttctacgcgggcgggcagggctggtacttcgacctgtggggccgcgggaccctcatcgtggtgtccagc

SEQ ID NO: 10802 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatctgcgggctgacccagggcgacacggccacctacttctgcgcccggcagaagttcgagcgcgggggccaggggtggtacttcgacctgtggggccggggcaccctcatcgtggtgagctcc

SEQ ID NO: 10803 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgcgcaaggtcggcgccagcgtgcgggtgtcctgctggaccagcgaggacatcttcgagcgcaccgagctcatccactgggtccggcaggcgcccgggcagggcctggagtggatcgggtgggtgaaggccgtgtccggcgccgtcaactacggcagcctggacttccgccaccgggtgtccctcacgcgcgaccgggacctgttcaccgcccacatggacatccgcgggctgacccaggacgacaccgccatctacttctgcgcgcggcagaagttcgcccgcggcgaccaggggtggttcttcgacctctggggccgggggacgctgatcgtggtcagctcc

SEQ ID NO: 10804 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagtactacgccgggggccaggggtggtacttcgacctgtggggccggggcaccctcatcgtggtgtccagc

SEQ ID NO: 10805 - RNA, 375 nt, synthetic construct
  misc_feature 1..375: note = derived and/or modified sequence opt1 from anti-HIV-1_HeavyChain
  source 1..375: mol_type = other RNA
caggtgcagctggtccagagcggcgccgaggtgaagaagcccggggcctccgtgcgcgtcagctgctggacctccgaggacatcttcgagcggaccgagctcatccactgggtgcgccaggcgccgggccaggggctggagtggatcggctgggtgaagacggtcaccggggccgtgaacttcggcagccccaacttccggcaccgcgtgtccctgacccgggaccgcgacctcttcaccgcccacatggacatccggggcctgacgcagggggacaccgccacctacttctgcgcccgccagaagttcgagcggggcgggcagggctggtacttcgacctgtgggggcgcggcaccctcatcgtcgtgagctcc

SEQ ID NO: 10806 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcctgagcgacttccgccagcgggtctccctcacccgcgaccgggggctgttcaccgcccacatggacatccgcggcctgacccagggggacacggccacctacttctgcgcccggcagaagttctacgcgggcgggcagggctggtacttcgacctctggggccgcgggaccctgatcgtggtgagctcc

SEQ ID NO: 10807 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcaccagcgtccgcgtgtcctgctggaccagcgaggacatcttcgagcggacggagctcatccactgggtgcgccaggccccggggcagggcctggagtggatcgggtgggtcaagaccgtgaccggcgcggtgaacttcggctcccccaacttccggcagcgcgtcagcctgacccgggaccgcgacctcttcacggcccacatggacatccgggggctgacccagggcgacaccgccacctacttctgcgcccgccagaagttcgagcgcgggggccaggggtggatcttcgacctgtggggccggggcacgctcatcgccgtgtccagc

SEQ ID NO: 10808 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttcgagcgcggcgggcagggctggtacttcgacctctgggggcggggcaccctgatcgtggtctccagc

SEQ ID NO: 10809 - RNA, 375 nt, synthetic construct
  misc_feature 1..375: note = derived and/or modified sequence opt1 from anti-HIV-1_HeavyChain
  source 1..375: mol_type = other RNA
caggtgcagctggtccagagcggcgccgaggtgaagaagcccggggcctccgtgcgcgtcagctgctggacctccgaggacatcttcgagggcagcgagctcatccactgggtgcggcaggcgccggggcagggcctggagtggatcgggtgggtgaagaccgtcacgggcgccgtgaacttcggctccgcctacttccgccaccgggtgagcctgacccgcgaccgggacctcttcaccgcccacatggacatccgcgggctgacccagggcgacacggccacctacttctgcgcgcggcagaagttctacaagggcgggcaggggtggtacttcgacctgtggggccgcggcaccctcatcgtcgtgtccagc

SEQ ID NO: 10810 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccagcgacttccgcaaccggatctccctgagccgcgaccgggacctctccaccgcccacatggacatccgcggcctgacccaggacgacacggccacctacttctgcgcccggcagaagttcgagcgcggcgggcagggctggatcttcgacctgtgggggcggggcaccctcatcgcggtgagctcc

SEQ ID NO: 10811 - RNA, 375 nt, synthetic construct
  misc_feature 1..375: note = derived and/or modified sequence opt1 from anti-HIV-1_HeavyChain
  source 1..375: mol_type = other RNA
caggtgcagctggtccagagcggcaccgaggtgaagaagcccggggcgtccgtgcgcgtcagctgcaaggcctccggctacaccttcgagaagtccgagctcatccactgggtgcggcaggcgccggggcagggcctggagtggatcgggtgggtgaagacggtcaccggcgccgtgaacttcggcagcagcgacttccgccagcgggtgtccctgacccgcgaccgggacctcttcaccgcccacatggacatccgcgggctgacgcagggcgacaccgccacctacttctgcgcccggcagaagttctacgccgggggccaggggtggtacttcgacctgtggggccgcggcaccctcatcgtcgtgagctcc

SEQ ID NO: 10812 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccagcgacttccgcaaccggatctccctgacccgcgaccgggacctcagcaccgcccacatggacatccgcggcctgacgcaggacgacaccgccacctacttctgcgcccggcagaagttcgagcgcgggggccaggggtggatcttcgacctgtggggccgggggaccctcatcgccgtgtccagc

SEQ ID NO: 10813 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaaggccgtgagcggcgccgtgaactacggctccctggacttccggcaccgcgtcagcctcacccgggaccgcgacctgtccacggcccacatggacatccgggggctgacccaggacgacaccgccacctacttctgcgcgcgccagaagttcgcccggggcgaccaggggtggttcttcgacctctggggccgcgggacgctgatcgtggtgagctcc

SEQ ID NO: 10814 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccaggacgacacggccatctacttctgcgcccggcagaagttcgcgcgcggcgaccaggggtggttcttcgacctgtggggccgggggaccctcatcgtggtgtccagc

SEQ ID NO: 10815 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccctggacttccggcaccgcatcagcctcacccgggaccgcgacctgttcaccgcccacatggacatccgggggctgacgcagggcgacaccgccacctacttctgcgcccgccagaagttctacgccgggggccaggggtggtacttcgacctctggggccggggcaccctgatcgtcgtgtccagc

SEQ ID NO: 10816 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcgtgcactgggtccggcaggcgccggggcagggcctggagtggatcgggtgggtgaagaccgtgacgggcgccgtcaacttcggcagctccgacttccgccagcgggtgagcctgacccgcgaccgggacctcttcaccgcccacatggacatccgcgggctgacccagggcgacacggccacctacttctgcgcccggcagaagttcgagcgcgggggccaggggtggatcttcgacctgtggggccggggcaccctcatcgcggtgtccagc

SEQ ID NO: 10817 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccagggcgacaccgccacgtacttctgcgcgcgccagaagttcgcccgcggggaccagggctggttcttcgacctgtgggggcggggcaccctgatcgtggtgagctcc

SEQ ID NO: 10818 - RNA, 375 nt, synthetic construct
  misc_feature 1..375: note = derived and/or modified sequence opt1 from anti-HIV-1_HeavyChain
  source 1..375: mol_type = other RNA
caggcgcaccgcgagcagagcggctccggggtgaagaagcccggcgccagcgtccgggtgtcctgctggaccagcgaggacatcttcgagcgcaccgagctgatccactgggtgcggcaggcgccggggcagggcctcgagtggatcgggtgggtcaagacggtgaccggcgccgtgaacttcggctccagcgacttccgccagcgggtctccctgacccgcgaccgggacctgttcaccgcccacatggacatccgcgggctcacgcagggcgacaccgccacctacttctgcgcccggcagaagttctacgccgggggccaggggtggtacttcgacctgtggggccgcggcaccctgatcgtggtgagctcc

SEQ ID NO: 10819 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggctccggggtgaagaagcccggcgccagcgtccgcgtgtcctgcctcgcgagcgaggacatcttcaagaccgagctgatccactgggtgcggcaggccccggggcagggcctggagtggatcgggtgggtcaagatcgtgtccggcgccgtgaacttcggcagccccaacttccgccagcgggtctccctcacccgcgaccgggacctgttcacggcccacatggacatccgcgggctgacccagggcgacaccgccacctacttctgcgcgcggcagaagttcgagcgcgggggccaggggtggatcttcgacctctggggccggggcacgctgatcgccgtgagctcc

SEQ ID NO: 10820 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaaggtcggcgccagcgtgcgcgtgtcctgctggaccagcgaggacatcttcgagcggaccgagctcatccactgggtccgccaggcgcccgggcagggcctggagtggatcgggtgggtgaaggccgtgtccggcgccgtcaactacggcagcctggacttccggcaccgcgtgtccctcacgcgggaccgcgacctgttcaccgcccacatggacatccgggggctgacccaggacgacaccgccatctacttctgcgcgcgccagaagttcgagcggggcgggcagggctggatcttcgacctctgggggcgcggcacgctgatcgccgtgagctcc

SEQ ID NO: 10821 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttcgcgcgcggggaccagggctggttcttcgacctgtgggggcggggcaccctcatcgtggtgtccagc

SEQ ID NO: 10822 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcgcctccggcgtgaagcgccccggggcgagcgtccgggtgtcctgctggaccagcgaggacatcttcgagcgctccgagctcatctactgggtgcggcaggccccgggccaggggctggagtggatcggctgggtcaagaccgtgacgggggccgtgaacttcggcagctccgacttccgccagcgggtcagcctgacccgcgaccgggacctcttcaccgcccacatggacatccgcggcctgacccagggggacacggccacctacttctgcgcgcggcagaagttctacgccggcgggcagggctggtacttcgacctgtgggggcgcggcaccctcatcgtggtgtccagc

SEQ ID NO: 10823 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaagacggtgaccggcgccgtgaacttcggctccccgaacttccggcaccgcgtcagcctcacccgggaccgcgacctgttcaccgcccacatggacatccgggggctgacgcagggcgacaccgccacctacttctgcgcccgccagaagtactacgccgggggccaggggtggtacttcgacctctggggccggggcaccctgatcgtggtgtccagc

SEQ ID NO: 10824 - RNA, 375 nt, synthetic construct
  misc_feature 1..375: note = derived and/or modified sequence opt1 from anti-HIV-1_HeavyChain
  source 1..375: mol_type = other RNA
caggtgcagctggtccagagcggctccggggtgaagaagcccggcgccagcgtgcgcgtctcctgctggaccagcgaggacatcttcgagcggaccgagctcatccactgggtgcgccaggccccggggcagggcctggagtggatcgggtgggtgaagatcgtctccggcgcggtgaacttcggcagccccaacttccggcagcgcgtgtccctgacgcgggaccgcgacctcttcaccgcccacatggacatccgggggctgacccagggcgacaccgccacgtacttctgcgcccgccagaagttcgagcgcgggggccaggggtggatcttcgacctgtggggccggggcaccctcatcgccgtcagctcc

SEQ ID NO: 10825 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcagagcggctccggggtgaagaagcccggcgccagcgtccgggtgtcctgctggaccagcgaggacatcttcgagcgcacggagctgatccactgggtgcggcaggccccggggcagggcctcgagtggatcgggtgggtcaagatcgtgtccggcgcggtgaacttcggcagccccaacttccgccagcgggtctccctgacccgcgaccgggacctgttcaccgcccacatggacatccgcgggctcacccagggcgacacggccacctacttctgcgcccggcagaagttcgagcgcgggggccaggggtggatcttcgacctgtggggccggggcaccctgatcgccgtgagctcc

SEQ ID NO: 10826 - RNA, 372 nt, synthetic construct
  misc_feature 1..372: note = derived and/or modified sequence opt1 from anti-HIV-1_HeavyChain
  source 1..372: mol_type = other RNA
cgccacacctgggagcagagcggctccggggtgaagaagcccggcgccagcgtccgggtgtcctgctggaccagcgaggacatcttcgagcgcacggagctgatccactgggtgcggcaggccccggggcagggcctcgagtggatcgggtgggtcaagaccgtgaccggcgcggtgaacctggcccccaacttccgccaccgggtctccctgacccgcgaccgggacctcttcacggcccacatggacatccgcggcctgacccagggggacaccgccacctacttctgcgcccggcagaagttcgagcgcggcgggcagggctggtacttcgacctgtgggggcggggcacgctcatcgtggtgagctcc

SEQ ID NO: 10827 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgaggggtccgagctcatccactgggtgcggcaggcgccgggccaggggctggagtggatcggctgggtcaagaccgtgacgggcgccgtgaacttcgggagctccgacttccgccagcgggtcagcctgacccgcgaccgggacctcttcaccgcccacatggacatccgcggcctgacccagggggacacggccacctacttctgcgcccggcagaagttctacgcgggcgggcagggctggtacttcgacctgtggggccgcgggaccctcatcgtggtgtccagc

SEQ ID NO: 10828 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgcgatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccagcgacttccgcaaccggatctccctgagccgcgaccgggacctctccaccgcccacatggacatccgcggcctgacccagggcgacacggccacctacttctgcgcccggcagaagtactacgccgggggccaggggtggtacttcgacctgtggggccgcgggaccctcatcgtggtcagctcc

SEQ ID NO: 10829 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaagatcgtgtccggcgccgtgaacttcggcagcccgaacttccggcagcgcgtctccctcacgcgggaccgcgacctgttcaccgcccacatggacatccgggggctgacccagggcgacaccgccacgtacttctgcgcccgccagaagttcgagcgcgggggccaggggtggatcttcgacctctggggccggggcaccctgatcgcggtgagctcc

SEQ ID NO: 10830 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccgcgaccgggacctcttcaccgcccacatggacatccgcgggctgacccagggcgacacggccacctacttctgcgcccggcagaagttctacaagggcgggcaggggtggtacttcgacctgtggggccgcggcaccctcatcgtggtgtccagc

SEQ ID NO: 10831 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacaccgccacctacttctgcgcccgccagaagttcgcgcgcggggaccagggctggttcttcgacctgtgggggcggggcaccctcatcgtggtgtccagc

SEQ ID NO: 10832 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcggggcctggagtggatcgggtgggtcaaggccgtgtccggcgccgtgaactacggcagcctcgacttccgccaccgggtctccctgacgcgcgaccgggacctgttcaccgcccacatggacatccgcgggctcacccagggcgacaccgccacgtacttctgcgcgcggcagaagttcgagcgcgggggccaggggtggtacttcgacctgtggggccggggcaccctgatcgtggtgagctcc

SEQ ID NO: 10833 - RNA, 375 nt, synthetic construct
  misc_feature 1..375: note = derived and/or modified sequence opt1 from anti-HIV-1_HeavyChain
  source 1..375: mol_type = other RNA
caggcccgccccggcaccagcgggtccggcgtgaagaagccgggggccagcgtccgggtgtcctgctggagctccgaggacatcttcgagcgcaccgagctgatccactgggtgcggcaggcgcccggccaggggctcgagtggatcggctgggtcaagacggtgaccggcgccgtgaacttcgggagcctggacttccgccagcgggtctccctgacccgcgaccgggacctcttcaccgcccacatggacatccgcggcctgacgcagggggacaccgccacctacttctgcgcccggcagaagttcgagcgcggcgggcagggctggatcttcgacctgtggggccgggggaccctcatcgcggtgagctcc

SEQ ID NO: 10834 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacggagggcgacaccgccacctacttctgcgcccgccagaagttcgagcgcgggggccaggggtggatcttcgacctgtggggccggggcaccctcatcgcggtgtccagc

SEQ ID NO: 10835 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaaggccatctccggcgccgtgaactacggcagcctggacttccggcaccgcgtgtccctcacgcgggaccgcgacctgttcaccgcccacatggacatccgggggctgacccaggacgacaccgccacgtacttctgcgcgcgccagaagttcgcccggggcgaccaggggtggttcttcgacctctggggccgcgggaccctgatcgtcgtgagctcc

SEQ ID NO: 10836 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacagcggctcccccaacttccgccaccgggtcagcctgacccgcgaccgggacctcttcaccgcccacatggacatccgcgggctgacccagggcgacacggccacctacttctgcgcccggcagaagttcgagcgcgggggccaggggtggtacttcgacctgtggggccggggcaccctcatcgtggtgtccagc

SEQ ID NO: 10837 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcgggcggagctcatccactgggtgcgccaggccccggggcagggcctggagtggatcgggtgggtcaagaccgtgtccggcgccgtgaacttcggcagcctgaacttccggcaccgcgtctccctcacgcgggaccgcgacctgttcaccgcccacatggacatccgggggctgacccagggcgacaccgccacgtacttctgcgcgcgccagaagttcgcccgcggggaccagggctggttcttcgacctctgggggcggggcaccctgatcgtggtgagctcc

SEQ ID NO: 10838 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgcccggggcgaccaggggtggttcttcgacctgtggggccgcgggaccctggtgaccgtgtccagc

SEQ ID NO: 10839 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctccctgaacttccggcaccgcgtcagcctcacccgggaccgcgacctgttcaccgcccacatggacatccgggggctgacgcagggcgacaccgccacctacttctgcgcccgccagaagttcgagcgcgggggccaggggtggtacttcgacctctggggccggggcaccctgatcgtggtgtccagc

SEQ ID NO: 10840 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctctccaccgcccacatggacatccgggggctgacgcaggacgacaccgccacctacttctgcgcccgccagaagttcgcgcggggcgaccaggggtggttcttcgacctgtggggccgcgggaccctcatcgtggtgagctcc

SEQ ID NO: 10841 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagaccgtcaccggggccgtgaacttcggcagccccaacttccgccaccgggtgtccctgacccgcgaccgggacctcttcacggcccacatggacatccgcggcctgacccagggggacaccgccacctacttctgcgcccggcagaagtactacgcgggcgggcagggctggtacttcgacctgtgggggcgcggcacgctcatcgtcgtgagctcc

SEQ ID NO: 10842 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggcctccggcgccgtgaacttcggcagccccaacttccggcaccgcgtgtccctgacccgggaccgcgacctcttcaccgcccacatggacatccgggggctgacccagggcgacacggccacctacttctgcgcgcgccagaagttcgagcgcgggggccaggggtggtacttcgacctgtggggccggggcaccctcatcgtcgtgagctcc

SEQ ID NO: 10843 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggctcacccaggacgacaccgccacgtacttctgcgcgcgccagaagttcgagcggggcgggcagggctggtacttcgacctgtgggggcgcggcaccctgatcgtggtgagctcc

SEQ ID NO: 10844 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcgcctccggcgtgaagcgccccggggcgagcgtccgggtgtcctgctggaccagcgaggacatcttcgagcgctccgagctcatctactgggtgcggcaggccccgggccaggggctggagtggatcggctgggtcaagaccgtgagcggggccgtgaacttcggctccacggacttccgcgagcgggtcagcctgacccgcgaccgggacctcttcaccgcccacatggacatccgcggcctgacccagggggacacggccacctacttctgcgcgcggcagaagttcgagcgcggcgggcagggctggtacttcgacctgtgggggcggggcaccctcatcgtggtgtccagc

SEQ ID NO: 10845 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgtggtcaactacggcagcctcgacttccggcaccgcgtgtccctgacgcgggaccgcgacctgagcaccgcccacatggacatccgggggctcacccaggacgacaccgccacgtacttctgcgcccgccagaagttcgcgcggggcgaccaggggtggttcttcgacctgtggggccgcgggaccctgatcgtggtctccagc

SEQ ID NO: 10846 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaaggtcggcgccagcgtgcgcgtgtcctgctggaccagcgaggacatcttcgagcggaccgagctcatccactgggtccgccaggcgcccgggcagggcctggagtggatcgggtgggtgaagacggtgtccggcgccgtcaacttcggcagcccgaacttccggcaccgcgtgtccctgacccgggaccgcgacctcttcaccgcccacatggacatccgggggctgacccagggcgacacggccacctacttctgcgcccgccagaagttcgagcgcgggggccaggggtggtacttcgacctgtggggccggggcaccctcatcgtggtcagctcc

SEQ ID NO: 10847 - RNA, 375 nt, synthetic construct
  misc_feature 1..375: note = derived and/or modified sequence opt1 from anti-HIV-1_HeavyChain
  source 1..375: mol_type = other RNA
caggcctacctggagcagagcggctccatcatgaagaagcccggggccagcgtgcgcgtctcctgctggaccagcgaggacatcttcgaccggaccgagctcatccactgggtgcgccaggcgccgggccaggggctggagtggatcggctgggtgaagacggtcaccggggccgtgaacttcggctccagcgacttccggcagcgcgtgtccctgacccgggaccgcgacctcttcaccgcccacatggacatccggggcctgacgcagggggacaccgccacctacttctgcgcccgccagaagttctacgcgggcgggcagggctggtacttcgacctgtgggggcggggcaccctcatcgtcgtgagctcc

SEQ ID NO: 10848 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagaagtccgagctcatccactgggtgcggctggcgccggggcagggcctggagtggatcgggtgggtcaagaccgtgacgggcgccgtgaacttcggcagctccgacttccgccagcgggtcagcctcacccgcgaccgggacctgttcaccgcccacatggacatccgcgggctgacccagggcgacacggccacctacttctgcgcccggcagaagttctacgccgggggccaggggtggtacttcgacctctggggccgcggcaccctgatcgtggtgtccagc

SEQ ID NO: 10849 - RNA, 375 nt, synthetic construct
  misc_feature 1..375: note = derived and/or modified sequence opt1 from anti-HIV-1_HeavyChain
  source 1..375: mol_type = other RNA
gaggcccacctggagcagagcggctccggggtgaagaagcccggcgccagcgtccgcgtgtcctgctggaccagcgaggacatcttcgagcggaccgagctcacgcactgggtgcgccaggcgccggggcagggcctggagtggatcgggtgggtcaagaccgtgaccggcgccgtgaacttcggctcccccaacttccggcagcgcgtcagcctgacccgggaccgcgacctcttcacggcccacatggacatccgggggctgacccagggcgacaccgccacctacttctgcgcccgccagaagttcgagcgcgggggccaggggtggatcttcgacctgtggggccggggcacgctcatcgcggtgtccagc

SEQ ID NO: 10850 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatctacgagcggaccgagctcatccactgggtgcgccaggcgccggggcagggcctggagtggatcgggtgggtcaaggccgtgtccggcgccgtgaactacggcagcctggacttccggcaccgcgtctccctcacgcgggaccgcgacctgttcaccgcccacatggacatccgggggctgacccaggacgacaccgccatctacttctgcgcgcgccagaagttcgcccggggcgaccaggggtggttcttcgacctctggggccgcgggacgctgatcgtggtgagctcc

SEQ ID NO: 10851 - RNA, 375 nt, synthetic construct
  misc_feature 1..375: note = derived and/or modified sequence opt1 from anti-HIV-1_HeavyChain
  source 1..375: mol_type = other RNA
caggtgcacctggagcagagcggctccggggtcaagaagcccggcgccagcgtgcgcgtgtcctgctggaccagcgaggacatcttcgagcggaccgagctcatccactgggtccgccaggccccggggcagggcctggagtggatcgggtgggtgaagacggtgaccggcgcggtcaacttcggctcccccaacttccggcaccgcgtgagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtggtctccagc

SEQ ID NO: 10852 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaaggtcggcgccagcgtgcgcgtgtcctgctggaccagcgaggacatcttcgagcggaccgagctcatccactgggtccgccaggcgcccgggcagggcctggagtggatcgggtgggtgaaggccgtgtccggcgccgtcaactacggcagcctggacttccggcaccgcgtgtccctcacgcgggaccgcgacctgagcaccgcccacatggacatccgggggctgacccaggacgacaccgccacgtacttctgcgcgcgccagaagttcgcccggggcgaccaggggtggttcttcgacctctggggccgcgggaccctgatcgtggtctccagc

SEQ ID NO: 10853 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgcccgggcagggcctggagtggatcgggtgggtcaagacggtgtccggcgccgtgaacttcggcccgcccaacttccggcaccgcgtcagcctgacccgggaccgcgacctcttcaccgcccacatggacatccgggggctgacccagggcgacacggccacctacttctgcgcccgccagaagttcgagcgcgggggccaggggtggtacttcgacctgtggggccggggcaccctcatcgtggtgtccagc

SEQ ID NO: 10854 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccacgtacttctgcgcgcgccagaagttcgagcggggcgggcagggctggatcttcgacctgtgggggcgcggcaccctgatcgccgtgtccagc

SEQ ID NO: 10855 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgcgcaagcccggcgccagcgtccgggtgtcctgctggaccagcgaggacatcttcgagcgcaccgagctcatccactgggtgcggcaggcgccggggcagggcctggagtggatcgggtgggtcaagacggtgaccggcgccgtgaacttcggctccagcgacttccgccagcgggtctccctgacccgcgaccgggacctcttcaccgcccacatggacatccgcgggctgacgcagggcgacaccgccacctacttctgcgcccggcagaagttctacgccgggggccaggggtggtacttcgacctgtggggccgcggcaccctcatcgtggtgagctcc

SEQ ID NO: 10856 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcggggcctggagtggatcgggtgggtcaaggccgtgtccggcgccgtgaactacggcagcccgaacttccgccaccgggtctccctcacgcgcgaccgggacctgttcaccgcccacatggacatccgcgggctgacccagggcgacaccgccacgtacttctgcgcgcggcagaagttcgagcgcgggggccaggggtggtacttcgacctctggggccggggcaccctgatcgtggtgagctcc

SEQ ID NO: 10857 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgagcgcgggggccaggggtggtacttcgacctgtggggccggggcgcgctcatcgtggtgagctcc

SEQ ID NO: 10858 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagcgcctacttccgccaccgggtctccctgacccgcgaccgggacctcttcaccgcccacatggacatccgcgggctgacccagggcgacacggccacctacttctgcgcgcggcagaagttctacaagggcgggcaggggtggtacttcgacctgtggggccgcggcaccctcatcgtggtgagctcc

SEQ ID NO: 10859 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcgggaccgtgaacttcggctccctggacttccgccaccgggtgagcctcacccgcgaccgggacctgtccaccgcccacatggacatccgcggcctgacgcaggacgacaccgccacctacttctgcgcccggcagaagttcgcccgcggggaccagggctggttcttcgacctctgggggcggggcaccctgatcgtcgtgagctcc

SEQ ID NO: 10860 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccagcgacttccgcaaccggatctccctgagccgcgaccgggacctctccaccgcccacatggacatccgcggcctgacccaggacgacacggccacctacttctgcgcccggcagaagttctacgcgggcgggcagggctggtacttcgacctgtgggggcgcggcaccctcatcgtggtcagctcc

SEQ ID NO: 10861 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgacgggcgccgtgaacttcggctccagcgacttccggcagcgcgtctccctcacccgggaccgcgacctgttcaccgcccacatggacatccgggggctgacccagggcgacacggccacctacttctgcgcgcgccagaagttctacgccgggggccaggggtggtacttcgacctctggggccggggcaccctgatcgtggtgagctcc

SEQ ID NO: 10862 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgagcggaccgagctcatctactgggtgcgccaggcgccgggccgggggctggagtggatcggctgggtgaagacggtcagcggggccgtgaacttcggctccagcgacttccgccagcgggtgtccctgacccgcgaccgggacctcttcaccgcccacatggacatccgcggcctgacccagggggacacggccacctacttctgcgcccggcagaagttctacgcgggcgggcagggctggtacttcgacctgtgggggcgcggcaccctcatcgtcgtgagctcc

SEQ ID NO: 10863 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctgacgcagggcgacgccgccacctacttctgcgcgcgccagaagttcgagcgcgggggccaggggtggtacttcgacctgtggggccggggcaccctcatcgtggtgtccagc

SEQ ID NO: 10864 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcggggcctggagtggatcgggtgggtcaaggccgtgtccggcgccgtgaactacggcagcctcgacttccgccaccgggtctccctgacgcgcgaccgggacctgttcaccgcccacatggacatccgcgggctcacccaggacgacaccgccacgtacttctgcgcgcggcagaagttctacgccggcgggcagggctggtacttcgacctgtgggggcgcggcaccctgatcgtggtgagctcc

SEQ ID NO: 10865 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcagcgcgtctccctgacgcgggaccgcgacctcttcgccgcccacatggacatccgggggctgacccagggcgacaccgccacctacttctgcgcgcgccagaagttcgagcgcgggggccaggggtggatcttcgacctgtggggccggggcacgctcatcgccgtgagctcc

SEQ ID NO: 10866 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgacctcttcaccgcccacatggacatccgggggctggcccagggcgacacggccacctacttctgcgcgcgccagaagttcgagcgcgggggccaggggtggtacttcgacctgtggggccggggcaccctcatcgtggtgtccagc

SEQ ID NO: 10867 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccagcgacttccgcaaccggatctccctgagccgcgaccgggacctctccaccgcccacatggacatccgcggcctgacccaggacgacacggccacctacttctgcgcccggcagaagttcgagcgcggcgggcagggctggtacttcgacctgtgggggcggggcaccctcatcgtggtcagctcc

SEQ ID NO: 10868 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgcgatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccgggtgagcctcacccgcgaccgggacctgttcaccgcccacatggacatccgcggcctgacgcagggcgacaccgccacctacttctgcgcccggcagaagttctacgccgggggccaggggtggtacttcgacctctggggccgcgggaccctgatcgtcgtgtccagc

SEQ ID NO: 10869 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagatcgtgtccggcgccgtgaacttcggcagccccaacttccggcaccgcgtctccctgacgcgggaccgcgacctcttcaccgcccacatggacatccgggggctgacccagggcgacaccgccacgtacttctgcgcccgccagaagttcgagcgcgggggccaggggtggtacttcgacctgtggggccggggcaccctcatcgtggtgagctcc

SEQ ID NO: 10870 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagaagtccgagctcatccactgggtgcggcgcgcgccggggcagggcctggagtggatcgggtgggtcaagaccgtgacgggcgccgtgaacttcggcagctccgacttccggcagcgcgtcagcctgacccgggaccgcgacctcttcaccgcccacatggacatccgggggctgacccagggcgacacggccacctacttctgcgcccgccagaagttctacgccgggggccaggggtggtacttcgacctgtggggccggggcaccctcatcgtggtgtccagc

SEQ ID NO: 10871 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcagcgcgtctccctgacgcgggaccgcgacctgttcaccgcccacatggacatccgggggctcacccagggcgacaccgccacgtacttctgcgcgcgccagaagttcgagcgcgggggccaggggtggatcttcgacctgtggggccggggcaccctgatcgccgtgagctcc

SEQ ID NO: 10872 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagcctggacttccggcaccgcatctccctcacccgggaccgcgacctgttcaccgcccacatggacatccgggggctgacccagggcgacacggccacctacttctgcgcccgccagaagttctacaagggcgggcaggggtggtacttcgacctctggggccggggcaccctgatcgtcgtgagctcc

SEQ ID NO: 10873 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcaccagcgtccgcgtgtcctgctggaccagcgaggacatcttcgagaagtccgagctcatccactgggtgcggcaggccccggggcagggcctggagtggatcgggtgggtcaagacggtgaccggcgcggtgaacttcggcagctccgacttccgccagcgggtcagcctgacccgcgaccgggacctcttcaccgcccacatggacatccgcgggctgacgcagggcgacaccgccacctacttctgcgcccggcagaagttctacgccgggggccaggggtggtacttcgacctgtggggccgcggcaccctcatcgtggtgtccagc

SEQ ID NO: 10874 - RNA, 375 nt, synthetic construct
  misc_feature 1..375: note = derived and/or modified sequence opt1 from anti-HIV-1_HeavyChain
  source 1..375: mol_type = other RNA
cagagccacctggagcagtccggcagcgccatgaagaagcccggggcctccgtgcgcgtcagctgctggacctccgaggacatcttcgacaccacggagctcatctactgggtgcggcaggcgccgggccaggggctggagtggatcggctgggtgaagatcgtcagcgggaccgtgaacttcgcctccctggacttccgcaaccggatcagcctctcccgcgaccgggacctgagcaccgcccacatggacatccgcggcctgacccaggacgacacggccacctacttctgcgcccggcagaagttctacgcgggcgggcagggctggtacttcgacctctgggggcgcggcaccctgatcgtggtctccagc

SEQ ID NO: 10875 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgggctgatccactgggtgcgccaggcgcccggccaggggctggagtggatcggctgggtcaaggccgtgtccggcgccgtgaactacgggagcctcgacttccggcaccgcgtctccctgacgcgggaccgcgacctgttcaccgcccacatggacatccggggcctcacccaggacgacaccgccacgtacttctgcgcgcgccagaagttcgcccgcggggaccagggctggttcttcgacctgtgggggcggggcaccctgatcgtggtgagctcc

SEQ ID NO: 10876 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcaccagcgtccgcgtgtcctgctggaccagcgaggacgtgttcgagcggacggagctcatccactgggtccgccaggccccggggcagggcctggagtggatcgggtgggtgaagaccgtgatcggcgcggtcaacttcggctcccccaacttccggcaccgcgtgagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtggtctccagc

SEQ ID NO: 10877 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggcgccggggtgaagaagcccggcgcgtccgtccgcgtgagctgctggacctccgaggacatcttcaagaccgagctcatccactgggtgcggcaggccccggggcagggcctggagtggatcgggtgggtcaagatcgtgagcggcgccgtgaacttcggctcccccaacttccgccagcgggtcagcctgacgcgcgaccgggacctcttcaccgcccacatggacatccgcgggctgacccagggcgacaccgccacgtacttctgcgcgcggcagaagttcgagcgcgggggccaggggtggatcttcgacctgtggggccggggcaccctcatcgccgtgtccagc

SEQ ID NO: 10878 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgtccggcgccgtgaacttcggcagccccgacttccggcaccgcgtctccctgacccgggaccgcgacctcttcaccgcccacatggacatccgggggctgacccagggcgacacggccacctacttctgcgcccgccagaagttcgcgcgcggggaccagggctggttcttcgacctgtgggggcggggcaccctcatcgtggtgagctcc

SEQ ID NO: 10879 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagcgccccggcgccagcgtccgggtgtcctgctggaccagcgaggacatcttcgagaccacggagctcatccactgggtgcgccaggcgccggggcagggcctggagtggatcgggtgggtcaagaccgtgtccggcgccgtgaacttcggcagcctgaacttccggcaccgcatctccctcacccgggaccgcgacctgttcaccgcccacatggacatccgggggctgacgcagggcgacaccgccacctacttctgcgcccgccagaagttcgcgcgcggggaccagggctggttcttcgacctctgggggcggggcaccctgatcgtcgtgagctcc

SEQ ID NO: 10880 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccaggacgacaccgccatctacttctgcgcgcgccagaagttcgcccggggcgaccaggggtggttcttcgacctgtggggccgcgggacgctgatcgtggtgtccagc

SEQ ID NO: 10881 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggacggggtgggtcaaggccgtgtccggcgccgtgaactacggcagcctcgacttccggcaccgcgtctccctgacccgggaccgcgacctgagcaccgcccacatggacatccgggggctcacccaggacgacacggccacctacttctgcgcgcgccagaagttcgcccggggcgaccaggggtggttcttcgacctgtggggccgcgggaccctgatcgtggtgtccagc

SEQ ID NO: 10882 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgttcaccgcccacatggacatccgggggccgacccaggacgacaccgccacgtacttctgcgcgcgccagaagttcgcccggggcgaccaggggtggttcttcgacctctggggccgcgggaccctgatcgtggtgagctcc

SEQ ID NO: 10883 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccgggggctcacccagggcgacaccgccacgtacttctgcgcgcgccagaagttcgagcgcgggggccaggggtggtacttcgacctgtggggccggggcaccctgatcgtggtgtccagc

SEQ ID NO: 10884 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggagctccgaggacatcttcgagcggaccgagctcatccactgggtgcgccaggcgccggggcagggcctggagtggatcgggtgggtcaagaccgtgacgggcgccgtgaacttcggcagccccaacttccggcaccgcgtctccctgacccgggaccgcgacctcttcaccgcccacatggacatccgggggctgacccagggcgacacggccacctacttctgcgcccgccagaagttcgagcgcgggggccaggggtggtacttcgacctgtggggccggggcaccctcatcgtggtgagctcc

SEQ ID NO: 10885 - RNA, 375 nt, synthetic construct
  misc_feature 1..375: note = derived and/or modified sequence opt1 from anti-HIV-1_HeavyChain
  source 1..375: mol_type = other RNA
cgccacacctggaacgagagcggctccggggtgaagaagcccggcgccagcgtccgggtgtcctgctggaccagcgaggacatcttcgagcgcacggagctgatccactgggtgcggcaggccccggggcagggcctcgagtggatcgggtgggtcaagaccgtgaccggcaccgtgaacttcggctccctgaacttccgccagcgggtcagcctgacgcgcgaccgggacctcttcaccgcgcacatggacatccgcgggctgacccagggcgacaccgccacgtacttctgcgcccggcagaagttctacgccgggggccaggggtggtacttcgacctgtggggccgcggcaccctcatcgtggtgtccagc

SEQ ID NO: 10886 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggcgccggggtgaagcgccccggcgcgtccgtccgggtgagctgctggacctccgaggacatcttcgagaccacggagctcatccactgggtgcgccaggccccggggcagggcctggagtggatcgggtgggtcaagaccgtgagcggcgccgtgaacttcggctcccccaacttccggcaccgcgtcagcctgacccgggaccgcgacctcttcaccgcccacatggacatccgggggctgacgcagggcgacaccgccacctacttctgcgcgcgccagaagttcgagcgcgggggccaggggtggtacttcgacctgtggggccggggcaccctcatcgtggtgtccagc

SEQ ID NO: 10887 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaaggccgtgtccggcgccgtgaacttcggcagccccaacttccggcaccgcgtctccctgacgcgggaccgcgacctcttcaccgcccacatggacatccgggggctgacccagggcgacaccgccacgtacttctgcgcgcgccagaagttcgagcgcgggggccaggggtggtacttcgacctgtggggccggggcaccctcatcgtggtgagctcc

SEQ ID NO: 10888 - RNA, 375 nt, synthetic construct
  misc_feature 1..375: note = derived and/or modified sequence opt1 from anti-HIV-1_HeavyChain
  source 1..375: mol_type = other RNA
caggcccacctgggcaccatcctcgggctggagagcaagaagcccggcgcctccgtgcgcgtcagctgctggacctccgaggacatcttcgagcggacggagctgatccactgggtgcgccaggcgccggggcagggcctcgagtggatcgggtgggtgaagaccgtcaccggcgccagcatcctggcccccaacttccggcaccgcgtgtccctgacccgggaccgcgacctcttcacggcccacatggacatccggggcctgacccagggggacaccgccacctacttctgcgcgcgccagaagttcgagcggggcgggcagggctggtacttcgacctgtgggggcgcggcacgctcatcgtggtcagctcc

SEQ ID NO: 10889 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcgccgtgaacttcggctcccccaacttccggcaccgcgtcagcctgacccgggaccgcgccctcttcaccgcccacatggacatccgggggctgacgcagggcgacaccgccacctacttctgcgcgcgccagaagttcgcccgcggggaccagggctggttcttcgacctgtgggggcggggcaccctcatcgtggtgtccagc

SEQ ID NO: 10890 - RNA, 375 nt, synthetic construct
  misc_feature 1..375: note = derived and/or modified sequence opt1 from anti-HIV-1_HeavyChain
  source 1..375: mol_type = other RNA
cgcgtgcacctggagcagagcggctccggggtcaagaagcccggcgccagcgtgcgggtgtcctgctggaccagcgaggacatcttcgagcgcaccgagctcatccactgggtccggcaggccccggggcagggcctggagtggatcgggtgggtgaagacggtgaccggcgcggtcaacttcggctcccccaacttccgccaccgggtgagcctgacccgcgaccgggacctcttcaccgcccacatggacatccgcgggctgacgcagggcgacaccgccacctacttctgcgcccggcagaagttcgagcgcgggggccaggggtggtacttcgacctgtggggccggggcaccctcatcgtggtctccagc

SEQ ID NO: 10891 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggcgccggggtgaagaagcccggcgcgtccgtccgcgtgagctgctggacctccgaggacatcttcgagcggaccgagctcatccactgggtgcgccaggccccggggcagggcctggagtggatcgggtgggtcaagacggtgaccggcgccgtgaacttcggcagccccaacttccggcagcgcgtctccctgacccgggaccgcgacctcagcaccgcccacatggacatccgggggctgacgcaggacgacaccgccacctacttctgcgcgcgccagaagttcgcccggggcgaccaggggtggttcttcgacctgtggggccgcgggaccctcatcgtggtgtccagc

SEQ ID NO: 10892 - RNA, 375 nt, synthetic construct
  misc_feature 1..375: note = derived and/or modified sequence opt1 from anti-HIV-1_HeavyChain
  source 1..375: mol_type = other RNA
caggtgcagctggtccagagcggcgccgaggtgaagcgccccggggcctccgtgaaggtcagctgctggacctccgaggacatcttcgagcggaccgagctcatccactgggtgcgccaggcgccgggccaggggctggagtggatcggctgggtgaagacggtcagcggggccgtgaacttcggctcccccaacttccggcaccgcgtgagcctgacccgggaccgcgacctcttcaccgcccacatggacatccggggcctgacccagggggacacggccacctacttctgcgcccgccagaagttcgagcggggcgggcagggctggtacttcgacctgtgggggcgcggcaccctcatcgtcgtgtccagc

SEQ ID NO: 10893 - RNA, 375 nt, synthetic construct
  misc_feature 1..375: note = derived and/or modified sequence opt1 from anti-HIV-1_HeavyChain
  source 1..375: mol_type = other RNA
cgccacgacctggagcagagcggctccggggtgaagaagcccggcgccagcgtccgggtgtcctgctggaccagcgaggacatcttcgagcgcaccgagctcatccactgggtgcggcaggccccggggcagggcctggagtggatcgggtgggtcaagatcgtgtccggcgcggtgaacttcggcagccccaacttccgccagcgggtctccctgacgcgcgaccgggacctcttcaccgcccacatggacatccgcgggctgacccagggcgacaccgccacgtacttctgcgcccggcagaagttcgagcgcgggggccaggggtggatcttcgacctgtggggccggggcaccctcatcgccgtgagctcc

SEQ ID NO: 10894 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcaggtctggagcggcgtgaagaagcccggggcctccgtgcgggtgagctgctggacctccgaggacatcttcgagaagtccgagctgatccactgggtccgccaggccccgggccaggggctcgagtggatcggctgggtgaagacggtgaccggggcggtcaacttcggcagcagcgacttccggcagcgcgtgtccctgacccgggaccgcgacctgttcaccgcccacatggacatccggggcctcacgcagggggacaccgccacctacttctgcgcccgccagaagttctacgccggcgggcagggctggtacttcgacctgtgggggcggggcaccctgatcgtggtcagctcc

SEQ ID NO: 10895 - RNA, 375 nt, synthetic construct
  misc_feature 1..375: note = derived and/or modified sequence opt1 from anti-HIV-1_HeavyChain
  source 1..375: mol_type = other RNA
cgccacacctggaacaagagcggctccggggtgaagaagcccggcgccagcgtccgggtgtcctgctggaccagcgaggacatcttcgagcgcacggagctgatccactgggtgcggcaggccccggggcagggcctcgagtggatcgggtgggtcaaggcggtgtccggcgccgtgaactacggcagcctggacttccgccaccgggtctccctgacccgcgaccgggacctcagcaccgcccacatggacatccgcgggctgacccaggacgacacggccacctacttctgcgcccggcagaagttcgcgcgcggcgaccaggggtggttcttcgacctgtggggccgggggaccctcatcgtggtgtccagc

SEQ ID NO: 10896 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcagagcggctccggggtgaagaagcccggcgccagcgtccgggtgtcctgctggaccagcgaggacatcttcgagaagtccgagctgatccactgggtgcgccaggccccggggcagggcctcgagtggatcgggtgggtcaagacggtgaccggcgcggtgaacttcggcagctccgacttccggcagcgcgtcagcctgacccgggaccgcgacctgttcaccgcccacatggacatccgggggctcacgcagggcgacaccgccacctacttctgcgcccgccagaagttcgagcgcgggggccaggggtggatcttcgacctgtggggccggggcaccctgatcgccgtgtccagc

SEQ ID NO: 10897 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagcgccccggcgccagcgtccgggtgtcctgctggaccagcgaggacatcttcgagaccacggagctcatccactgggtgcgccaggcgccggggcagggcctggagtggatcgggtgggtcaaggccgtgtccggcgccgtgaactacggcagcctggacttccggcaccgcgtctccctcacccgggaccgcgacctgagcaccgcccacatggacatccgggggctgacccaggacgacacggccacctacttctgcgcgcgccagaagttcgcccggggcgaccaggggtggttcttcgacctctggggccgcgggaccctgatcgtggtgtccagc

SEQ ID NO: 10898 - RNA, 375 nt, synthetic construct
  misc_feature 1..375: note = derived and/or modified sequence opt1 from anti-HIV-1_HeavyChain
  source 1..375: mol_type = other RNA
cgccacgacctggagcagagcggctccggggtgaagaagcccggcgccagcgtccgggtgtcctgctggaccagcgaggacatcttcgagcgcaccgagctcatccactgggtgcggcaggccccggggcagggcctggagtggatcgggtgggtcaagacggtgaccggcgcggtgaacttcggctcccccaacttccgccaccgggtcagcctgacccgcgaccgggacctcttcaccgcccacatggacatccgcgggctgacgcagggcgacaccgccacctacttctgcgcccggcagaagttcgagcgcgggggccaggggtggtacttcgacctgtggggccggggcaccctcatcgtggtgtccagc

SEQ ID NO: 10899 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcagagcggctccggggtgaagaagctgggcgccagcgtccgggtgtcctgctggaccagcgaggacatcttcgagcgcacggagctcatccactgggtgcggcaggcccccgggcagggcctggagtggatcgggtgggtcaaggcggtgtccggcgccgtgaactacggcagcctggacttccgccaccgggtctccctcacccgcgaccgggacctgagcaccgcccacatggacatccgcgggctgacccaggacgacacggccacctacttctgcgcccggcagaagttcgcgcgcggcgaccaggggtggttcttcgacctctggggccgggggaccctgatcgtggtgtccagc

SEQ ID NO: 10900 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgcctcgcgagcgaggacatcttcgagaagtccgagctgatccactgggtgcggcaggccccggggcagggcctggagtggatcgggtgggtcaagaccgtgaccggcgccgtgaacttcggcagctccgacttccgccagcgggtcagcctcacgcgcgaccgggacctgttcaccgcccacatggacatccgcgggctgacccagggcgacaccgccacgtacttctgcgcgcggcagaagttctacgccgggggccaggggtggtacttcgacctctggggccgcggcaccctgatcgtggtgtccagc

SEQ ID NO: 10901 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggcgccggggtgaagaagcccggcgcgtccgtccgcgtgagctgctggacctccgaggacatcttcgagaagtccgagctcatccactgggtgcggcaggccccggggcagggcctggagtggatcgggtgggtcaagaccgtgacgggcgccgtgaacttcggcagcagcgacttccgccagcgggtctccctgacccgcgaccgggacctcttcaccgcccacatggacatccgcgggctgacccagggcgacacggccacctacttctgcgcgcggcagaagttctacgccgggggccaggggtggtacttcgacctgtggggccgcggcaccctcatcgtggtgagctcc

SEQ ID NO: 10902 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcagagcggctccggggtgaagaagcccggcgccagcgtccgggtgtcctgctggaccagcgaggacatcttcgagaagtccgagctgatccactgggtgcgccaggccccggggcagggcctcgagtggatcgggtgggtcaagacggtgaccggcgcggtgaacttcggcagctccgacttccggcagcgcgtcagcctgacccgggaccgcgacctgttcaccgcccacatggacatccgggggctcacgcagggcgacaccgccacctacttctgcgcccgccagaagttctacgccgggggccaggggtggtacttcgacctgtggggccggggcaccctgatcgtggtgtccagc

SEQ ID NO: 10903 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcagagcggctccggggtgaagaagcccggcgccagcgtccgggtgtcctgctggaccagcgaggacatcttcgagcgcacggagctgatccactgggtgcggcaggccccggggcagggcctcgagtggatcgggtgggtcaagaccgtgaccggcgcggtgaacttcggctcccccaacttccgccaccgggtcagcctgacccgcgaccgggacctgttcacggcccacatggacatccgcgggctcacccacggcgacaccgccacctacttctgcgcccggcagaagttcgagcgcgggggccaggggtggtacttcgacctgtggggccggggcacgctgatcgtggtgtccagc

SEQ ID NO: 10904 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcagagcggctccggggtgaagaagctgggcgcgagcgtccgggtgtcctgctggaccagcgaggacatcttcgagcgcacggagctcatccactgggtgcggcaggcccccgggcagggcctggagtggatcgggtgggtcaaggcggtgtccggcgccgtgaactacggcagcctggacttccgccaccgggtctccctcacccgcgaccgggacctgttcaccgcccacatggacatccgcgggctgacccagggcgacacggccacctacttctgcgcccggcagaagttctacgccgggggccaggggtggtacttcgacctctggggccgcggcaccctgatcgtggtgagctcc

SEQ ID NO: 10905 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggcgccggggtgaagaagctcggcgcgtccgtccgcgtgagctgctggacctccgaggacatcttcgagcggaccgagctgatccactgggtgcgccaggcccccgggcagggcctggagtggatcgggtgggtcaaggccgtgagcggcgccgtgaactacggctccctcgacttccggcaccgcgtcagcctgacgcgggaccgcgacctgttcaccgcccacatggacatccgggggctcacccaggacgacaccgcgacgtacttctgcgcccgccagaagttcgcccggggcgaccaggggtggttcttcgacctgtggggccgcgggaccctgatcgtggtgtccagc

SEQ ID NO: 10906 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtcgaggtgtcctgctggaccagcgaggacatcttcgagcgcaccgagctcatccactgggtgcggcaggcgccggggcagggcctggagtggatcgggtgggtcaagacggtgtccggcgccgtgaacttcggcagccccaacttccgccaccgggtctccctgacccgcgaccgggacctcttcaccgcccacatggacatccgcgggctgacccagggcgacacggccacctacttctgcgcccggcagaagttcgcgcgcggggaccagggctggttcttcgacctgtgggggcggggcaccctcatcgtggtgagctcc

SEQ ID NO: 10907 - RNA, 372 nt, synthetic construct
  misc_feature 1..372: note = derived and/or modified sequence opt1 from anti-HIV-1_HeavyChain
  source 1..372: mol_type = other RNA
caggcccacctggagcagagcggcgccggggtgaagaagctcggcgcgtccgtccgcgtgagctgctggacctccgaggacatcttcaagaccgagctgatccactgggtgcggcaggcccccgggcagggcctggagtggatcgggtgggtcaaggccgtgagcggcgccgtgaactacggctccctcgacttccgccaccgggtcagcctgacgcgcgaccgggacctgtccaccgcccacatggacatccgcgggctcacccaggacgacaccgcgacgtacttctgcgcccggcagaagttcgcccgcggcgaccaggggtggttcttcgacctgtggggccgggggaccctgatcgtggtgagctcc

SEQ ID NO: 10908 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcagagcggctccggggtgaagaagcccggcgccagcgtccgggtgtcctgctggaccagcgaggacatcttcgagcgcacggagctgatccactgggtgcggcaggccccggggcagggcctcgagtggatcgggtgggtcaagaccgtgaccggcgcggtgaacttcggctcccccaacttccgccaccgggtcagcctgacccgcgaccgggacctgttcacggcccacatggacatccgcgggctcacccagggcgacaccgccacctacttctgcgcccggcagaagttctacgccgggggccaggggtggtacttcgacctgtggggccgcggcacgctgatcgtggtgtccagc

SEQ ID NO: 10909 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcggatctggagcggcgtgaagaagcccggggcctccgtccgcgtgagctgctggacctccgaggacatcttcgagcggacggagctgatccactgggtgcgccaggccccgggccaggggctcgagtggatcggctgggtcaagatcgtgagcggggcggtgaacttcggctcccccaacttccggcagcgcgtcagcctgacccgggaccgcgacctgttcaccgcccacatggacatccggggcctcacccagggggacacggccacctacttctgcgcccgccagaagttcgagcggggcgggcagggctggatcttcgacctgtgggggcgcggcaccctgatcgccgtgtccagc

SEQ ID NO: 10910 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgacctgagcaccgcccacatggacatccggcgcctcacccaggacgacaccgccacgtacttctgcgcgcggcagaagttcgcccgcggggaccagggctggttcttcgacctgtgggggcggggcaccctgatcgtggtgtccagc

SEQ ID NO: 10911 - RNA, 375 nt, synthetic construct
  misc_feature 1..375: note = derived and/or modified sequence opt1 from anti-HIV-1_HeavyChain
  source 1..375: mol_type = other RNA
cgccacaccgtggagcagagcggctccggggtcaagaagcccggcgccagcgtgcgggtgtcctgctggaccagcgaggacatcttcgagcgcacggagctgatccactgggtccggcaggccccggggcagggcctcgagtggatcgggtgggtgaagaccgtgaccggcgcggtcaacttcggctcccccaacttccgccaccgggtgagcctgacccgcgaccgggacctgttcacggcccacatggacatccgcgggctcacccagggcgacaccgccacctacttctgcgcccggcagaagttcgagcgcgggggccaggggtggtacttcgacctgtggggccggggcacgctgatcgtggtctccagc

SEQ ID NO: 10912 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagaccgtgacgggcgccgtgaacttcggcagctccgacttccgccagcgggtcagcctgacccccgaccgcgacctcttcaccgcccacatggacatccgggggctgacccagggcgacacggccacctacttctgcgcccgccagaagttctacgccgggggccaggggtggtacttcgacctgtggggccggggcaccctcatcgtggtgtccagc

SEQ ID NO: 10913 - RNA, 375 nt, synthetic construct
  misc_feature 1..375: note = derived and/or modified sequence opt1 from anti-HIV-1_HeavyChain
  source 1..375: mol_type = other RNA
cgccacaccgtggagcagagcggctccggggtcaagaaggtgggcgccagcgtgcgggtctcctgctggaccagcgaggacatcttcgagcgcacggagctgatccactgggtgcggcaggcccccgggcagggcctcgagtggatcgggtgggtgaaggcggtctccggcgccgtgaactacggcagcctggacttccgccaccgggtgtccctgacccgcgaccgggacctcttcaccgcccacatggacatccgcgggctgacccaggacgacacggccatctacttctgcgcccggcagaagttcgcgcgcggcgaccaggggtggttcttcgacctgtggggccgggggaccctcatcgtcgtgagctcc

SEQ ID NO: 10914 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctgggcgagcgaggacatcttcgagcggaccgagctcatccactgggtgcgccaggccccggggcagggcctggagtggatcgggtgggtcaagaccgtgtccggcgccgtgaacttcggcagccccaacttccggcaccgcgtctccctgacgcgggaccgcgacctcttcaccgcccacatggacatccgggggctgacccagggcgacaccgccacgtacttctgcgcgcgccagaagttcgagcgcgggggccaggggtggtacttcgacctgtggggccggggcaccctcatcgtggtgagctcc

SEQ ID NO: 10915 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcaggtctggagcggcgtgaagaagcccggggcctccgtgcgggtgagctgctggacctccgaggacatcttcgagcgcacggagctgatccactgggtccggcaggccccgggccaggggctcgagtggatcggctgggtgaagaccgtgaccggggcggtcaacttcggcagccccaacttccgccaccgggtgtccctgacccgcgaccgggacctgttcacggcccacatggacatccgcggcctcacccagggggacaccgccacctacttctgcgcccggcagaagttcgagcgcggcgggcagggctggtacttcgacctgtgggggcggggcacgctgatcgtggtcagctcc

SEQ ID NO: 10916 - RNA, 375 nt, synthetic construct
  misc_feature 1..375: note = derived and/or modified sequence opt1 from anti-HIV-1_HeavyChain
  source 1..375: mol_type = other RNA
cgccacacctggcggcagagcggctccggggtgaagaagctgggcgccagcgtccgcgtgtcctgctggaccagcgaggacatcttcgagcggacggagctcatccactgggtgcgccaggcccccgggcagggcctggagtggatcgggtgggtcaaggcggtgtccggcgtggtcaactacggcagcctggacttccggcaccgcgtgtccctcacccgggaccgcgacctgagcaccgcccacatggacatccgggggctgacccaggacgacacggccacctacttctgcgcccgccagaagttcgcccggggcgaccaggggtggttcttcgacctctggggccgcgggaccctgatcgtggtctccagc

SEQ ID NO: 10917 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcggggacatcttcgagcggaccgagctcatccactgggtgcgccaggcgccgggccaggggctggagtggatcggctgggtcaagatcgtgtccggcgccgtgaacttcgggagccccaacttccggcagcgcgtctccctgacgcgggaccgcgacctcttcaccgcccacatggacatccggggcctgacccagggggacaccgccacgtacttctgcgcccgccagaagttcgagcggggcgggcagggctggatcttcgacctgtggggccgcgggaccctcatcgcggtgagctcc

SEQ ID NO: 10918 - RNA, 375 nt, synthetic construct
  misc_feature 1..375: note = derived and/or modified sequence opt1 from anti-HIV-1_HeavyChain
  source 1..375: mol_type = other RNA
cgccacaccgtggagcagagcggctccggggtcaagaagcccggcgccagcgtgcgggtgtcctgctggaccagcgaggacatcttcgagaagtccgagctgatccactgggtccgccaggccccggggcagggcctcgagtggatcgggtgggtgaagacggtgaccggcgcggtcaacttcggcagctccgacttccggcagcgcgtgagcctgacccgggaccgcgacctgttcaccgcccacatggacatccgggggctcacgcagggcgacaccgccacctacttctgcgcccgccagaagttctacgccgggggccaggggtggtacttcgacctgtggggccggggcaccctgatcgtggtctccagc

SEQ ID NO: 10919 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcgctgggccagcgtccgggtgtcctgctggaccagcgaggacatcttcgagcgcaccgagctcatccactgggtgcggcaggcgcccggccaggggctggagtggatcggctgggtcaaggccgtgtccggggccgtgaactacggcagcctggacttccgccaccgggtctccctcacgcgcgaccgggacctgttcaccgcccacatggacatccgcggcctgacccaggacgacaccgccacgtacttctgcgcgcggcagaagttcgcccgcggggaccagggctggttcttcgacctctgggggcggggcaccctgatcgtggtgagctcc

SEQ ID NO: 10920 - RNA, 375 nt, synthetic construct
  misc_feature 1..375: note = derived and/or modified sequence opt1 from anti-HIV-1_HeavyChain
  source 1..375: mol_type = other RNA
cgccacaccgtggagcagagcggctccggggtcaagcggcccggcgccagcgtgcgcgtgtcctgctggaccagcgaggacatcttcgagacgaccgagctgatccactgggtccggcaggccccggggcagggcctcgagtggatcgggtgggtgaagaccgtgaccggcgcggtcaacttcggctccagcgacttccgccagcgggtgtccctgacgcgcgaccgggacctgttcaccgcccacatggacatccgcgggctcacccagggcgacaccgccacgtacttctgcgcccggcagaagttctacgccgggggccaggggtggtacttcgacctgtggggccgcggcaccctgatcgtggtcagctcc

SEQ ID NO: 10921 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgaggacatcttcgagcggaccgagctgatccactgggtgcgccaggcgcccgggcagggcctggagtggatcgggtgggtcaaggccgtgtccggcgccgtgaactacggcagcctcgacttccggcaccgcgtctccctgacgcgggaccgcgggctgttcaccgcccacatggacatccggggcctcacccaggacgacaccgccacgtacttctgcgcgcgccagaagttcgcccgcggggaccagggctggttcttcgacctgtgggggcggggcaccctgatcgtggtgagctcc

SEQ ID NO: 10922 - RNA, 375 nt, synthetic construct
  misc_feature 1..375: note = derived and/or modified sequence opt1 from anti-HIV-1_HeavyChain
  source 1..375: mol_type = other RNA
caggtgcacctggagcagagcggctccggggtcaagaagcccggcgccagcgtgcgcgtgtcctgctggaccagcgaggacatcttcgagaagtccgagctcatccactgggtccggcaggccccggggcagggcctggagtggatcgggtgggtgaagaccgtgacgggcgcggccaacttcggcagctccgacttccgccagcgggtcagcctgacccccgaccgcgacctcttcaccgcccacatggacatccgggggctgacccagggcgacacggccacctacttctgcgcccgccagaagttctacaagggcgggcaggggtggtacttcgacctgtggggccggggcaccctcatcgtggtgtccagc

SEQ ID NO: 10923 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggcgccggggtgaagaagcccggcgcgtccgtccgcgtgagctgctggacctccgaggacatcttcgacaccacggagctcatccactgggtgcggcaggccccggggcagggcctggagtggatcgggtgggtcaagatcgtgagcggcgccgtgaacttcggctcccccaacttccgccagcgggtcagcctgacccgcgaccgggacctcttcaccgcccacatggacatccgcgggctgacccagggcgacacggccacctacttctgcgcgcggcagaagttcgagcgcgggggccaggggtggatcttcgacctgtggggccggggcaccctcatcgccgtgtccagc

SEQ ID NO: 10924 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagccgggacatcttcgagcgcaccgagctgatccactgggtgcggcaggcgcccgggcagggcctggagtggatcgggtgggtcaaggccgtgtccggcgccgtgaactacggcagcctcgacttccgccaccgggtctccctgacgcgcgaccgggacctgagcaccgcccacatggacatccgcgggctcacccaggacgacaccgccacgtacttctgcgcgcggcagaagttcgcccgcggcgaccaggggtggttcttcgacctgtggggccgggggaccctgatcgtggtgtccagc

SEQ ID NO: 10925 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgcctggcgagcgaggacatcttcgagcggaccgagctgatccactgggtgcgccaggcccccgggcagggcctcgagtggatcgggtgggtcaaggccgtgtccggcgccgtgaactacggcagcctggacttccggcaccgcgtctccctgacccgggaccgcgacctcagcacggcccacatggacatccgggggctgacccaggacgacaccgcgacctacttctgcgcccgccagaagttcgcccggggcgaccaggggtggttcttcgacctgtggggccgcgggacgctcatcgtggtgtccagc

SEQ ID NO: 10926 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggccgagcgaggacatcttcgagcggaccgagctcatccactgggtgcgccaggcgcccgggcagggcctggagtggatcgggtgggtcaagaccgtgacgggcaccgtgaacttcggctccctgaacttccggcagcgcgtcagcctcacccgggaccgcgacctgttcaccgcccacatggacatccgggggctgacgcagggcgacaccgccacctacttctgcgcccgccagaagttcgagcgcgggggccaggggtggtacttcgacctctggggccggggcaccctgatcgtggtgtccagc

SEQ ID NO: 10927 - RNA, 375 nt, synthetic construct
  misc_feature 1..375: note = derived and/or modified sequence opt1 from anti-HIV-1_HeavyChain
  source 1..375: mol_type = other RNA
cgcgcccacctggagcagagcggctccgagtggaagaagctcggggccagcgtgcgggtctcctgctggaccagcggcgacatcttcgagcgcaccgagctgatccactgggtgcggcaggcgcccgggcagggcctggagtggatcgggtgggtgaaggccgtctccggcgccgtgaactacggcagcctcgacttccgccaccgggtgtccctgacgcgcgaccgggacctgttcaccgcccacatggacatccgcgggctcacccaggacgacaccgccacgtacttctgcgcgcggcagaagttcgcccgcggcgaccaggggtggttcttcgacctgtggggccgggggaccctgatcgtcgtgagctcc

SEQ ID NO: 10928 - RNA, 375 nt, synthetic construct
  misc_feature 1..375: note = derived and/or modified sequence opt1 from anti-HIV-1_HeavyChain
  source 1..375: mol_type = other RNA
cgccacaccgtggagcagagcggctccggggtcaagaagctgggcgccagcgtgaacgtgtcctgctggaccagcgaggacatcttcgagcggacggagctcatccactgggtccgccaggcccccgggcagggcctggagtggatcgggtgggtgaaggcggtgtccggcgccgtcaactacggcagcctggacttccggcaccgcgtgtccctcacccgggaccgcgacctgttcaccgcccacatggacatccgggggctgacccaggacgacacggccacctacttctgcgcccgccagaagttcgcgcggggcgaccaggggtggttcttcgacctctggggccgcgggaccctgatcgtggtcagctcc

SEQ ID NO: 10929 - RNA, 375 nt, synthetic construct
  misc_feature 1..375: note = derived and/or modified sequence opt1 from anti-HIV-1_HeavyChain
  source 1..375: mol_type = other RNA
caggcgcacctggagcagagcggctccggggtgaagaagcccggcgccagcgtccgcgtgtcctgctggaccagcgaggacatcttcgagaagtccgagctcatccactgggtgcggcaggcgccggggcagggcctggagtggatcgggtgggtcaagcccgtgaccggcgccgtgaacttcggcagctccgacttccgccagcgggtcagcctgacgcgcgaccgggacctcttcaccgcccacatggacatccgcgggctgacccagggcgacaccgccacgtacttctgcgcccggcagaagttctacgccgggggccaggggtggtacttcgacctgtggggccgcggcaccctcatcgtggtgtccagc

SEQ ID NO: 10930 - RNA, 375 nt, synthetic construct
  misc_feature 1..375: note = derived and/or modified sequence opt1 from anti-HIV-1_HeavyChain
  source 1..375: mol_type = other RNA
cgccacacctggaacaagagcggctccggggtgaagaagcccggcgccagcgtccgggtgtcctgctggaccagcgaggacatcttcgagcgcacggagctgatccactgggtgcggcaggccccggggcagggcctcgagtggatcgggtgggtcaagaccgtgaccggcgcggtgaacttcggctcccccaacttccgccaccgggtcagcctgacccgcgaccgggacctgttcacggcccacatggacatccgcgggctcacccagggcgacaccgccacctacttctgcgcccggcagaagttcgagcgcgggggccaggggtggtacttcgacctgtggggccggggcacgctgatcgtggtgtccagc

SEQ ID NO: 10931 - RNA, 375 nt, synthetic construct
  misc_feature 1..375: note = derived and/or modified sequence opt1 from anti-HIV-1_HeavyChain
  source 1..375: mol_type = other RNA
caggcccacagcgagcagtccggcagcggggtgaagaagcccggcgcctccgtccgcgtgagctgctggacctccgaggacatcttcgagcggaccgagctgatccactgggtgcgccaggcgccggggcagggcctcgagtggatcgggtgggtcaagatcgtgagcggcgccgtgaacttcggctcccccaacttccggcagcgcgtcagcctgacgcgggaccgcgacctgttcaccgcccacatggacatccgggggctcacccagggcgacaccgccacgtacttctgcgcccgccagaagttcgagcgcgggggccaggggtggatcttcgacctgtggggccggggcaccctgatcgcggtgtccagc

SEQ ID NO: 10932 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggcgccggggtgaagcgccccggcgcgtccgtccgggtgagctgctggacctccgaggacatcttcgagaccacggagctcatccactgggtgcgccaggccccggggcagggcctggagtggatcgggtgggtcaagaccgtgaccggcgccgtgaacttcggcagccccaacttccggcaccgcgtctccctgacccgggaccgcgacctcttcacggcccacatggacatccgggggctgacccagggcgacaccgccacctacttctgcgcgcgccagaagttcgagcgcgggggccaggggtggtacttcgacctgtggggccggggcacgctcatcgtggtgagctcc

SEQ ID NO: 10933 - RNA, 375 nt, synthetic construct
  misc_feature 1..375: note = derived and/or modified sequence opt1 from anti-HIV-1_HeavyChain
  source 1..375: mol_type = other RNA
ggccacacctgggagcagagcggggccggcgtgaagaagctgggggcctccgtccgcgtgagctgctggacctccgaggacatcttcgagcggacggagctcatccactgggtgcgccaggcgcccggccaggggctggagtggatcggctgggtcaaggccgtgagcggcgccgtgaactacgggtccctggacttccggcaccgcgtcagcctcacccgggaccgcgacctgttcaccgcccacatggacatccggggcctgacccaggacgacacggccatctacttctgcgcgcgccagaagttcgcccgcggggaccagggctggttcttcgacctctgggggcggggcaccctgatcgtggtgtccagc

SEQ ID NO: 10934 - RNA, 375 nt, synthetic construct
  misc_feature 1..375: note = derived and/or modified sequence opt1 from anti-HIV-1_HeavyChain
  source 1..375: mol_type = other RNA
ggcacccccgggagcgagtccggcagcggggtgaagaagctgggcgcctccgtccgcgtgagctgctggacctccgaggacatcttcgagcggacggagctcatccactgggtgcgccaggccccggggcagggcctggagtggatcggctgggtcaaggcggtgagcggggccgtgaactacggctccctggacttccggcaccgcgtcagcctcacccgggaccgcgacctgtccaccgcccacatggacatccgggggctgacccaggacgacacggccacctacttctgcgcccgccagaagttcgcgcggggcgaccaggggtggttcttcgacctctggggccgcggcaccctgatcgtggtgagctcc

SEQ ID NO: 10935 - RNA, 375 nt, synthetic construct
  misc_feature 1..375: note = derived and/or modified sequence opt1 from anti-HIV-1_HeavyChain
  source 1..375: mol_type = other RNA
ggcacccccgggagcgagtccggcagcggggtgaagatgccgggcgcctccgtccgcgtgagctgctggacctccgaggacatcttcgagcggacggagctgatccactgggtgcgccaggcccccgggcagggcctcgagtggatcggctgggtcaagaccgtgagcggggcggtgaacttcggctcccccaacttccggcaccgcgtcagcctgacccgggaccgcgacctgttcaccgcccacatggacatccgggggctcacgcagggcgacaccgccacctacttctgcgcccgccagaagttcgagcgcgggggccagggctggtacttcgacctgtgggggcggggcaccctgatcgtggtgtccagc

SEQ ID NO: 10936 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcagagcggcgccggggtgaagaagcccggcgcctccgtccgggtgagctgctggacctccgaggacatcttcgagcgcacggagctgatccactgggtgcggcaggcgccggggcagggcctcgagtggatcgggtgggtcaagaccgtgagcggcgccgtgaacttcggctcccccaacttccgccaccgggtcagcctgacccgcgaccgggacctgttcaccgcccacatggacatccgcgggctcacgcagggcgacaccgccacctacttctgcgcccggcagaagttcgagcgcgggggccaggggtggtacttcgacctgtggggccggggcaccctgatcgtggtgtccagc

SEQ ID NO: 10937 - RNA, 375 nt, synthetic construct
  misc_feature 1..375: note = derived and/or modified sequence opt1 from anti-HIV-1_HeavyChain
  source 1..375: mol_type = other RNA
ggcacccccgggaacaagagcggctccggggtgaagaagccgggcgccagcgtccgcgtgtcctgctggaccagcgaggacatcttcgagaagtccgagctgatccactgggtgcggcaggcccccgggcagggcctcgagtggatcggctgggtcaagacggtgaccggggcggtgaacttcggcagctccgacttccgccagcgggtcagcctgacccgcgaccgggacctgttcaccgcccacatggacatccgcgggctcacgcagggcgacaccgccacctacttctgcgcccggcagaagttctacgccgggggccagggctggtacttcgacctgtgggggcgcggcaccctgatcgtggtgtccagc

SEQ ID NO: 10938 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggcgccggggtgaagaagcccggcgcgtccgtccgcgtgagctgctggtccagcgaggacatcttcgagcggaccgagctcatccactgggtgcgccaggccccggggcagggcctggagtggatcgggtgggtcaagaccgtgacgggcgccgtgaacttcggctcccccaacttccggcaccgcgtcagcctgacccgggaccgcgacctcttcaccgcccacatggacatccgggggctgacccagggcgacacggccacctacttctgcgcgcgccagaagttcgagcgcgggggccaggggtggtacttcgacctgtggggccggggcaccctcatcgtggtgtccagc

SEQ ID NO: 10939 - RNA, 375 nt, synthetic construct
  misc_feature 1..375: note = derived and/or modified sequence opt1 from anti-HIV-1_HeavyChain
  source 1..375: mol_type = other RNA
ggcacccccgggaacaagagcggctccggggtgaagaagccgggcgccagcgtccgcgtgtcctgctggaccagcgaggacatcttcgagcggacggagctgatccactgggtgcgccaggcccccgggcagggcctcgagtggatcggctgggtcaagaccgtgaccggggcggtgaacttcggctcccccaacttccggcaccgcgtcagcctgacccgggaccgcgacctgttcacggcccacatggacatccgggggctcacccagggcgacaccgccacctacttctgcgcccgccagaagttcgagcgcgggggccagggctggatcttcgacctgtgggggcggggcacgctgatcgccgtgtccagc

SEQ ID NO: 10940 - RNA, 375 nt, synthetic construct
  misc_feature 1..375: note = derived and/or modified sequence opt1 from anti-HIV-1_HeavyChain
  source 1..375: mol_type = other RNA
ggcacccccgggaacaagagcggctccggggtgaagaagccgggcgccagcgtccgcgtgtcctgctggagctccgaggacatcttcgagcggaccgagctgatccactgggtgcgccaggcccccgggcagggcctcgagtggatcggctgggtcaagacggtgaccggggcggtgaacttcggcagcctggacttccggcaccgcatctccctgacccgggaccgcgacctcttcaccgcccacatggacatccgggggctgacgcagggcgacaccgccacctacttctgcgcccgccagaagttcgagcgcgggggccagggctggatcttcgacctgtgggggcggggcaccctcatcgccgtcagctcc

SEQ ID NO: 10941 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcgcctccggcgtgaagcgccccgggggctgggtccgggtgagctgctggacctccgaggacatcttcgagcgcagcgagctcatctactgggtgcggcaggcgccggggcagggcctggagtggatcgggtgggtcaagaccgtgacgggcgccgtgaacttcggctcccccaacttccgccaccgggtcagcctgacccgcgaccgggacctcttcaccgcccacatggacatccgcgggctgacccagggcgacacggccacctacttctgcgcccggcagaagttcgagcgcgggggccaggggtggtacttcgacctgtggggccggggcaccctcatcgtggtgtccagc

SEQ ID NO: 10942 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacgtccagcggcgccgtgaacttcggctcccccaacttccggacccgcgtgagcctgacccgggaccgcgacctcttcaccgcccacatggacatccgggggctgacgcagggcgacaccgccacctacttctgcgcccgccagaagttcgagcgcgggggccaggggtggtacttcgacctgtggggccggggcaccctcatcgtcgtgtccagc

SEQ ID NO: 10943 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggcgccggggtgaagaagcccggcgcgtccgtccgcgtgagctgctggacctccgaggacatcttcgagcggaccgagctcatccactgggtgcgccaggccccggggcagggcctggagtggatcgggtgggtcaagacggtgagcggcgccgtgaacttcggctcccccaacttccggcaccgcgtcagcctgacccgggaccgcgacctcttcaccgcccacatggacatccgggggctgacccagggcgacacggccacctacttctgcgcgcgccagaagttcgagcgcgggggccaggggtggtacttcgacctgtggggccggggcaccctcatcgtggtgtccagc

SEQ ID NO: 10944 - RNA, 375 nt, synthetic construct
  misc_feature 1..375: note = derived and/or modified sequence opt1 from anti-HIV-1_HeavyChain
  source 1..375: mol_type = other RNA
cgccacacctgggagcagagcggctccggggtgaagaagcccggcgccagcgtccgggtgtcctgctggaccagcgaggacatcttcgagcgcacggagctgatccactgggtgcggcaggccccggggcagggcctcgagtggatcgggtgggtcaagaccgtgaccggcgcggtgaacttcggctcccccaacttccgccaccgggtcagcctgacccgcgaccgggacctgttcacggcccacatggacatccgcgggctcacccagggcgacaccgccacctacttctgcgcccggcagaagttcgagcgcgggggccaggggtggtacttcgacctgtggggccggggcacgctgatcgtggtgtccagc

SEQ ID NO: 10945 - RNA, 375 nt, synthetic construct
  misc_feature 1..375: note = derived and/or modified sequence opt1 from anti-HIV-1_HeavyChain
  source 1..375: mol_type = other RNA
ggcaccacctggaacaagagcgggtccggcgtgaagaagcccggggccagcgtccgcgtgtcctgctggacgagcgaggacatcttcgagcggaccgagctgatccactgggtgcgccaggccccgggccaggggctcgagtggatcggctgggtcaagaccgtgaccggcgcggtgaacttcgggtcccccaacttccggcaccgcgtcagcctgacgcgggaccgcgacctgttcaccgcccacatggacatccggggcctcacccagggggacaccgccacgtacttctgcgcccgccagaagttcgagcggggcgggcagggctggtacttcgacctgtggggccgcgggaccctgatcgtggtgtccagc

SEQ ID NO: 10946 - RNA, 375 nt, synthetic construct
  misc_feature 1..375: note = derived and/or modified sequence opt1 from anti-HIV-1_HeavyChain
  source 1..375: mol_type = other RNA
cgccacacctggaacgagagcggctccggggtgaagaagcccggcgccagcgtccgggtgtcctgctggaccagcgaggacatcttcgagaagtccgagctgatccactgggtgcgccaggccccggggcagggcctcgagtggatcgggtgggtcaagacggtgaccggcgcggtgaacttcggcagctccgacttccggcagcgcgtcagcctgacccgggaccgcgacctgttcaccgcccacatggacatccgggggctcacgcagggcgacaccgccacctacttctgcgcccgccagaagttctacgccgggggccaggggtggtacttcgacctgtggggccggggcaccctgatcgtggtgtccagc

SEQ ID NO: 10947 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccggggtgaagaagctcggcgccagcgtccgcgtgtcctgctggaccagcgggaacatcttcgagcggaccgagctgatccactgggtgcgccaggcgcccggccaggggctggagtggatcggctgggtcaaggccgtgtccggcgccgtgaactacgggagcctcgacttccggcaccgcgtctccctgacgcgggaccgcgacctgagcaccgcccacatggacatccggggcctcacccaggacgacaccgccacgtacttctgcgcgcgccagaagttcgcccgcggggaccagggctggttcttcgacctgtgggggcggggcaccctgatcgtggtgtccagc

SEQ ID NO: 10948 - RNA, 378 nt, synthetic construct
  misc_feature 1..378: note = derived and/or modified sequence opt1 from anti-HIV-1_HeavyChain
  source 1..378: mol_type = other RNA
cgctgcagcatggagcagcccggctggtccgagaagccgggggccagcgtgaccctgtcctgcaagaccgccgacgaggacgtcttcgacgcggcctacatgcactgggtgcggcaggcccccggccagacgttcgagtggctcgggtggatgaagcccgtgaccggcgccgtcagctacgcccgcaagttccaggggcgggtgtccttctacatgacccgcgagctgggcatggcgtacatggacctgcggaacctccgcttcgacgacaccgccgtgtacttctgcgcccggaagacggccggcgacgtcagcggggacaaccgcggctacttcttcgacctgtgggggcggggctcccgcgtgatcgtgagctcc

SEQ ID NO: 10949 - RNA, 375 nt, synthetic construct
  misc_feature 1..375: note = derived and/or modified sequence opt1 from anti-HIV-1_HeavyChain
  source 1..375: mol_type = other RNA
cgccacaccagcgagcagtccggcagcggggtgaagaagcccggcgcctccgtccgggtgagctgctggacctccgaggacatcttcgagcgcagcgagctgatccactgggtgcggcaggccccggggcagggcctcgagtggatcgggtgggtcaagacggtgaccggcgcggtgaacttcggctcccccaacttccgccaccgggtcagcctgacccgcgaccgggacctgttcaccgcccacatggacatccgcgggctcacgcagggcgacaccgccacctacttctgcgcccggcagaagtactacgccgggggccaggggtggtacttcgacctgtggggccgcggcaccctgatcgtggtgtccagc

SEQ ID NO: 10950 - RNA, 375 nt, synthetic construct
  misc_feature 1..375: note = derived and/or modified sequence opt1 from anti-HIV-1_HeavyChain
  source 1..375: mol_type = other RNA
cgccacaccgtggagcagagcggcgccggggtcaagaagcccggcgcctccgtgcgggtgagctgctggacctccgaggacatcttcgagcgcacggagctgatccactgggtccggcaggcgccggggcagggcctcgagtggatcgggtgggtgaagaccgtgagcggcgccgtcaacttcggctcccccaacttccgccaccgggtgagcctgacccgcgaccgggacctgttcaccgcccacatggacatccgcgggctcacgcagggcgacaccgccacctacttctgcgcccggcagaagttcgagcgcgggggccaggggtggtacttcgacctgtggggccggggcaccctgatcgtggtctccagc

SEQ ID NO: 10951 - RNA, 375 nt, synthetic construct
  misc_feature 1..375: note = derived and/or modified sequence opt1 from anti-HIV-1_HeavyChain
  source 1..375: mol_type = other RNA
ggcaccccctggaacgagagcgggtccggcgtgaagaagccgggggccagcgtccgcgtgtcctgctggaccagcgaggacatcttcgagaagtccgagctgatccactgggtgcggcaggcccccggccaggggctcgagtggatcggctgggtcaagacggtgaccggcgcggtgaacttcgggagccccaacttccgccaccgggtctccctgacccgcgaccgggacctgttcaccgcccacatggacatccgcggcctcacgcagggggacaccgccacctacttctgcgcccggcagaagttcgagcgcggcgggcagggctggtacttcgacctgtggggccgggggaccctgatcgtggtgagctcc

SEQ ID NO: 10952 - RNA, 375 nt, synthetic construct
  misc_feature 1..375: note = derived and/or modified sequence opt1 from anti-HIV-1_HeavyChain
  source 1..375: mol_type = other RNA
cgccacgacctggagcccagcggctccggggtgaagaagccgggcgccagcgtccgggtgtcctgctggaccagcgaggacatcttcgagcgcaccgagctcatccactgggtgcggcaggcccccgggcagggcctggagtggatcgggtgggtcaagacggtgaccggcgcggtgaacttcggctccctggacttccgccaccggatcagcctcacccgcgaccgggacctgttcaccgcccacatggacatccgcgggctgacgcagggcgacaccgccacctacttctgcgcccggcagaagttcgagtcccgctacaccgggggccaggggtggtacttcgacctctggggccggggcacgcacatcgtc

SEQ ID NO: 10953 - RNA, 375 nt, synthetic construct
  misc_feature 1..375: note = derived and/or modified sequence opt1 from anti-HIV-1_HeavyChain
  source 1..375: mol_type = other RNA
cgccacaccgtggagcagagcggctccggggtcaagaagctgggcgccagcgtgcgggtgtcctgcctcgccagcgaggacatcttcgagcgcaccgagctgatccactgggtccggcaggcgcccgggcagggcctggagtggatcgggtgggtgaaggccgtgtccggcgccgtcaactacggcagcctcgacttccgccaccgggtgtccctgacgcgcgaccgggacctgagcaccgcccacatggacatccgcgggctcacccaggacgacaccgccacgtacttctgcgcgcggcagaagttcgcccgcggcgaccaggggtggttcttcgacctgtggggccgggggaccctgatcgtggtctccagc

SEQ ID NO: 10954 - RNA, 375 nt, synthetic construct
  misc_feature 1..375: note = derived and/or modified sequence opt1 from anti-HIV-1_HeavyChain
  source 1..375: mol_type = other RNA
caggcccacctggagcagagcggctccgagagcaagaagcccggggcctccgtgcgcgtcagctgctggacctccgaggacatcttcgagaagtccgagctcatccactgggtgcggcaggcgccgggccaggggctggagtggatcggctgggtgaagaccgtcacgggggccgtgaacttcggcagcagcgacttccgccagcgggtgtccctgacccgcgaccgggacctcttcaccgcccacatggacatccgcggcctgacccagggggacacggccacctacttctgcgcccggcagaagttctacgcgggcgggcagggctggtacttcgacctgtgggggcgcggcaccctcatcgtcgtgagctcc

SEQ ID NO: 10955 - RNA, 375 nt, synthetic construct
  misc_feature 1..375: note = derived and/or modified sequence opt1 from anti-HIV-1_HeavyChain
  source 1..375: mol_type = other RNA
ggcacccccgggagcgagtccgccagcggcgtgcgccggccgggggcctccgtccgcgtgagctgctggacctccgaggacatcttcgagcggagcgagctgatctactgggtgcgccaggcgcccggccgggggctcgagtggatcggctggatcaagctggtctccggcgccgtgaacttcgggagcgtggacttccgcgaccgggtctccctgacgcgcgaccgggacctcttcaccgcccacatggacatccgcggcctgacccagggggacaccgccacgtacttctgcgcccggcagaagttcgagcgcggcgggcagggctggtacttcgacctgtggggccgggggaccctcatcgtggtgagctcc

SEQ ID NO: 10956 - RNA, 375 nt, synthetic construct
  misc_feature 1..375: note = derived and/or modified sequence opt1 from anti-HIV-1_HeavyChain
  source 1..375: mol_type = other RNA
caggtgcacctggagcagagcggctccggggtcaagaagcccggcgccagcgtgcgcgtgtcctgctggaccagcgaggacatcttcgagaagtccgagctcatccagtgggtccggcaggccccggggcagggcctggagtggatcgggtgggtgaagaccgtgacgggcgcggtcaacttcggcagctccgacttccgccagcgggtgagcctgacccgcgaccgggacctcttcaccgcccacatggacatccgcgggctgacccagggcgacacggccacctacttctgcgcccggcagaagttctacgccgggggccaggggtggtacttcgacctgtggggccgcggcaccctcatcgtggtctccagc

SEQ ID NO: 10957 - RNA, 375 nt, synthetic construct
  misc_feature 1..375: note = derived and/or modified sequence opt1 from anti-HIV-1_HeavyChain
  source 1..375: mol_type = other RNA
ggcacccccgggagcgagtccggcagcggggtgaagaaggtcggcgcctccgtgcgcgtgagctgctggacctccgaggacatcttcgagcggacggagctgatccactgggtccgccaggccccggggcagggcctcgagtggatcggctgggtgaaggcggtgagcggggccgtcaactacggctccctggacttccggcaccgcgtgagcctgacccgggaccgcgacctcttcaccgcccggatggacatccgcgggctgacccaggacgacacggccatctacttctgcgcccggcagaagttcgcgcgcggcgaccaggggtggttcttcgacctgtggggccggggcaccctcatcgtggtctccagc

SEQ ID NO: 10958 - RNA, 375 nt, synthetic construct
  misc_feature 1..375: note = derived and/or modified sequence opt1 from anti-HIV-1_HeavyChain
  source 1..375: mol_type = other RNA
ggcacccccgggagcgagtccggcagcggggtgaagcgcccgggcgcctccgtccgggtgagctgctggacctccgaggacatcttcgagacgaccgagctgatccactgggtgcgccaggcccccgggcagggcctcgagtggatcggctgggtcaagaccgtgagcggggcggtgaacttcggctccctgaacttccggcaccgcgtcagcctgacccgggaccgcgacctctccacggcccacatggacatccgggggctgacccaggacgacaccgccacctacttctgcgcccgccagaagttcgcccggggcgaccaggggtggttcttcgacctgtggggccgcggcacgctcatcgtggtgagctcc

SEQ ID NO: 10959 - RNA, 372 nt, synthetic construct
  misc_feature 1..372: note = derived and/or modified sequence opt1 from anti-HIV-1_HeavyChain
  source 1..372: mol_type = other RNA
cgcgcccacctggagcagagcggcgccggggtgaagaagcccggcgggtgggtccgggtgtcctgctggaccagcgaggacatcttcaagaccgagctcatccactgggtgcgccaggcgccgggccaggggctggagtggatcggctgggtcaagacggtgaccggcgccgtgaacttcgggtcccccaacttccggcaccgcgtcagcctgacccgggaccgcgacctcttcaccgcccacatggacatccggggcctgacgcagggggacaccgccacctacttctgcgcccgccagaagttcgagcggggcgggcagggctggtacttcgacctgtggggccgcgggaccctcatcgtggtgtccagc

SEQ ID NO: 10960 - RNA, 378 nt, synthetic construct
  misc_feature 1..378: note = derived and/or modified sequence opt1 from anti-HIV-1_HeavyChain
  source 1..378: mol_type = other RNA
caggtgcagctgatgcagagcggcgccgaggtcaagcgccccggggcctccgtgaagatcagctgcaccgcgtccggcttcaccctcacggaccactacatgcactgggtgcggcaggccccggggcagaccttcgagtggctgggctggatgaagcccgtcaccggggccgtgaactacgcccgcaagttccagggccgggtgagcttctaccgcacccgggagctgggcatcgcctacatggacctccgcaacctgcggttcgacgacacggcggtctacttctgcgcccgcaagaccgccggggacgtgtccggcgacaagcgggggttcttcttcgacctgtggggccgcgggagccgggtgatcgtctccagc

SEQ ID NO: 10961 - RNA, 378 nt, synthetic construct
  misc_feature 1..378: note = derived and/or modified sequence opt1 from anti-HIV-1_HeavyChain
  source 1..378: mol_type = other RNA
caggtgcagctggtccagagcggcgccgaggtgaagaagcccggggcctccgtgaaggtcagctgcaaggcgtccggctacaacttcaccgggtactacctccactgggtgcgccaggccccgggccagaccttcgagtggctggggtggatgaagcccgtgacgggcgccgtcagctacgcccggaagttccagggccgcgtgtccttctacatgacccgggagctggggatggcctacatggacctccgcaacctgcggttcgacgacaccgcggtgtacttctgcgcccgcaagaccgccggcgacgtcagcggggacaaccggggctacttcttcgacctgtgggggcgcggctcccgggtgatcgtgagctcc

SEQ ID NO: 10962 - RNA, 375 nt, synthetic construct
  misc_feature 1..375: note = derived and/or modified sequence opt1 from anti-HIV-1_HeavyChain
  source 1..375: mol_type = other RNA
ggcacccccgggagcaagtccggcagcggggtgaagaagccgggcgcctccgtccgcgtgagctgctggacctccgaggacatcttcgagcggacggagctgatccactgggtgcgccaggcccccgggcagggcctcgagtggatcggctgggtcaagaccgtgaccggggcggtgaacttcggcagccccaacttccggcaccgcgtctccctgacccgggaccgcgacctgttcacggcccacatggacatccgggggctcacccagggcgacaccgccacctacttctgcgcccgccagaagttcgagcgcgggggccagggctggtacttcgacctgtgggggcggggcacgctgatcgtggtgagctcc

SEQ ID NO: 10963 - RNA, 378 nt, synthetic construct
  misc_feature 1..378: note = derived and/or modified sequence opt1 from anti-HIV-1_HeavyChain
  source 1..378: mol_type = other RNA
caggtgcagctggtccagagcggcgccgagctcaagaagcccggggcctccgtgaaggtgagctgcgaggcgtccggctacagcttcaccgaccaccacatccactgggtccgccaggccccggggcagggcctggagtggctggggtggatgaaccccaacaacggcgacaccgcctacgcccagacgttcctcggccgggtgaccatgacccgcgacacctccatcaacacggcctacatggagctgagccggctgacctccgacgacaccgcggtgtacttctgcgcccgcaagaccgccggggacgtcagcggcgacaagcgggggttcttcttcgacctctggggccgcgggtcccgggtgatcgtgagctcc

SEQ ID NO: 10964 - RNA, 378 nt, synthetic construct
  misc_feature 1..378: note = derived and/or modified sequence opt1 from anti-HIV-1_HeavyChain
  source 1..378: mol_type = other RNA
caggtgtacatgagctcccgcggcgggatgaagaagcccggcgccagcatgaccgtctcctgcaagaccgccgacgaggacatcttcgacgcggcctacatgcactgggtgcggcaggccccggggcagacgttcgagtggctgggctggatgaagcccgtgaccggggccgtcaactacgcccgccagttccagggccgggtgagcttctaccgcacccgggagctcggcatcgcgtacatggacctgcgcgacctgaagttcgacgacaccgccgtgtacttctgcgcccggaagacgaagggggacgtctccggcgacgaccgcgggttcttcttcgacctctggggccgggggacccgcgtgatcgtgagctcc

SEQ ID NO: 10965 - RNA, 378 nt, synthetic construct
  misc_feature 1..378: note = derived and/or modified sequence opt1 from anti-HIV-1_HeavyChain
  source 1..378: mol_type = other RNA
caggtgcagctggtccagagcggcgccgaggtgaagaagcccggggcctccgtgaaggtcagctgcaaggcgtccggctacaccttcaccgcctactacatgcactggctccgccaggccccggggcagggcctggagtggatggggtggatcaacccccacagcggcggcacgaacttcgcccagaagttccaggggcgggtgaccatgacccgcgacacctccatcacgaccgcctacatggagctgagccggctccgctccgacgacaccgcgacctacttctgcgcccggcagaagttcgccagccgctactccggcgaccaggggagctacttcgacctgtggggccgggggacgctgatcgtggtctccagc

SEQ ID NO: 10966 - RNA, 375 nt, synthetic construct
  misc_feature 1..375: note = derived and/or modified sequence opt1 from anti-HIV-1_HeavyChain
  source 1..375: mol_type = other RNA
cgcgcccacctggagcagagcggcgccggggtgaagaagctcggcgcgtccgtccgggtgagctgctggacctccgaggacatcttcgagcgcaccgagctgatccactgggtgcggcaggcccccgggcagggcctggagtggatcgggtgggtcaaggccgtgagcggcgccgtgaactacggctccctcgacttccgccaccgggtcagcctgacgcgcgaccgggacctgttcaccgcccacatggacatccgcgggctcacccaggacgacaccgcgacgtacttctgcgcccggcagaagttcgcccgcggcgaccaggggtggttcttcgacctgtggggccgggggaccctgatcgtggtgtccagc

SEQ ID NO: 10967 - RNA, 378 nt, synthetic construct
  misc_feature 1..378: note = derived and/or modified sequence opt1 from anti-HIV-1_HeavyChain
  source 1..378: mol_type = other RNA
caggtgcgcctggtccagagcggcgccgacgtgaagcagcccggggcctccgtgaaggtcagctgcaaggcgtccggctacaccttcaccgactactacatgcactgggtgcggcaggccccggggcagacgttcgagtggctcggctggatgaagcccgtgaccggggccgtcagctacgcccgcaagttccagggccgggtgtccttctacatgacccgcgagctgggcatggcctacatggacctgcggaacctccgcttcgacgacaccgcggtgtacttctgcgcccggaagacggccggggacgtcagcggcgacaaccgcgggtacttcttcgacctgtggggccgggggtcccgcgtgatcgtgagctcc

SEQ ID NO: 10968 - RNA, 378 nt, synthetic construct
  misc_feature 1..378: note = derived and/or modified sequence opt1 from anti-HIV-1_HeavyChain
  source 1..378: mol_type = other RNA
caggcccacctgggcaacaagagcgggtccggcgtgaagaagcccggggccagcgtccgcgtgtcctgctggaccagcgaggacatcttcgagaagtccgagctcatccactgggtgcggcaggcgccgggccaggggctggagtggatcggctgggtcaagaccgtgacgggcgccgtgaacttcgggagctccgacttccgccagcgggtcagcctgacccgcgaccgggacctcttcaccgcccacatggacatccgcggcctgacccagggggacacggccacctacttctgcgcccggcagaagttctacgcgggcgggcagggctggtacttcgacctgtggggccgcgggaccctcatcgtggtgtccagc

SEQ ID NO: 10969 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcagagcggcgggggcgtcaagaagcccggggcctccgtgaccctgagctgcaagaccgccgacgaggacgtgttcgacgcggcctacatgcactgggtccgccaggccccgggccagacgttcgagtggctcgggtggatgaagcccgtgaccggcgccgtgaactacgcccggaagttccagggccgcgtctccttctaccggacccgcgagctggggatcgcgtacatggacctgcggaacctccgcttcgacgacaccgccgtgtacttctgcacgcggaagaccgccggcgacgtgagcggggacaagcgcggcttcttcttcgacctgtgggggcggggctcccgcgtcatcgtgagctcc

SEQ ID NO: 10970 - RNA, 381 nt, synthetic construct
  misc_feature 1..381: note = derived and/or modified sequence opt1 from anti-HIV-1_HeavyChain
  source 1..381: mol_type = other RNA
caggtgtacgtcgagcagcccggcgggggcgtgaagaagccgggggccagcgtgaccctgtcctgcaagaccgccgacgaggacgtcttcgacgcgacgtacatgcactgggtgcgccaggcccccggccagaccttcgagtggctcgggtggatgaagcccgtgaccggcgccgtcaactacgcccggaagttccagggccgcgtgagcttctaccggacccgcgagctggggatcgcctacatggacctgcggaacctccgcttcgacgacacggcggtgtacttctgcgcccggaagaccgccggcgacgtctccggggacaagcgcggcttcttcttcgacctgtgggggcggggcagccgcgtgatcgtgtccagc

SEQ ID NO: 10971 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgtcgaggtggagaagcccggggccagcgtgaccctgtcctgcaagaccgcggacgaggacgtcttcgacgccgcctacatgcactgggtgcgccaggccccgggccagacgttcgagtggctcgggtggatgaagcccgtgaccggcgccgtcagctacgcgcggaagttccaggggcgcgtgtccttctacatgacccgggagctgggcatggcctacatggacctgcgcaacctccggttcgacgacaccgccgtgtacttctgcgcccgcaagacggcgggcgacgtcagcggggacaaccggggctacttcttcgacctgtgggggcgcggctcccgggtgatcgtgagctcc

SEQ ID NO: 10972 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgccggggtcaagaagcccggcgcgagcgtgaccctgtcctgcaagaccgccgacgaggacgtgttcgacgccgcctacatgcactgggtccgccaggccccggggcagacgttcgagtggctcggctggatgaagcccgtgaccggggcggtgagctacgcccggaagttccagggccgcgtctccttctacatgacccgggagctgggcatggcctacatggacctgcgcaacctccggttcgacgacaccgccgtgtacttctgcgcgcgcaagacggccggggacgtgagcggcgacaaccgggggtacttcttcgacctgtggggccgcgggtcccgggtcatcgtgagctcc

SEQ ID NO: 10973 - RNA, 381 nt, synthetic construct
  misc_feature 1..381: note = derived and/or modified sequence opt1 from anti-HIV-1_HeavyChain
  source 1..381: mol_type = other RNA
caggtgcacatggagcaggccggcgccggggtcaagaagcccggcgcgagcgtgaccctgtcctgcaagaccgccgacgaggacgtgttcgacgccgcctacatgcactgggtccgccaggccccggggcagacgttcgagtggctcggctggatgaagcccgtgaccggggcggtgaactacgcccggaagttccagggccgcgtcagcttctaccggacccgcgagctgggcatcgcctacatggacctgcggaacctccgcttcgacgacaccgccgtgtacttctgcgcgcggaagacggccggggacgtgtccggcgacaagcgcgggttcttcttcgacctgtggggccgggggagccgcgtcatcgtgtccagc

SEQ ID NO: 10974 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgccgaggtcaagaagcccggggcgagcgtgaccctgtcctgcgagaccgccgacgaggacgtgttcgacgccgcctacatgcactgggtccgccaggccccgggccagacgttcgagtggctcgggtggatgaagcccgtgaccggcgcggtgaactacgcccggaagttccaggggcgcgtcagcttctaccggacccgcgagctgggcatcgcctacatggacctgcggaacctccgcttcgacgacaccgccgtgtacttctgcgcgcggaagacggccggcgacgtgtccggggacaagcgcggcttcttcttcgacctgtgggggcggggcagccgcgtcatcgtgtccagc

SEQ ID NO: 10975 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcagcccggcgggggcgtcaagaagccgggggccagcgtgaccctgtcctgcaagaccgccgacgaggacgtgttcgacgcggcctacatgcactgggtccgccaggcccccggccagacgttcgagtggctcgggtggatgaagcccgtgaccggcgccgtgaactacgcccggaagttccagggccgcgtcagcttctaccggacccgcgagctggggatcgcgtacatggacctgcggaacctccgcttcgacgacaccgccgtgtacttctgcgcccggaagacggccggcgacgtgtccggggacaagcgcggcttcttcttcgacctgtgggggcggggcagccgcgtcatcgtgtccagc

SEQ ID NO: 10976 - RNA, 372 nt, synthetic construct
  misc_feature 1..372: note = derived and/or modified sequence opt1 from anti-HIV-1_HeavyChain
  source 1..372: mol_type = other RNA
gccaccccctggaacaagagcggctccggggtgaagaagccgggcgccagcgtccgcgtgtcctgctggaccagcgaggacatcttcgagcggacggagctgtccctcgtgcgccaggcgcccgggcagggcctggagtggatcgggtggatgaagaccgtcaccggcgccgtgaacttcggcagccccaacttccggcacggggtgtccctgacccgcgaccgggacctcttcacggcccacatggacatccgcggcctgacccagggggacaccgccacctacttctgcgcccggcagaagttcgagcgcggcgggcagggctggtacttcgacctgtggggccgggggacgctcatcgtcgtgagctcc

SEQ ID NO: 10977 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgccgggatgaagaagcccggcgcgagcatgaccgcctcctgcaagaccgccgacgaggacatcttcgacgccgcctacatgcactgggtccgccaggcgccggggcagacgttcgagtggctgggctggatgaagcccgtgaccggggccgtgaactacgcccggcagttccagggccgcgtcagcttctaccggacccgcgagctcggcatcgcctacatggacctgcgggacctgaagttcgacgacaccgcggtgtacttctgcgcccgcaagacgaagggggacgtgtccggcgacgaccgggggttcttcttcgacctctggggccgcgggacccgggtcatcgtgagctcc

SEQ ID NO: 10978 - RNA, 378 nt, synthetic construct
  misc_feature 1..378: note = derived and/or modified sequence opt1 from anti-HIV-1_HeavyChain
  source 1..378: mol_type = other RNA
caggtgcagctggtccagagcggcgccgaggtgaagaagcccggggcctccgtgaaggtcagctgcaaggcgtccggctacaccttcaccgggtactacatgcactgggtgcgccaggccccgggccagacgttcgagtggctcgggtggatgaagcccgtgaccggcgccgtcaactacgcccggcagttccagggccgcgtgagcttctaccggacccgcgagctggggatcgcctacatggacctgcgggacctcaagttcgacgacaccgcggtgtacttctgcgcccgcaagacgaaggccgacgtctccggcgacgaccgggggttcttcttcgacctgtggggccgcgggacccgggtgatcgtgagctcc

SEQ ID NO: 10979 - RNA, 381 nt, synthetic construct
  misc_feature 1..381: note = derived and/or modified sequence opt1 from anti-HIV-1_HeavyChain
  source 1..381: mol_type = other RNA
cgcgtgtacatggagcaggccggcgccggggtcaagaagcccggcgcgagcgtgaccctgtcctgcaagaccgccgacgaggacgtgttcgacgccgcctacatgcactgggtccggcaggccccggggcagacgttcgagtggctcggctggatgaagcccgtgaccggggcggtgagctacgcccgcaagttccagggccgggtctccttcaccatgacccgcgagctgggcatggcctacatggacctgcggaacctccgcttcgacgacacggccgtgtacttctgcgcgcggaagaccgccggggacgtgagcggcgacaaccgcgggtacttcttcgacctgtggggccgggggtcccgcgtcatcgtgagctcc

SEQ ID NO: 10980 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcagagcggcgggggcgtcaagaagcccgggccgtccgtgaccctgagctgcaagaccgccgacgaggacgtgttcgacgccgcgtacatgcactgggtccgccaggcccccggccagacgttcgagtggctcgggtggatgaagcccgtgaccggcgccgtgaactacgcccggaagttccagggccgcgtctccttctaccggacccgcgagctggggatcgcctacatggacctgcggaacctccgcttcgacgacaccgcggtgtacttctgcgcccggaagacggccggcgacgtgagcggggacaagcgcggcttcttcttcgacctgtgggggcggggctcccgcgtcatcgtgagctcc

SEQ ID NO: 10981 - RNA, 378 nt, synthetic construct
  misc_feature 1..378: note = derived and/or modified sequence opt1 from anti-HIV-1_HeavyChain
  source 1..378: mol_type = other RNA
caggtgcagctggtccagagcggcgccgaggtgaagaagcccggggcctccgtgaaggtcagctgcaaggcgtccggctacaccttcaccgggtactacatccactggatgcgccaggccccgggccaggggctcgagtggatgggctggatcaaccccaacagcggcgccgtgtcctacgcccggaagttccaggggcgcgtgagcttcctgcacgaccagggcatccggatggcctacatggacctgcgcaacctccggttcgacgacacggcggtctacttctgcgcccgcaagaccgccggggacgtgtccggcgacaaccgggggtacttcttcgacctgtggggccgcggcagccgggtgatcgtctccagc

SEQ ID NO: 10982 - RNA, 381 nt, synthetic construct
  misc_feature 1..381: note = derived and/or modified sequence opt1 from anti-HIV-1_HeavyChain
  source 1..381: mol_type = other RNA
caggtgcacatggagcaggccggcgtcgaggtggagaagcccggggccagcgtgaccctgtcctgcaagaccgcggacgaggacgtcttcgacgccgcctacatgcactgggtgcgccaggccccgggccagacgttcgagtggctcgggtggatgaagcccgtgaccggcgccgtcaactacgcgcggaagttccaggggcgcgtgagcttctaccggacccgcgagctgggcatcgcctacatggacctgcggaacctccgcttcgacgacaccgccgtgtacttctgcgcccggaagacggcgggcgacgtctccggggacaagcgcggcttcttcttcgacctgtgggggcggggcagccgcgtgatcgtgtccagc

SEQ ID NO: 10983 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgccggggtcaagaagcccggcgcgagcgccaccctgtcctgcaagaccgccgacgaggacgtgttcgacgccgcctacatgcactgggtgcgccaggcgccggggcagacgttcgagtggctcggctggatgaagcccgtcaccggggccgtgagctacgcccggaagttccagggccgcgtgtccttctacatgacccgggagctgggcatggcctacatggacctgcgcaacctccggttcgacgacaccgcggtctacttctgcgcccgcaagacggccggggacgtgagcggcgacaaccgggggtacttcttcgacctgtggggccgcgggtcccgggtgatcgtcagctcc

SEQ ID NO: 10984 - RNA, 375 nt, synthetic construct
  misc_feature 1..375: note = derived and/or modified sequence opt1 from anti-HIV-1_HeavyChain
  source 1..375: mol_type = other RNA
ggccacgacctggagcagagcgggtccggcgtgaagaagcccggggccagcgtccgcgtgtcctgctggaccagcgaggacatcttcgagaagtccgagctcatccactgggtgcggcaggccccgggccaggggctggagtggatcggctgggtcaaggcggtgagcggcgccgtgaactacgggtccctggacttccgccaccgggtcagcctcacccgcgaccgggacctgttcacggcccacatggacatccgcggcctgacccaggacgacaccgccatctacttctgcgcccggcagaagttcgcgcgcggggaccagggctggttcttcgacctctgggggcggggcaccctgatcgtggtgtccagc

SEQ ID NO: 10985 - RNA, 378 nt, synthetic construct
  misc_feature 1..378: note = derived and/or modified sequence opt1 from anti-HIV-1_HeavyChain
  source 1..378: mol_type = other RNA
caggcccaccgcggcaccatctgggggctggaggtgaagaagcccggcgggtgggtccgggtgagctgctggacctccgaggacatcttcgagcgcacggagctcatccactgggtgcggcaggccccgggccaggggctggagtggatcggctgggtcaagaccgtgaccggcgcggtgaacttcgggagccccaacttccgccaccgggtctccctgacccgcgaccgggacctcttcacggcccacatggacatccgcggcctgacccagggggacaccgccacctacttctgcgcccggcagaagttcgagcgcggcgggcagggctggtacttcgacctgtggggccgggggacgctcatcgtggtgagctcc

SEQ ID NO: 10986 - RNA, 381 nt, synthetic construct
  misc_feature 1..381: note = derived and/or modified sequence opt1 from anti-HIV-1_HeavyChain
  source 1..381: mol_type = other RNA
caggtgcacatggagcaggccggcgccggggtcgagaagcccggcgcgagcgtgaccctgtcctgcaagaccgccgacgaggacgtgttcgacgccgcctacatgcactgggtccgccaggccccggggcagacgttcgagtggctcggctggatgaagcccgtgaccggggcggtgagctacgcccggaagttccagggccgcgtctccttctacatgacccgggagctgggcatggcctacatggacctgcgcaacctccggttcgacgacaccgccgtgtacttctgcgcgcgcaagacggccggggacgtgagcggcgacaaccgggggtacttcttcgacctgtggggccgcgggtcccgggtcatcgtgagctcc

SEQ ID NO: 10987 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcagagcggcgggggcgtcaagaagcccggggcctccgtgaccctgagctgcaagaccgccgacgaggacgtgttcgacgcggcctacatgcactgggtccgccaggccccgggccagacgttcgagtggctcgggtggatgaagcccgtgaccggcgccgtgtcctacgcccggaagttccagggccgcgtcagcttctacatgacccgggagctggggatggcgtacatggacctgcgcaacctccggttcgacgacaccgccgtgtacttctgcgcccgcaagacggccggcgacgtgtccggggacaaccggggctacttcttcgacctgtgggggcgcggcagccgggtcatcgtgtccagc

SEQ ID NO: 10988 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcagagcggcgggggcgtcaagaagcccggggcctccgtgaccctgagctgcaagaccgccgacgaggacgtgttcgacgcggcctacatgcactgggtccgccaggccccgggccagacgttcgagtggctcgggtggatgaagcccgtgaccggcgccgtgaactacgcccggaagttccagggccgcgtctccttctaccggacccgcgagctggggatcgcgtacatggacctgcggaacctccgcttcgacgacaccgccgtgtacttctgcgcccggaagacggccggcgacgtgagcggggacaagcgcggcttcttcttcgacctgtgggggcggggctcccgcgtcatcgtgagctcc

SEQ ID NO: 10989 - RNA, 381 nt, synthetic construct
  misc_feature 1..381: note = derived and/or modified sequence opt1 from anti-HIV-1_HeavyChain
  source 1..381: mol_type = other RNA
gaggtgtacatggagcagagcggcgggggcgtcaagaagcccggggcctccgtgaccctgagctgcaagaccgcctccgaggacgtgttcgacgcggcctacatgcactgggtccgccaggccccgggccagacgttcgagtggctcgggtggatgaagcccgtgaccggcgccgtgaactacgcccggaagttccagggccgcgtcagcttctaccggacccgcgagctggggatcgcgtacatggacctgcggaacctccgcttcgacgacaccgccgtgtacttctgcgcccggaagacggccggcgacgtgtccggggacaagcgcggcttcttcttcgacctgtgggggcggggcagccgcgtcatcgtgtccagc

SEQ ID NO: 10990 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgaagaagcccggggcctccgtgaccctcagctgcaagaccgcggacgaggacgtcttcgacgccgcctacatgcactgggtgcgccaggccccgggccagacgttcgagtggctggggtggatgaagcccgtgaccggcgccgtctcctacgcgcggaagttccaggggcgcgtgagcttctacatgacccgggagctgggcatggcctacatggacctccgcaacctgcggttcgacgacaccgccgtgtacttctgcgcccgcaagacggcgggcgacgtctccggggacaaccggggctacttcttcgacctgtgggggcgcggcagccgggtgatcgtgtccagc

SEQ ID NO: 10991 - RNA, 381 nt, synthetic construct
  misc_feature 1..381: note = derived and/or modified sequence opt1 from anti-HIV-1_HeavyChain
  source 1..381: mol_type = other RNA
caggtgttcatggagcagagcggcgggggcatgaagaagcccggggcctccatgaccgtcagctgcaagaccgccgacgaggacgtgttcgacgcggcctacatgcactgggtgcgccaggccccgggccagacgttcgagtggctggggtggatgaagcccgtcaccggcgccgtgtcctacgcccggaagttccagggccgcgtgagcttctacatgacccgggagctcgggatggcgtacatggacctgcgcaacctgcggttcgacgacaccgccgtctacttctgcgcccgcaagacggccggcgacgtgtccggggacaaccggggctacttcttcgacctctgggggcgcggcagccgggtgatcgtctccagc

SEQ ID NO: 10992 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcatgaagaagcccggggccagcatgaccgtctcctgcaagaccgcggacgaggacatcttcgacgccgcctacatgcactgggtgcgccaggccccgggccagacgttcgagtggctggggtggatgaagcccgtgaccggcgccgtcaactacgcgcggcgcttccagggccgggtgagcttctaccgcacccgggagctcgggatcgcctacatggacctgcgcgacctgaagttcgacgacaccgccgtgtacttctgcgcccggaagacgaagggcgacgtctccggggacgaccgcggcttcttcttcgacctctgggggcggggcacccgcgtgatcgtgagctcc

SEQ ID NO: 10993 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgccggggtcaagaagcccggcgcgagcgtgaccctgtcctgcaaggccgccgacgaggacgtgttcgacgccgcctacatgcactgggtccgccaggcgccggggcagaccttcgagtggctcggctggatgaagcccgtgacgggggccgtgagctacgcccggaagttccagggccgcgtctccttctacatgacccgggagctgggcatggcctacatggacctgcgcaacctccggttcgacgacaccgcggtgtacttctgcgcccgcaagaccgccggggacgtgagcggcgacaaccgggggtacttcttcgacctgtggggccgcgggtcccgggtcatcgtgagctcc

SEQ ID NO: 10994 - RNA, 381 nt, synthetic construct
  misc_feature 1..381: note = derived and/or modified sequence opt1 from anti-HIV-1_HeavyChain
  source 1..381: mol_type = other RNA
caggtgttcatggagcaggccggcgccgggatgaagaagcccggcgcgagcatgaccgtctcctgcaagaccgccgacgaggacatcttcgacgccgcctacatgcactgggtgcgccaggccccggggcagacgttcgagtggctgggctggatgaagcccgtgaccggggcggtcaactacgcccggcagttccagggccgcgtgagcttctaccggacccgcgagctcggcatcgcctacatggacctgcgggacctgaagttcgacgacaccgccgtgtacttctgcgcgcgcaagacgaagggggacgtctccggcgacgaccgggggttcttcttcgacctctggggccgcgggacccgggtgatcgtgagctcc

SEQ ID NO: 10995 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcagcccggcggggaggtcaagaagccgggcgccagcgtgaccctgtcctgcaagaccgccgacgaggacgtgttcgacgcggcctacatgcactgggtccgccaggcccccgggcagacgttcgagtggctcggctggatgaagcccgtgaccggggccgtgaactacgcccggaagttccagggccgcgtcagcttctacatgacccgggagctgggcatggcgtacatggacctgcgcaacctccggttcgacgacaccgccgtgtacttctgcgcccgcaagacggccggggacgtgtccggcgacaaccgggggtacttcttcgacctgtggggccgcgggagccgggtcatcgtgtccagc

SEQ ID NO: 10996 - RNA, 381 nt, synthetic construct
  misc_feature 1..381: note = derived and/or modified sequence opt1 from anti-HIV-1_HeavyChain
  source 1..381: mol_type = other RNA
caggtgcacatggagcaggccggcgccggggtcaagaagcccggcgcgagcgtgaccctgtcctgcaagaccgccgacgaggacgtgttcgacgccgcctacatgcactgggtccgccaggccccggggcagacgttcgagtggctcggctggatgaagcccgtgaccggggcggtgagctacgcccggaagttccagggccgcgtctccttctacatgacccgggagctgggcatggcctacatggacctgcgcaacctccggttcgacgacaccgccgtgtacttctgcgcgcgcaagacggccggggacgtgagcggcgacaaccgggggtacttcttcgacctgtggggccgcgggtcccgggtcatcgtgagctcc

SEQ ID NO: 10997 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaagttccagggccgcgtcagcttctaccggacccgcgagctggggatcgcctacatggacctgcggaacctccgcttcgacgacaccgccgtgtacttctgcgcccggaagacggcgggcgacgtgtccggggacaagcgcggcttcttcttcgacctgtgggggcggggcccccgcgtcatcgtgagctcc

SEQ ID NO: 10998 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgaagaagcccggggcctccgtgaaggtcagctgcaaggcgtccggccacaccttcaccaactacgacatcaactgggtgcgccaggccccggggcagggcctcgagtggatcgggtgggtgaagatcgtcagcggcacggtgaacttcgcctccctggacttccggaaccgcatcagcctgtcccgggaccgcgacctcagcaccgcctacatggacatccggggcctgacccaggacgacaccgccacgtacttctgcgcgcgccagaagttcgcctcccggtacagcggggaccagggctcctacttcgacctgtgggggcgcggcaccctcatcgtggtcagctcc

SEQ ID NO: 10999 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcatgaagaagcccggggccagcatgaccgtctcctgcaagaccgcggacgaggacatcttcgacgccgcctacatgcactgggtgcgccaggccccgggccagacgttcgagtggctggggtggatgaagcccgtgaccggcgccgtcaactacgcgcggcagttccagggccgcgtgagcttctaccggacccgcgagctcgggatcgcctacaccgacctgcgggacctgaagttcgacgacacggccgtgtacttctgcgcccgcaagaccaagggcgacgtctccggggacgaccggggcttcttcttcgacctctgggggcgcggcacccgggtgatcgtgagctcc

SEQ ID NO: 11000 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggcagttccagggccgcgtcagcttctaccggacccgcgagctggggatcgcctacatggacctgcgggacctcaagttcgacgacaccgccgtgtacttctgcgcccgcaagacgaagggcgacgtgtccggggacgaccggggcttcttcttcgacctgtgggggcgcggcacccgggtcatcgtgagctcc

SEQ ID NO: 11001 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggcccgggtggatgaagcccgtgaccggcgccgtgaactacgcgcggaagttccagggccgcgtcagcttctaccggacccgcgagctcgggatcgcctacatggacctgcggaacctgcgcttcgacgacaccgccgtgtacttctgcgcccggaagacggcgggcgacgtgtccggggacaagcgcggcttcttcttcgacctctgggggcggggcagccgcgtcatcgtgtccagc

SEQ ID NO: 11002 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgcgaccctgtcctgcaagaccgccgacgaggacgtgttcgacgccgcctacatgcactgggtgcgccaggccccgggccagacgttcgagtggctcgggtggatgaagcccgtcaccggcgcggtgagctacgcccggaagttccagggccgcgtgtccttctacatgacccgggagctggggatggcctacatggacctgcgcaacctccggttcgacgacaccgccgtctacttctgcgcgcgcaagacggccggcgacgtgagcggggacaaccggggctacttcttcgacctgtgggggcgcggctcccgggtgatcgtcagctcc

SEQ ID NO: 11003 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcgctgggtccggcaggccccgggccagacgttcgagtggctcgggtggatgaagcccgtgaccggcgccgtgaactacgcgcgcaagttccagggccgggtcagcttctaccgcacccgggagctggggatcgcctacatggacctgcgcaacctccggttcgacgacaccgccgtgtacttctgcgcccgcaagacggcgggcgacgtgtccggggacaagcggggcttcttcttcgacctgtgggggcgcggcagccgggtcatcgtgtccagc

SEQ ID NO: 11004 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgaagaagcccggggcctccgtgaaggtcagctgccgcgcgtccggctacaccttcgggaaccacgccatcagctgggtgcggcaggccccgggccaggggctcgagtggatgggctggatccgccccaagaccggcgcccggaaccaggcccgccagttccagccccggatctccctgacgcgcgaccgggcgctgagcaccgcctacctcgacctgaactccctgaccagcgccgactccgggacctacttctgcgcccgccagacgttcaagcccgacttctacttcgcggaccagggctggagcttcaacctctgggggcggggcgcccacttcatcgtgtccagc

SEQ ID NO: 11005 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgagctacgcgcggaagttccagggccgcgtctccttctacatgacccgggagctggggatggcctacatggacctgcgcaacctccggttcgacgacaccgccgtgtacttctgcgcccgcaagacggcgggcgacgtgagcggggacaaccggggctacttcttcgacctgtgggggcccggctcccgcgtcatcgtgagctcc

SEQ ID NO: 11006 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgccggggtcaagaagcccggcgcgagcgtgaccctgtcctgcaagaccgccgacgaggacgtgttcgacgccgcctacatgcactgggtccgccaggccccggggcagacgttcgagtggctcggctggatgaagcccgtgaccggggcggtgaactacgcccggaagttccagggccgcgtcagcttctaccggacccgcgagctgggcatcgcctacatggacctgcggaacctccgcttcgacgacaccgccgtgtacttctgcgcgcggaagacggccggggacgtgtccggcgacaagcgcgggttcttcttcgacctgtggggccgggggagccgcgtcatcgtgtccagc

SEQ ID NO: 11007 - RNA, 381 nt, synthetic construct
  misc_feature 1..381: note = derived and/or modified sequence opt1 from anti-HIV-1_HeavyChain
  source 1..381: mol_type = other RNA
caggtgcacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaagttccagggccgcgtcagcttctaccggacccgcgagctggggatcgcctacatggacctgcggaacctccgcttcgacgacaccgccgtgtacttctgcgcccggaagacggcgggcgacgtgtccggggacaagcgcggcttcttcttcgacctgtgggggcggggcagccgcgtcatcgtgtccagc

SEQ ID NO: 11008 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgacgggatgaagaagcccggcgccagcatgaccgtctcctgcaagaccgcggacgaggacatcttcgacgccgcctacatgcactgggtgcgccaggccccggggcagacgttcgagtggctgggctggatgaagcccgtgaccggggccgtcaactacgcgcggcagttccagggccgcgtgagcttctaccggacccgcgagctcggcatcgcctacatggacctgcgggacctgaagttcgacgacaccgccgtgtacttctgcgcccgcaagacgaagggggacgtctccggcgacgaccgggggttcttcttcgacctctggggccgcgggacccgggtgatcgtgagctcc

SEQ ID NO: 11009 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgaagaagcccggggcctccgtgaccctcagctgcaagaccgcggacgaggacgtcttcgacgccgcctacatgcactgggtgcgccaggcccagggccagacgttcgagtggctggggtggatgaagccggtgaccggcgccgtcaactacgcgcggaagttccaggggcgcgtgtccttctaccggacccgcgagctgggcatcgcctacatggacctccggaacctgcgcttcgacgacaccgccgtgtacttctgcgcccggaagacggcgggcgacgtcagcggggacaagcgcggcttcttcttcgacctgtgggggcggggctcccgcgtgatcgtgagctcc

SEQ ID NO: 11010 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaagttccagggccgcgtcagcttctaccggacccgcgagctggggatcgcctacatggacctgcggaacctccgcttcgacgacaccgccgtgtacttctgcgcccggaagacggcgggcgacgtgtccggggacaagcgcggcttcttcttcgacctgtgggggcggggcagccaggtcatcgtgtccagc

SEQ ID NO: 11011 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgcgcaagcccggggcctccgtgaaggtcagctgcaaggcgtccggctacaccttcaccaactactacatgcactgggtgcggcaggccccggggcagggcctcgagtggatcgggtgggtgaagatcgtcagcggcacggtgaacttcgcctccctggacttccgcaaccggatcagcctgtcccgcgaccgggacctcagcaccgcctacatggacatccgcggcctgacccaggacgacaccgccacgtacttctgcgcgcggcagaagttcgcctcccgctacagcggggaccagggctcctacttcgacctgtgggggcggggcaccctcatcgtggtcagctcc

SEQ ID NO: 11012 - RNA, 381 nt, synthetic construct
  misc_feature 1..381: note = derived and/or modified sequence opt1 from anti-HIV-1_HeavyChain
  source 1..381: mol_type = other RNA
caggcccacctggagcagagcggctccggggtgaagaagcccggcgccagcgtccgcgtgtcctgctggaccagcgaggacatcttcgagcggaccgagctcatccactgggtgcgccaggcgccggggcagggcctggagtggatcgggtgggtcaagacggtgaccggcaccgtgaactacgcccggaagttccagggccgcgtctccttctaccggacccgcgagctggggatcgcctacatggacctccggaacctgcgcttcgacgacacggccgtgtacttctgcgcccggaagaccgcgggcgacgtgagcggggacaagcgcggcttcttcttcgacctgtgggggcggggctcccgcgtcatcgtgagctcc

SEQ ID NO: 11013 - RNA, 381 nt, synthetic construct
  misc_feature 1..381: note = derived and/or modified sequence opt1 from anti-HIV-1_HeavyChain
  source 1..381: mol_type = other RNA
ctgatccacctcgcccagagcggcgccgaggtgaagaagcccggggcgtccgtcaccctgagctgcaagaccgccgacgaggacgtgttcgacgccgcctacatgcactgggtgcgccaggccccgggccagacgttcgagtggctggggtggatgaagcccgtcaccggcgcggtgtcctacgcccggaagttccaggggcgcgtgagcttctacatgacccgggagctcggcatggcctacatggacctgcgcaacctgcggttcgacgacaccgccgtctacttctgcgcgcgcaagacggccggcgacgtgtccggggacaaccggggctacttcttcgacctctgggggcgcggcagccgggtgatcgtctccagc

SEQ ID NO: 11014 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgaagaagcccggggcctccatgaccgtgagctgcaagaccgcggacgaggacatcttcgacgccgcctacatgcactgggtccgccaggccccgggccagacgttcgagtggctcgggtggatgaagcccgtgaccggcgccgtgaactacgcgcggcagttccaggggcgcgtctccttctaccggacccgcgagctgggcatcgcctacatggacctgcgggacctcaagttcgacgacaccgccgtgtacttctgcgcccgcaagacgaagggcgacgtgagcggggacgaccggggcttcttcttcgacctgtgggggcgcggcacccgggtcatcgtgtccagc

SEQ ID NO: 11015 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcagggccgcgggggcgtcaagaagcccggggccagcgtgaccctgtcctgcaagaccgccgacgaggacgtgttcgacgcggcctacatgcactgggtccggcaggccccgggccagacgttcgagtggctcgggtggatgaagcccgtgaccggcgccgtgaactacgcccgcaagttccagggccgggtcagcttctaccgcacccgggagctggggatcgcgtacatggacctgcgcaacctccggttcgacgacaccgccgtgtacttctgcgcccgcaagacggccggcgacgtgtccggggacaagcggggcttcttcttcgacctgtgggggcgcggcagccgggtcatcgtgtccagc

SEQ ID NO: 11016 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcatgaagaagcccggggccagcatgaccgtctcctgcaagaccgcggacgaggacgtgttcgacgccgcctacatgcactgggtgcgccaggccccgggccagacgttcgagtggctggggtggatgaagcccgtcaccggcgccgtgaactacgcgcggcagttccagggccgcgtgagcttctaccggacccgcgagctcgggatcgcctacatggacctgcgggacctgaagtccgacgacaccgccgtctacttctgcgcccgcaagacggcgggcgacgtgagcggggacaagcggggcttcttcttcgacctctgggggcgcggctcccgggtgatcgtcagctcc

SEQ ID NO: 11017 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgaagaagcccgggtccagcatcaaggtgtcctgcaaggccagcggcgacaccatctcccgctacgcgatcaactgggtccggcaggccccggggcagggcctcgagtggatcgggtgggtgaagaccgtgacgggcgccgtcaacttcggcagcctggacttccgccaccggatctccctgacccgcgaccgggacctcttcaccgcccacatggggatccgcggcctgacccagggggacacggccacctacttctgcgcgcggcagaagttcgagagccgctacaccggcgggcagggctggtacttcgacctgtggggccgggggacccacatcgtggtgtccagc

SEQ ID NO: 11018 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacatcttcgacgccgcctacatgcactgggtgcgccaggccccgggccagacgttcgagtggctcgggtggatgaagcccgtcaccggcgccgtgaactacgcgcggaagttccagggccgcgtgagcttctaccggacccgcgagctggggatcgcctacatggacctgcggaacctccgcttcgacgacaccgccgtctacttctgcgcccggaagacggcgggcgacgtgtccggggacaagcgcggcttcttcttcgacctgtgggggcggggcagccgcgtgatcgtctccagc

SEQ ID NO: 11019 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaacttccagggccgcgtcagcttctaccggacccgcgagctggggatcgcctacatggacctgcggaacctccgcttcgacgacaccgccgtgtacttctgcgcccggcagaagttcgagtcccgctacagcggcgaccaggggtcctacttcgacctgtggggccgggggacgctgatcatcgtgagctcc

SEQ ID NO: 11020 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagcgccccggggccagcgtgaccctgtcctgcaagaccgcggacgaggacgtgttcgacgccgcctacatgcactgggtccggcaggccccgggccagacgttcgagtggctcgggtggatgaagcccgtgaccggcgccgtgaactacgcgcgcaagttccagggccgggtcagcttctaccgcacccgggagctggggatcgcctacatggacctgcgcaacctccggttcgacgacaccgccgtgtacttctgcgcccgcaagacggcgggcgacgtgtccggggacaagcggggcttcttcttcgacctgtgggggcgcggcagccgggtcatcgtgtccagc

SEQ ID NO: 11021 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgacgaggtgaagaagcccggggcctccgtgaccctcagctgcaagaccgccgacgaggacgtcttcgacgcggcctacatgcactgggtgcgccaggccccgggccagacgttcgagtggctggggtggatgaagcccgtgaccggcgccgtcaactacgcccggaagttccaggggcgcgtgtccttctaccggacccgcgagctgggcatcgcgtacatggacctccggaacctgcgcttcgacgacaccgccgtgtacttctgcgcccggaagacggccggcgacgtcagcggggacaagcgcggcttcttcttcgacctgtgggggcggggctcccgcgtgatcgtgagctcc

SEQ ID NO: 11022 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccggggtgaagaagcccggctccagcgtgaaggtctcctgcaaggccagcgggggcaccttctccagctacgcgatcaactggctccgccaggtgccggggcagcggcccgagtggatgggctggatccgccccaagaccggcgcccggaaccaggcccgccagttccagccccggatctccctgacgcgcgaccgggccctgagcaccgcctacctcgacctgaactccctgaccagcgcggactccgggacctacttctgcgcccgccagacgttcaagccggacttctacttcgccgaccagggctggagcttcaacctctgggggcggggcgcccacttcatcgtgtccagc

SEQ ID NO: 11023 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcgcgccggcgggggcgtcaagaagcccggggccagcgtgaccctgtcctgcgagaccgcggacgaggacgtgttcgacgccgcctacatgcactgggtccggcaggccccgggccagacgttcgagtggctcgggtggatgaagcccgtgaccggcgccgtgaactacgcgcgcaagttccagggccgggtcagcttctaccgcacccgggagctggggatcgcctacatggacctgcgcaacctccggttcgacgacaccgccgtgtacttctgcgcccgcaagacggcgggcgacgtgtccggggacaagcggggcttcttcttcgacctgtgggggcgcggcagccgggtcatcgtgtccagc

SEQ ID NO: 11024 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgccgggatgaagaagcccggcgcgagcatgaccgtctcctgcaagaccgccgacgaggacatcttcgacgccgcctacatgcactgggtgcgccaggccccggggcagacgttcgagtggctgggctggatgaagcccgtgaccggggcggtcaactacgcccggcagttccagggccgcgtgagcttcctccaggaccagggcatccggatcgcctacatggacctgcgcgacctgaagttcgacgacaccgccgtgtacttctgcgcgcggaagaccaagggggacgtctccggcgacgaccgcgggttcttcttcgacctctggggccgggggacgcgcgtgatcgtgagctcc

SEQ ID NO: 11025 - RNA, 381 nt, synthetic construct
  misc_feature 1..381: note = derived and/or modified sequence opt1 from anti-HIV-1_HeavyChain
  source 1..381: mol_type = other RNA
caggtgtacatgggcgccgggcgcggcggggtcaagaagcccggcgccagcgtgaccctgtcctgcaagaccgcggacgaggacgtgttcgacgccgcctacatgcactgggtccggcaggccccggggcagacgttcgagtggctcggctggatgaagcccgtgaccggcgccgtgaactacgcgcgcaagttccaggggcgggtcagcttctaccgcacccgggagctgggcatcgcctacatggacctgcgcaacctccggttcgacgacaccgccgtgtacttctgcgcccgcaagacggcgggggacgtgtccggcgacaagcgggggttcttcttcgacctgtggggccgcggcagccgggtcatcgtgtccagc

SEQ ID NO: 11026 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgccggggtcaagaagcccggcgcgagcgtgaccctgtcctgcaagaccgccgacgaggacgtgttcgacgccgcctacatgcactgggtccgccaggccccggggcagcccttcgagtggctcggctggatgaagcccgtgacgggggcggtgagctacgcccggaagttccagggccgcgtctccttctacatgacccgggagctgggcatggcctacatggacctgcgcaacctccggttcgacgacaccgccgtgtacttctgcgcgcgcaagaccgccggggacgtgagcggcgacaaccgggggtacttcttcgacctgtggggccgcgggtcccgggtcatcgtgagctcc

SEQ ID NO: 11027 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgaagaagcccggggcctccgtgaagatcagctgcaaggcgtccggctacaccttcatccgccacgggatccactggctccggcaggtcccgggccagcgccccgagtggatggggtggatccggcccaagaccggcgcccgcaaccaggcccggcagttccagccccgcatcagcctggcccgggaccgcgccctgtccacggcgtacctcgacctgaacagcctgacctccgccgacagcggcacctacttctgcgcccggcagaccttcaagccggacttctacttcgccgaccaggggtggtccttcaacctctggggccgcggggcgcacttcatcgtgagctcc

SEQ ID NO: 11028 - RNA, 381 nt, synthetic construct
  misc_feature 1..381: note = derived and/or modified sequence opt1 from anti-HIV-1_HeavyChain
  source 1..381: mol_type = other RNA
caggtgctgctcgtccagagcggcgccgaggtgaagaagcccgggtccagcgtgaaggtctcctgcaaggccagcggcgactccctgaccaagtacgcgttcagctgggtgcggcaggccccggggcagggccccgagtggatggggtggatccggcccaagaccggcgcccgcaaccgggcccgccagttccagccccggatctccctgacgcgcgaccgggccctcagcaccgcgtacctggacctgaactccctcaccagcgccgactccggcacctacttctgcgcccgccagacgttcaagccggacttctacttcgccgaccaggggtggagcttcaacctgtggggccgcggggcgcacttcatcgtgtccagc

SEQ ID NO: 11029 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggcccggggccagacgttcgagtggctcgggtggatgaagccggtgaccggcgccgtgaactacgcgcgcaagttccagggccgggtcagcttctaccgcacccgggagctggggatcgcctacatggacctgcgcaacctccggttcgacgacaccgccgtgtacttctgcgcccgcaagacggcgggcgacgtgtccggggacaagcggggcttcttcttcgacctgtgggggcgcggcagccgggtcatcgtgtccagc

SEQ ID NO: 11030 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaagttccagggccgcgtcagcttctaccggacccgcgagctggggatcgcctacatggacctgcggaacctccgcttcgacgacaccgccgtgtacttctgcgcccggaagacggcgggcgacgtgtccggggacaaccgcggctacttcttcgacctgtgggggcggggcagccgcgtcatcgtgtccagc

SEQ ID NO: 11031 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgaactacgcgcggaagttccagggccgcgtcagcttctaccggacccgcgagctggggatcgcctacatggacctgcggaacctccgcttcgacgacaccgccgtgtacttctgcgcccggaagacggcgggcgacgtgtccggggacaagcgcggcttcttcttcgacctgtgggggcccggcagccgggtcatcgtgtccagc

SEQ ID NO: 11032 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcatgaagaagcccggggccagcatgaccgtctcctgcaagaccgcggacgaggacatcttcgacgccgcctacatgcgctgggtgcggcaggccccgggccagacgttcgagtggctggggtggatgaagcccgtgaccggcgccgtcaactacgcgcgccagttccagggccgggtgagcttctaccgcacccgggagctcgggatcgcctacatggacctgcgcgacctgaagttcgacgacaccgccgtgtacttctgcgcccggaagacgaagggcgacgtctccggggacgaccgcggcttcttcttcgacctctgggggcggggcacccgcgtgatcgtgagctcc

SEQ ID NO: 11033 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatgaagcccgtgaccggcgccgtgagctacgcgcggaagttccagggccgcgtctccttctacatgacccgggagctggggatggcctacctggacctccgcaacctgcggttcgacgacaccgccgtgtacttctgcgcccgcaagacggcgggcgacgtgagcggggacaaccggggctacttcttcgacctgtgggggcgcggctcccgggtcatcgtgagctcc

SEQ ID NO: 11034 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgaagaagcccggggcctccgtgaaggtcagctgcaaggcgtccggctacaccttcaccgggtactacatgcactgggtgcgccaggccccgggccaggggctcgagtggatcggctgggtgaagacggtcaccggcgccgtgaacttcgggagcctggacttccggcaccgcatctccctgacccgggaccgcgacctcttcaccgcccacatggacatccggggcctgacgcagggggacaccgccacctacttctgcgcgcgccagaagttcgagagccggtacaccggcgggcagggctggtacttcgacctgtggggccgcgggacgcacatcgtggtctccagc

SEQ ID NO: 11035 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatcaagcccgtgaccggcgccgtgaactacgcgcggaagttccagggccgcgtcagcttctaccggacccgcgagctggggatcgcctacatggacctgcggaacctccgcttcgacgacaccgccgtgtacttctgcgcccggaagacggcgggcgacgtgtccggggacaagcgcggcttcttcttcgacctgtgggggcggggcagccgcgtcatcgtgtccagc

SEQ ID NO: 11036 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcatgaagaagcccggggccagcgtcaccgtgtcctgcaagaccgcggacgaggacatcttcgacgccgcctacatgcactgggtgcgccaggccccgggccagacgttcgagtggctggggtggatgaagcccgtcaccggcgccgtgaactacgcgcggcagttccagggccgcgtgagcttctaccggacccgcgagctcgggatcgcctacatggacctgcgggacctgaagttcgacgacaccgccgtctacttctgcgcccgcaagacgaagggcgacgtgtccggggacgaccggggcttcttcttcgacctctgggggcgcggcacccgggtgatcgtcagctcc

SEQ ID NO: 11037 - RNA, 381 nt, synthetic construct
  misc_feature 1..381: note = derived and/or modified sequence opt1 from anti-HIV-1_HeavyChain
  source 1..381: mol_type = other RNA
caggcccacctggagcagagcggctccggggtgaagaagcccggcgccagcgtccgcgtgtcctgctggagctccgaggacatcagcaaggcggagctcatccactgggtgcggcaggccccggggcagggcctggagtggatcgggtgggtcaagaccgtgaccggcgccgtgaacttcggctccctggacttccgccaccggatcagcctcacgcgcgaccgggacctgttcaccgcccacatggacatccgcgggctgacccagggcgacaccgccacgtacttctgcgcgcggcagaagttcgagtcccgctacaccgggggccaggggtggtacttcgacctctggggccggggcacccacatcgtcgtgagctcc

SEQ ID NO: 11038 - RNA, 381 nt, synthetic construct
  misc_feature 1..381: note = derived and/or modified sequence opt1 from anti-HIV-1_HeavyChain
  source 1..381: mol_type = other RNA
caggtgtacatggaggccggccgcgggggcgtcaagaagcccggggccagcgcgaccctgtcctgcaagaccgccgacgaggacgtgttcgacgccgcctacatgcactgggtgcggcaggccccgggccagacgttcgagtggctcgggtggatgaagcccgtcaccggcgcggtgagctacgcccgcaagttccagggccgggtgtccttctacatgacccgcgagctggggatggcctacatggacctgcggaacctccgcttcgacgacaccgccgtctacttctgcgcgcggaagacggccggcgacgtgagcggggacaaccgcggctacttcttcgacctgtgggggcggggctcccgcgtgatcgtcagctcc

SEQ ID NO: 11039 - RNA, 381 nt, synthetic construct
  misc_feature 1..381: note = derived and/or modified sequence opt1 from anti-HIV-1_HeavyChain
  source 1..381: mol_type = other RNA
cgctgcatctggcggcaggccggcgggggcgtgaagaagcccggggccagcgtcaccctgtcctgcaagaccgcggacgaggacgtgttcgacgccgcctacatgcactgggtgcgccaggccccgggccagacgttcgagtggctcgggtggatgaagcccgtcaccggcgccgtgagctacgcgcggaagttccagggccgcgtgtccttctacatgacccgggagctggggatggcctacatggacctgcgcaacctccggttcgacgacaccgccgtctacttctgcgcccgcaagacggcgggcgacgtgagcggggacaaccggggctacttcttcgacctgtgggggcgcggctcccgggtgatcgtcagctcc

SEQ ID NO: 11040 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcactgggtccgccaggccccgggccagacgttcgagtggctcgggtggatcaagcccgtgaccggcgccgtgagctacgcgcggaagttccagggccgcgtctccttctacatgacccgggagctggggatggcctacatggacctgcgcaacctccggttcgacgacaccgccgtgtacttctgcgcccgcaagacggcgggcgacgtgagcggggacaaccggggctacttcttcgacctgtgggggcgcggctcccgggtcatcgtgagctcc

SEQ ID NO: 11041 - RNA, 384 nt, synthetic construct
  misc_feature 1..384: note = derived and/or modified sequence opt1 from anti-HIV-1_HeavyChain
  source 1..384: mol_type = other RNA
cagagccacctggagcagtccggcagcgccatgaagaagcccggggcctccgtcaagagctcctgctggaccagcgaggacatcttcgacaccacggagctcatctactgggtgcgccaggcgccgggccaggggctggagtggatcggctgggtgaagatcgtgtccgggaccgtcaacttcgccagcctggacttccggaaccgcatctccctcagccgggaccgcgacctgtccaccgcctacatggacatccggggcctgacccaggacgacacggccacctacttctgcgcccgccagaagttcgcgagccggtactccggcgaccaggggagctacttcgacctctggggccgcgggaccctgatcgtggtgtccagc

SEQ ID NO: 11042 - RNA, 381 nt, synthetic construct
  misc_feature 1..381: note = derived and/or modified sequence opt1 from anti-HIV-1_HeavyChain
  source 1..381: mol_type = other RNA
cgctgcctgtggcggcaggccggcgggggcatgaagaagcccggggccagcatgaccgtgtcctgcaagaccgcggacgaggacgtcttcgacgccgcctacatgcactgggtgcgccaggccccgggccagacgttcgagtggctcgggtggatgaagcccgtgaccggcgccgtcaactacgcgcggaagttccagggccgcgtgagcttctaccggacccgcgagctggggatcgcctacatggacctgcggaacctccgcttcgacgacaccgccgtgtacttctgcgcccggaagacggcgggcgacgtctccggggacaagcgcggcttcttcttcgacctgtgggggcggggcagccgcgtgatcgtgtccagc

SEQ ID NO: 11043 - RNA, 381 nt, synthetic construct
  misc_feature 1..381: note = derived and/or modified sequence opt1 from anti-HIV-1_HeavyChain
  source 1..381: mol_type = other RNA
cgctgcatctgggagcgggccggcgggggcatgaagaagcccggggccagcatgaccgtgtcctgcaagaccgcggacgaggacatcttcgacgccgcctacatgcactgggtccgccaggccccgggccagacgttcgagtggctggggtggatgaagcccgtgaccggcgccgtgaactacgcgcggcagttccagggccgcgtcagcttctaccggacccgcgagctcgggatcgcctacatggacctgcgggacctgaagttcgacgacaccgccgtgtacttctgcgcccgcaagacgaagggcgacgtgtccggggacgaccggggcttcttcttcgacctctgggggcgcggcacccgggtcatcgtgagctcc

SEQ ID NO: 11044 - RNA, 381 nt, synthetic construct
  misc_feature 1..381: note = derived and/or modified sequence opt1 from anti-HIV-1_HeavyChain
  source 1..381: mol_type = other RNA
caggtgcagctggagcaggccggcgggggcgtcaagaagcccggggccagcgtgaccctctcctgcaagaccgcggacgaggacgtgttcgacgccgcctacatgcactgggtccgccaggccccgggccagacgttcgagtggctggggtggatgaagcccgtgaccggcgccgtgaactacgcgcggaagttccagggccgcgtcagcttctaccggacccgcgagctggggatcgcctacatggacctccggaacctgcgcttcgacgacaccgccgtgtacttctgcgcccggaagacggcgggcgacgtgtccggggacaagcgcggcttcttcttcgacctgtgggggcggggcagccgcgtcatcgtgtccagc

SEQ ID NO: 11045 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcatgaagaagcccggggccagcatgaccgtctcctgcaagaccgcggacgaggacgtgttcgacgccgcctacatgcactgggtgcgccaggccccgggccagacgttcgagtggctggggtggatgaagcccgtcaccggcgccgtgaactacgcgcggaagttccagggccgcgtgagcttctaccggacccgcgagctcgggatcgcctacatggacctgcggaacctgcgcttcgacgacaccgccgtctacttctgcgcccggaagacggcgggcgacgtgtccggggacaagcgcggcttcttcttcgacctctgggggcggggcagccgcgtgatcgtctccagc

SEQ ID NO: 11046 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcgggggcgtcaagaagcccggggccagcgtgaccctgtcctgcaagaccgcggacgaggacgtgttcgacgccgcctacatgcgctgggtccggcaggccccgggccagacgttcgagtggctcgggtggatgaagcccgtgaccggcgccgtgagctacgcgcgcaagttccagggccgggtctccttctacatgacccgcgagctggggatggcctacatggacctgcggaacctccgcttcgacgacaccgccgtgtacttctgcgcccggaagacggcgggcgacgtgagcggggacaaccgcggctacttcttcgacctgtgggggcggggctcccgcgtcatcgtgagctcc

SEQ ID NO: 11047 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcagcccggcgggggcgtcaagaagccgggggccagcgtgaccctgtcctgcaagaccgccgacgaggacgtgttcgacgcggcctacatgcactgggtccgccaggcccccggccagacgttcgagtggctcgggtggatgaagcccgtgaccggcgccgtgagctacgcccggaagttccagggccgcgtctccttctacatgacccgggagctggggatggcgtacatggacctgcgcaacctccggttcgacgacaccgccgtgtacttctgcgcccgcaagacggccggcgacgtgagcggggacaaccggggctacttcttcgacctgtgggggcgcggctcccgggtcatcgtgagctcc

SEQ ID NO: 11048 - RNA, 381 nt, synthetic construct
  misc_feature 1..381: note = derived and/or modified sequence opt1 from anti-HIV-1_HeavyChain
  source 1..381: mol_type = other RNA
caggtgtacatggagcaggccggcggggaggtcaagaagcccggcgccagcgtgaccctgtcctgcaagaccgcggacgaggacgtgttcgacgccgcctacatgcactgggtccgccaggccccggggcagacgttcgagtggctcggctggatgaagcccgtgaccggggccgtgagctacgcgcggaagttccagggccgcgtctccttctacatgacccgggagctgggcatggcctacatggacctgcgcaacctccggttcgacgacaccgccgtgtacttctgcgcccgcaagacggcgggggacgtgagcggcgacaaccgggggtacttcttcgacctgtggggccgcgggtcccgggtcatcgtgagctcc

SEQ ID NO: 11049 - RNA, 381 nt, synthetic construct
  misc_feature 1..381: note = derived and/or modified sequence opt1 from anti-HIV-1_HeavyChain
  source 1..381: mol_type = other RNA
caggtgcagctggtccagagcggcgccgaggtgaagaagcccggggcctccgtgcgcgtcagctgccaggcgtccggctacatcttcaccgggtacttcgtgaactggctccggcagctgccgggccagcgccccgagtggatggggtggatccggcccaagagcggcgcccgcaaccaggcccggcagttccagccccgcatctccctgacccgggaccgcgccctcagcacggcctacctggactccaacagcctgacctccgcggacagcggcacctacttctgcgcccggcagaccttcaagccggacttctacttcgccgaccaggggtggtccttcaacctctggggccgcggggcccacttcatcgtgagctcc

SEQ ID NO: 11050 - RNA, 381 nt, synthetic construct
  misc_feature 1..381: note = derived and/or modified sequence opt1 from anti-HIV-1_HeavyChain
  source 1..381: mol_type = other RNA
ggctgcatctggacccaggccgggggcggggtgaagaagcccggcgccagcgtcaccctgtcctgcaagacggcggacgaggacgtgttcgacgccgcctacatgcactgggtgcgccaggccccggggcagaccttcgagtggctcggctggatgaagcccgtcaccggcgccgtgagctacgcgcggaagttccaggggcgcgtgtccttctacatgacccgggagctgggcatggcctacatggacctgcgcaacctccggttcgacgacacggccgtctacttctgcgcccgcaagaccgcgggggacgtgagcggcgacaaccgggggtacttcttcgacctgtggggccgcggctcccgggtgatcgtcagctcc

SEQ ID NO: 11051 - RNA, 381 nt, synthetic construct
  misc_feature 1..381: note = derived and/or modified sequence opt1 from anti-HIV-1_HeavyChain
  source 1..381: mol_type = other RNA
cgctgcatctggcggcaggccggcgggggcatgaagaagcccggggccagcatgaccgtgtcctgcaagaccgcggacgaggacatcttcgacgccgcctacatgcactgggtccgccaggccccgggccagacgttcgagtggctggggtggatgaagcccgtgaccggcgccgtgaactacgcgcggcagttccagggccgcgtcagcttctaccggacccgcgagctcgggatcgcctacatggacctgcgggacctgaagttcgacgacaccgccgtgtacttctgcgcccgcaagacgaagggcgacgtgtccggggacgaccggggcttcttcttcgacctctgggggcgcggcacccgggtcatcgtgagctcc
